United States Patent 11,981,905 (POLYNUCLEOTIDE SEQUENCES AND PROTEINS ENCODED THEREBY USEFUL FOR MODIFYING PLANT CHARACTERISTICS) - sequence listing, part 13

SEQ ID NO: 37464 - DNA, 1297 bp, Panicum virgatum
  misc_feature: Ceres CLONE 1990105
  misc_feature: Encodes the peptide sequence at SEQ ID NO. 37465
cacgaacccaccctccccgattcaaaccgtcgccgccgtcgccgagtgagtcgtgagcggcggcccgcgaccacccgttcccacccgtcgcgtctccgggaaccacatttgcgcccgccccctccgcttccttcccccctcgccgtggcccgagagctgaggctgagctgcctcgggcgggtggggtcgtcgtccgcccggcggctgcggcggcggcggcggcggcggttacgaggctgggcgaattccggcgcggggcgccgcgatccccgcagtgatgtgcggatcggagcatgggtgtgaccccaccggcaagtagcggcggctggcggagggctcggagcgggagctgcggacacgaccatgtacatcgcgcgggaggcaaccaagctgtggaggaaggtgagcgcggagacgacggcggagctgcagcttctgctggagaagtggcaactgctgcttgcaggattggtgttccagtacattcatggattggctgctcgaggggtacattacttgcaccgacccggaccactgctccaggacttgggatttatggcccttccggaacttggacaagagaaaggttatcttagcgagagcgtattcactttcatcttcatttcctttctgttgtggagttttcacccttttatttatcatagcaaacgtttctacactgttctactgtggcgaagggtgctggcatttttagttgcttcacaatttttacggattgtcacactttactccactcaacttcccggtccaaattatcactgccgtgagggctcaaaacttgccactcttccaccaccaaataatgcacttgaagtgctcctgattaactttcctcgtggagtgctttttggttgtggtgatctgatattctcatctcacatgatctttaccctagtttttgtgcgcacatactataaatatggatcaaacaggttgattaagctccttgcttggctgatggctataattcagagtcttcttataattgcttctcgcaagcactacaccgtggatgttgttgttgcttggtacactgttaatctggttgtattctttgttgataagaagctgccagaaatgccagatcgtacaaatggattatctctgcttccagtgagctcaaaagataaagacggcaggatgaaggaagagctccacaaacttgatggaaggatgaaggatgagttccataaattgttaaatgggaacactgtcgatgctactgatcgggtactatagaacacttcgtatcacctcaaaatttctgaatcaccat

SEQ ID NO: 37465 - protein, 298 aa, Panicum virgatum
  misc_feature: Ceres CLONE 1990105
  misc_feature: SWISSPROT Homolog: EC 2.7.8.27 Sphingomyelin synthase
MYIAREATKLWRKVSAETTAELQLLLEKWQLLLAGLVFQYIHGLAARGVHYLHRPGPLLQDLGFMALPELGQEKGYLSESVFTFIFISFLLWSFHPFIYHSKRFYTVLLWRRVLAFLVASQFLRIVTLYSTQLPGPNYHCREGSKLATLPPPNNALEVLLINFPRGVLFGCGDLIFSSHMIFTLVFVRTYYKYGSNRLIKLLAWLMAIIQSLLIIASRKHYTVDVVVAWYTVNLVVFFVDKKLPEMPDRTNGLSLLPVSSKDKDGRMKEELHKLDGRMKDEFHKLLNGNTVDATDRVL

SEQ ID NO: 37466 - DNA, 677 bp, Panicum virgatum
  misc_feature: Ceres CLONE 1990128
  misc_feature: Encodes the peptide sequence at SEQ ID NO. 37467
ataagcgcccccccactgtttcccctatctccatttccaagagcaagacctgaggaagcagccatggcggtgtcgatcgagctcaccaaggagtacgggtacgtcgtgctggtgctggtggcctacgccttcctcaacttctggatgagcttccaggtcggcaaggcccgcaaaaagtacaaggtgttctaccccaccatgtacgccgtcgagtcggagaacaaggacgccaagctcttcaactgcgtgcagagggggcatcagaactcgctggagatgatgcccatgttcttcgtcatgctgctgctcggcggtctgcagcacccgaccatcgccgccggactgggcgccttctacacggtcgcgaggttcttctacttcaagggatacgccaccggcgtcccggagaaccgtctcaagattgggtaagtttgcattcctagtggggcctgtgtcagatgcacaagattgctgataaaatggtatcaaagcacggattttctttcattattttgcgcaatttcagaaaacacaaatcatatgtgggaggattaatagaggctgactgatttctttgtttttgaaaaactgagattgactaatttctatgctttggattgttaggacatgcttattagtcttttttttttttagaaaaaattgagccataccatcac

SEQ ID NO: 37467 - protein, 121 aa, Panicum virgatum
  misc_feature: Ceres CLONE 1990128
  misc_feature (9)..(120): Pfam Name: MAPEG Pfam Description: MAPEG family
  misc_feature: SWISSPROT Homolog: EC 2.5.1.18 Glutathione transferase
MAVSIELTKEYGYVVLVLVAYAFLNFWMSFQVGKARKKYKVFYPTMYAVESENKDAKLFNCVQRGHQNSLEMMPMFFVMLLLGGLQHPTIAAGLGAFYTVARFFYFKGYATGVPENRLKIG

SEQ ID NO: 37468 - DNA, 674 bp, Panicum virgatum
  misc_feature: Ceres CLONE 1990142
  misc_feature: Encodes the peptide sequence at SEQ ID NO. 37469
gtacccgctcacaaaaccctagcccaacaccgcagccccgcgcccggccgccgccgccgccgccggggacgatggcgaagcctcggcgcggccgctccgcctcgcgctcctcctcgggctcctcctcccgctccgtctcctccggctccgtctcgtcccgctcccggtcgcgctcccgctccttctcgtcgtcctcctcccagtcccggagccgctcccctcccccacctaaacgcagctcatcgggagcacggaaaggtcaatcaccttcatcacctcctaaaaaaggttcaccctcaaagaaagtccgttcaccatcaccaccgcctaaaacggcttcaccccctaggaaagcatctcctcctgctgagtctgctgttctctgcattgatcatctctcaaggaatgttaatgaggctcacttgaaagagatttttggaaactttggcgaagtggtgaatgtggagctatcaatggaccgattggtcgatcttcctcgtgggtatggatacgttgaattcaagaagagagctgatgctgagaaagctcttctttacatggatggtggtcaaattgatggaaatgttgttaagttgagattcactctgcaaccacgccaaagggctgcatcacctacgaagggtcctccccctccaaaaagagatgctcctcca

SEQ ID NO: 37469 - protein, 200 aa, Panicum virgatum
  misc_feature: Ceres CLONE 1990142
  misc_feature (104)..(175): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAKPRRGRSASRSSSGSSSRSVSSGSVSSRSRSRSRSFSSSSSQSRSRSPPPPKRSSSGARKGQSPSSPPKKGSPSKKVRSPSPPPKTASPPRKASPPAESAVLCIDHLSRNVNEAHLKEIFGNFGEVVNVELSMDRLVDLPRGYGYVEFKKRADAEKALLYMDGGQIDGNVVKLRFTLQPRQRAASPTKGPPPPKRDAP

SEQ ID NO: 37470 - DNA, 704 bp, Panicum virgatum
  misc_feature: Ceres CLONE 1990146
  misc_feature: Encodes the peptide sequence at SEQ ID NO. 37471
atcagctaggtttgtgtgtgtgctggctcgtgatttggaagaacacatcacacaccttgtcttactcaggtcaggtggctactagctagcgaggtatagtcatccgtcgatcgatgatggccggggcaccgccgatgcacatctgcatggactcggactggctcaagggcatcgtccccgaggagcccgggatggggtcgtcgtcgccgtcggcggagctgatcgcgtgcccgcggccggtgcacgccgcggcggcggaccggcgcctgcggccgcagcacgaccagccgctcaagtgcccgcggtgcgagtccacgcacaccaagttctgctactacaacaactacagcctctcgcagccgcgctacttctgcaagacgtgccgccgctactggaccaagggcggctcgctccgcaacgtccccgtcggcggcggctgccgcaagaacaagcgcgccagcgccaagaagcccgccgcgccgccgttgctgcaggcgcacgcgcggcaggtggtggcggagaccggcctccacctgtccttctccggcatgcagcagctgccgccgcctccgcccgccgcggcggacccgctgtgcagcctcggcctcctggattggaagtacgacccgatcctcgcaggatcgtccggcggcgcgctggatggcgccagctccgaggcgcacttcgcggggggccggcatgat

SEQ ID NO: 37471 - protein, 195 aa, Panicum virgatum
  misc_feature: Ceres CLONE 1990146
  misc_feature (54)..(116): Pfam Name: zf-Dof Pfam Description: Dof domain, zinc finger
MAGAPPMHICMDSDWLKGIVPEEPGMGSSSPSAELIACPRPVHAAAADRRLRPQHDQPLKCPRCESTHTKFCYYNNYSLSQPRYFCKTCRRYWTKGGSLRNVPVGGGCRKNKRASAKKPAAPPLLQAHARQVVAETGLHLSFSGMQQLPPPPPAAADPLCSLGLLDWKYDPILAGSSGGALDGASSEAHFAGGRH

SEQ ID NO: 37472 - DNA, 599 bp, Panicum virgatum
  misc_feature: Ceres CLONE 1990147
  misc_feature: Encodes the peptide sequence at SEQ ID NO. 37473
acgctgcacaccactccccaccccgagctgtccccccccccccaccccccccattccttccgcaccagctgctcgctcgctctagagttccctcgcggtccggtccagagagatcgagctcctgcagccatggcggctcccctgcttctcctgctgctactggccatgttcgcaggctcagatgcggcgttctgcgtgtgcaagccgggcacccccgacgcgatgctgcagaaggcgatcgactacgcctgcagcaagggcgccgactgcgcccagaccacgcagggcgggccgtgctacggcaacggcaacaaggtggccgtctgctcctacatctgcaacagctacttccagagcaggagctccatgggcgccacctgcgacttcggcggcgtcgccaccctcaccggcaccgaccccagcaccggcacctgcaagttcgcctccggccccagcagcgttggcaccggcggcggcggcatgggcaccggcggggcaggcgccggcaccggcaccggcggcggcatgggcgccggcgcgggcacaggaggagcaggcaccggcgctggcactggagcgggcactggtggcatgggcgc

SEQ ID NO: 37473 - protein, 156 aa, Panicum virgatum
  misc_feature: Ceres CLONE 1990147
  misc_feature (20)..(104): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
MAAPLLLLLLLAMFAGSDAAFCVCKPGTPDAMLQKAIDYACSKGADCAQTTQGGPCYGNGNKVAVCSYICNSYFQSRSSMGATCDFGGVATLTGTDPSTGTCKFASGPSSVGTGGGGMGTGGAGAGTGTGGGMGAGAGTGGAGTGAGTGAGTGGMG

SEQ ID NO: 37474 - DNA, 681 bp, Panicum virgatum
  misc_feature: Ceres CLONE 1990163
  misc_feature: Encodes the peptide sequence at SEQ ID NO. 37475
accaaaaccgagctcgcggtctttgtccccttcgcgtggggctagggtttcgtccgcttcgctcgcaggcaagatgccccgctacgatgaccggtacggtgggaacacaaggctgtacgtgggtcgtatctcctctcgcacaagggcagaggaccttgaagacattttcagcagatatgggaggttttgggggcttacccaacctcggtgtccatggtgggagggtgtccttggtggcattgctggctgttctcccaaagtttctagcaggctttgccgattcttttgaaaaaaaattcgtctgtcttaattgaaattcacagtcatcactcacgtttagttccttctgaccggtgattcatttatctacccacttcttgacggcattactgtttctggaaaccatttccgcagagtgcgttatgtggatatgaagcatgagttcgcatttgttgagtttagcgatgcccgggatgctgatgatgcaaggtacaaccttgacggtcgggatatcgatggaagccgcataattgttgagtttgctaaaggggttccgcgtggcccaggaggatcccgtgaatatatgggcagggaaccacctccaggttctggccgctgctttaactgtggtattgatgggcactgggctcgtgactgcaaagctggtgactggaaaaacag

SEQ ID NO: 37475 - protein, 83 aa, Panicum virgatum
  misc_feature: Ceres CLONE 1990163
  misc_feature (61)..(78): Pfam Name: zf-CCHC Pfam Description: Zinc knuckle
MKHEFAFVEFSDARDADDARYNLDGRDIDGSRIIVEFAKGVPRGPGGSREYMGREPPPGSGRCFNCGIDGHWARDCKAGDWKN

SEQ ID NO: 37476 - DNA, 771 bp, Panicum virgatum
  misc_feature: Ceres CLONE 1990173
  misc_feature: Encodes the peptide sequence at SEQ ID NO. 37477
aagcatgagctagcgacgcgcgaaaaagaagaagaaaaaaaacgttggactgctgcagccgcagccgccgcccgaggaagcataagcaaggacgagcggaggcaaggcaaaggcaaaggcagaaggagatggaagcgcgaggaggaaggggatcgtcgccggcgggaggggcagcgcggctgcgggtggctctggtgtgggtgctgctgctggcggcggcggcggagatcatcgtgcaggaggaggtcagcaaggcggtgtccgggaaccccggcgtcgccgccagcctcgtccgcctccacttccacgactgcttcgtcaggggctgcgacgcatccgttctgctggactcgacgccgggcaacacggcggagaaggacgcgcccccgaacacgagcctccgcggcttcgaggtcatcgacagcgccaagactcggctggagcaggcctgcttcggcgtcgtctcctgcgccgacgtgctcgccttcgccgccagggacgccctcgcgctggtcggaggcaacgcgtaccaggtgccctcggggcgacgggacggcaacgtctcggtggcgcaggagaccaacggcaacctgcctcccccgacggcgagcgtgagccagctgaaccagatcttcggcagcaaggggctgagccaggcggacatggtgaccctctccggcgcgcacaccatcgggagcgcgcactgcagctcggtcgacagccggctctactcgtacgggcccaacgccgcgggggcaagaccccagcatg

SEQ ID NO: 37477 - protein, 214 aa, Panicum virgatum
  misc_feature: Ceres CLONE 1990173
  misc_feature (36)..(210): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
MEARGGRGSSPAGGAARLRVALVWVLLLAAAAEIIVQEEVSKAVSGNPGVAASLVRLHFHDCFVRGCDASVLLDSTPGNTAEKDAPPNTSLRGFEVIDSAKTRLEQACFGVVSCADVLAFAARDALALVGGNAYQVPSGRRDGNVSVAQETNGNLPPPTASVSQLNQIFGSKGLSQADMVTLSGAHTIGSAHCSSVDSRLYSYGPNAAGARPQH

SEQ ID NO: 37478 - DNA, 398 bp, Panicum virgatum
  misc_feature: Ceres CLONE 1990176
  misc_feature: Encodes the peptide sequence at SEQ ID NO. 37479
aagcttgctgctaaatcctgccattagtggtaagcaactaaacaagtaagtagattaagcagcgtcgcggcctcgcgggtgagagaggagaggagggactgggatggaggcggggctggcggcggggtactggggcgtggttgggcggcggtgcggggcgtgcgggggctcgccggcggcggtgcactgccggacgtgccccggcggcgcgtacctgtgctcggcgtgcgacgcggggcccgcgccggcgggccacgagagggtctgggtctgcgaggtgtgagagcgcgcgccggccgcggtctcgtgccgggccgacgccgcggcgctctgccccgcgtgcgacgccgacgtccacgacgcctacccgcctggcgtgccgccgctagcacgtgccc

SEQ ID NO: 37479 - protein, 59 aa, Panicum virgatum
  misc_feature: Ceres CLONE 1990176
  misc_feature (12)..(56): Pfam Name: zf-B_box Pfam Description: B-box zinc finger
  misc_feature: Useful for making plants with altered lignin content
  misc_feature: Useful for making plants with modulated cold sensitivity
MEAGLAAGYWGVVGRRCGACGGSPAAVHCRTCPGGAYLCSACDAGPAPAGHERVWVCEV

SEQ ID NO: 37480 - DNA, 544 bp, Panicum virgatum
  misc_feature: Ceres CLONE 1990187
  misc_feature: Encodes the peptide sequence at SEQ ID NO. 37481
acactctcatttctctgtctctcatctctctaccttatcctttggagtgcggggcacgcgggccgccgcagcggggcgctgctgcgggccgcgccggccgcctctgcagggcgcgccggctgccgctgccgagcgctgctgcgggccccgctactgcggggcgctcgccgggggtccgggtccggccaagcaggcagcatggcggaggaggcactgatggacaagctgggcctccgccgcggccacgtcgccctccttctcgcgcccagctcgctccacttccccgtcgtctccctcggcatgctttccctcggcgccgtgctctccaccgccaacccgctcctcacgcccggcgagctcgccgaccaggcccgcgactcggagcctttcctcgcgctcacgaccgccgagctcgcccccaagctcggctccctgctgcccgcctcgcgggtcgtcctcgtcgaccagctcctcgccggcctcgacggccacgacgcgtgggcgggcacgtccagtaccggccgcgacgacccgacgcaggacg

SEQ ID NO: 37481 - protein, 115 aa, Panicum virgatum
  misc_feature: Ceres CLONE 1990187
  misc_feature: SWISSPROT Homolog: EC 6.2.1.12 4-coumarate--CoA ligase
  misc_feature: Useful for making plants with altered cell wall content and/or composition
MAEEALMDKLGLRRGHVALLLAPSSLHFPVVSLGMLSLGAVLSTANPLLTPGELADQARDSEPFLALTTAELAPKLGSLLPASRVVLVDQLLAGLDGHDAWAGTSSTGRDDPTQD

SEQ ID NO: 37482 - DNA, 580 bp, Panicum virgatum
  misc_feature: Ceres CLONE 1990201
  misc_feature: Encodes the peptide sequence at SEQ ID NO. 37483
attttttccggcctcctcttcctcgcgcggcgcctgcccccctgccggttcgaagcgtgcgaagagagcgaagaagcagcgcggagagatggcccgtaccaagcaaaccgctcgcaagtccacgggagggaaggctcccaggaagcagcttgcaactaaggctgcccgcaagtcagccccgaccactggaggagtgaagaagccccaccgctaccgccctgggactgttgccctccgtgagatccgcaagtaccagaagagcactgagctgttgatcaggaagctgcccttccagaggcttgttagggaaattgcacaggacttcaagactgatctgcgtttccagagccatgctgtgcttgccctccaggaggctgccgaggcgtaccttgttggtctgtttgaggacaccaacctgtgcgccatccatgctaagcgtgtgaccatcatgcccaaggacattcagctggccaggaggatccgtggcgagagggcttaatcatctcaatcatgacaatcaaagtcaagtgtcgaagtagtgggttaatgtggtgccctgttcaggacatctgagtagggc

SEQ ID NO: 37483 - protein, 136 aa, Panicum virgatum; identical to SEQ ID NO: 9871
  misc_feature: Ceres CLONE 1990201
  misc_feature (58)..(132): Pfam Name: Histone Pfam Description: Core histone H2A/H2B/H3/H4

SEQ ID NO: 37484 - DNA, 1136 bp, Panicum virgatum
  misc_feature: Ceres CLONE 1990202
  misc_feature: Encodes the peptide sequence at SEQ ID NO. 37485
gttttgggaaagtggggagagcgagcgagcaaggatctcagcagctcgcctcctccacaagggcagcagactggagagtgggtgagagccagccgagcagagctctagctagatccagcagctccctcgtccttggcttggccttgcttgctgcttcagccagtcactccgtttggtcaggtgactctcccctcctctcctcctctaccgccgagagagagagcaagggggagatccaatccaatccgatccagtccaaatggccgggcggcgcgcggaggaggagtacgactacctcttcaaggtggtgctcatcggggactccggcgtcggcaagtccaacctgctctcccgcttcacccgcaacgagttctgcctcgagtccaagtccaccatcggcgtcgagttcgcaacgcgaacgctccatgttgagggcaagatcatcaaggcacagatctgggacacggcaggccaagagcggtaccgggcgatcacgagtgcctactaccgtggagcccttggtgcggtcctcgtctatgatgtgagcaagcccaccaccttcgagaacatcagccggtggctcaaggagctgcgcgaccatgccgattccaacatcagaatcatgctcgtcggcaacaagactgacctcagacacctccgggctgtcaccagagagaatgcccagaactttgcagaggcagaaggcctgtcctacattgagacgtctgcgctggaggcgacaaatgttgaggaggcattccagctgatcctgggcgacatttatcgtgccatcagcaaaaaacccgtggcgtcggatgagtctggggccggggctgctggaggtgtcaaggaaggcaagacgatcaacgttgcagccggtgacagtgctgctgaaaagaagcaatgctgctcagcttagtacgggtgctgcgtcctgccgagatcttccagaggcgaatgtgttgtcgtgacggctgttttgagtccaaagtttgttgattcgttttgtcagatagtacctttgttggacctcaattctctaaagcaagcagttatatatgattatatcaaatcatcaagtcagttgttctcctatatgattgtatatcaaaccatccattcaattattttctatc

SEQ ID NO: 37485 - protein, 219 aa, Panicum virgatum
  misc_feature: Ceres CLONE 1990202
  misc_feature (15)..(176): Pfam Name: Ras Pfam Description: Ras family
  misc_feature (15)..(129): Pfam Name: Miro Pfam Description: Miro-like protein
  misc_feature: SWISSPROT Homolog: EC 2.7.11.1 Non-specific serine/threonine protein kinase
  misc_feature: Useful for making plants with altered lignin content
  misc_feature: Useful for making plants with altered alkaloid content
  misc_feature: Useful for making plants with altered terpenoid content
MAGRRAEEEYDYLFKVVLIGDSGVGKSNLLSRFTRNEFCLESKSTIGVEFATRTLHVEGKIIKAQIWDTAGQERYRAITSAYYRGALGAVLVYDVSKPTTFENISRWLKELRDHADSNIRIMLVGNKTDLRHLRAVTRENAQNFAEAEGLSYIETSALEATNVEEAFQLILGDIYRAISKKPVASDESGAGAAGGVKEGKTINVAAGDSAAEKKQCCSA

SEQ ID NO: 37486 - DNA, 676 bp, Panicum virgatum
  misc_feature: Ceres CLONE 1990206
  misc_feature: Encodes the peptide sequence at SEQ ID NO. 37487
accccacctctccccaagctcgctcacctcagctgctggcctcctcctctcccgtccctttccaccgatcgagcttcttctaactgctggtgcagatctgggttggccttcgtggacaggcggcggcgaaggagctatggagatggccggcgcggcggacagcccgggcctggcggcggcgcggccgagccggtacgagtcgcagaagcgccgggactggcagacgttcgggcagtacctgcgcaaccaccggccgccgctggagctggcccggtgcagcggcgcgcacgtgctcgagttcctccgctacctggaccagttcggcaagaccaaggttcacgcgccggggtgccccttcttcggccacccgtcgccgccggcgccgtgcccgtgcccgctcaagcaggcgtggggcagcctcgacgcgctcgtcggccgcctccgcgccgccttcgaggagcacggcggccgccccgaggccaaccccttcggggcgcgcgccgtccggctctacctccgcgaggtccgcgacacccaggccaaggcgcgcggcatcgcctacgagaagaaacgccgcaagcgccacccgccggcacacaggcaggccaagcagcagcaggacgccggccagcagcagcagcagcactaccacccccaccaccaccacaccaggcgt

SEQ ID NO: 37487 - protein, 179 aa, Panicum virgatum
  misc_feature: Ceres CLONE 1990206
  misc_feature: Useful for making plants with modulated low light sensitivity
  misc_feature: Useful for making plants with modulated flowering time
  misc_feature: Useful for making plants with modulated nitrogen use efficiency
  misc_feature: Useful for making plants with modulated biomass
  misc_feature: Useful for biocontainment applications
MEMAGAADSPGLAAARPSRYESQKRRDWQTFGQYLRNHRPPLELARCSGAHVLEFLRYLDQFGKTKVHAPGCPFFGHPSPPAPCPCPLKQAWGSLDALVGRLRAAFEEHGGRPEANPFGARAVRLYLREVRDTQAKARGIAYEKKRRKRHPPAHRQAKQQQDAGQQQQQHYHPHHHHTR

SEQ ID NO: 37488 - DNA, 653 bp, Panicum virgatum
  misc_feature: Ceres CLONE 1990214
  misc_feature: Encodes the peptide sequence at SEQ ID NO. 37489
aattaacaacaatcctcttcagtttggaagttacggaaagcctatttctccatctcatataaatactacaaccgcagcaacagctgcagcaagaattgaccctcagtcactagaacagcaaacaggagctcaacaaaatctggtggctttaccaactggtaataccgagaactggggagagtcagctatggctgatagtcccatgactgacacatcaacagatccagatactgatgagaggaatcagatgtttgaacaaggactggttgctggccccacagcttctgattctagtgacaaatcgagggataaactagatcagaagacacttcgtcgtcttgcccaaaatcgtgaagctgccaggaaaagccgtttaagaaagaaggcgtacatccaaaaccttgagagtagcagactgaaacttactcagttagagcaagagcttcagcgggctcgccaacagggtatatttatttcgacatcagtagatcaacctcaatcagcaaacgcaaatggtaatgctacactcacatgactctttctagaagttctaggttaatgtacaggtactgtgtactttccataatgagacttgacttctgtgcctgtttcttgggtgctccttataatttatgagttacttgtaaaataag

SEQ ID NO: 37489 - protein, 177 aa, Panicum virgatum
  misc_feature: Ceres CLONE 1990214
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
INNNPLQFGSYGKPISPSHINTTTAATAAARIDPQSLEQQTGAQQNLVALPTGNTENWGESAMADSPMTDTSTDPDTDERNQMFEQGLVAGPTASDSSDKSRDKLDQKTLRRLAQNREAARKSRLRKKAYIQNLESSRLKLTQLEQELQRARQQGIFISTSVDQPQSANANGNATLT

SEQ ID NO: 37490 - DNA, 705 bp, Panicum virgatum
  misc_feature: Ceres CLONE 1990219
  misc_feature: Encodes the peptide sequence at SEQ ID NO. 37491
atttgcaaggcaaacgaaaccacattcagcctgccacggtggcgggagtggaagcgatcgaaggcaacaagccgcagtggttaggatacagctcatggggcgtgtcggtagtgccgcgctgtcgctgctcgccctcgccgtcgtgtcgccatggcaggccgtggcggcggcggcgggcaacgggacggcggtcggcggcgggagcccgcgggtgccggccctcctggtgttcggcgactccatcgtcgacacgggcaacaacaacgccgtcctcacgctcaccaggtccgacttccgcccgtacggcaaggacctcaacggcggcgtccccaccggccgcttctccaacggccggatccccaccgacttgctagcgtcccgtctcgggctcaaggacctggttccggcgtacctcggcgctgacctcagcgacgacgacctcctcaccggcgacagcttcgcttcagcgggcaccggctacgaccctctcacctccactctagtggccgtcctgccgatgcaggaggagctcaacatgtttgccgagtacaaggagaagctggcagggattgtcggagaagaggccgccgcgggcatcgtttccaagagcctgttcttggtctgcgccggcacagacgacatcgccaacaactactacctcgccccggtcaggcctctgcaatacgacatctcggcgtacgtcaa

SEQ ID NO: 37491 - protein, 203 aa, Panicum virgatum
  misc_feature: Ceres CLONE 1990219
  misc_feature: SWISSPROT Homolog: EC 3.2.1.51 Alpha-L-fucosidase
MGRVGSAALSLLALAVVSPWQAVAAAAGNGTAVGGGSPRVPALLVFGDSIVDTGNNNAVLTLTRSDFRPYGKDLNGGVPTGRFSNGRIPTDLLASRLGLKDLVPAYLGADLSDDDLLTGDSFASAGTGYDPLTSTLVAVLPMQEELNMFAEYKEKLAGIVGEEAAAGIVSKSLFLVCAGTDDIANNYYLAPVRPLQYDISAYV

SEQ ID NO: 37492 - DNA, 1282 bp, Panicum virgatum
  misc_feature: Ceres CLONE 1990221
  misc_feature: Encodes the peptide sequence at SEQ ID NO. 37493
ctcgctctcactctctctcaggtccccctctctctcggccgccttctttccaagcggcgacgacaggggagtggcgccgccgcccatctgtcctacactgggtccacccctgcctcctcgtcctcgtccctctactggaaggggatggagtcgagtggggatccacatccacctatactggctggagcccagaatgcgtgggatatgctctctgatgagcagtcacagaaacacatcactactggttctggtgacctcaacaacatacttggtggtgggattcactgcaaagaagtcactgagataggtggtgtcccaggggttggtaaaactcaactggggattcaactagcaatcaatgtccaaatcccagtggaatatggtggccttggtgggaaagcagtttatatcgacacggagggcagtttcatggttgaacgtgtctatcaaattgctcaagggtgtatcagcgacatactggagcactttccgcacagccatgagaagtcttcttctggccaaaaacaactgcagcctgagcatttccttgcagacatctattacttccgaatatgcagctatacggaacagattgctgctataaactacctggaaaaattcctcggggagcataaagatgtgcgtatagttattattgatagtgtcactttccactttcgacaagattttgatgatctggctctacggaccagagtgctcagtggattgtcattgaagttaatgaagattgcaaagacatacaacttggcggttgtcttgttgaaccaagtcactactaaatttacagaaggatcatttcaattgactcttgctctaggtgacagctggtcccactcgtgcacaaatcgactgattctgtactggaatgggaatgatcggtatgcatacctggacaaatctccttcacttccagttgcttcagctccatatgcagtgacaggcaagggggtgagggatgctgcgagttcaaatcacaagagagtccgagtaacgtagcgaacttggtgccaactcctgtacctccagttctctactatgcacttgctgctaaattaactgcgttccttcaccgtgggtcttttggacaaattaggtgattggtgggtattggtagagaatctcctaccattttgaaagtctcgattgctttttgatgtaaaccagaaattgtagggaagtagatgccgcaaaagagggtttagttgacccatcgtcaactctcgtgtgtctgaaacgcgactaccagctctttcaggtggcc

SEQ ID NO: 37493 - protein, 290 aa, Panicum virgatum
  misc_feature: Ceres CLONE 1990221
  misc_feature (11)..(280): Pfam Name: Rad51 Pfam Description: Rad51
MESSGDPHPPILAGAQNAWDMLSDEQSQKHITTGSGDLNNILGGGIHCKEVTEIGGVPGVGKTQLGIQLAINVQIPVEYGGLGGKAVYIDTEGSFMVERVYQIAQGCISDILEHFPHSHEKSSSGQKQLQPEHFLADIYYFRICSYTEQIAAINYLEKFLGEHKDVRIVIIDSVTFHFRQDFDDLALRTRVLSGLSLKLMKIAKTYNLAVVLLNQVTTKFTEGSFQLTLALGDSWSHSCTNRLILYWNGNDRYAYLDKSPSLPVASAPYAVTGKGVRDAASSNHKRVRVT

SEQ ID NO: 37494 - DNA, 716 bp, Panicum virgatum
  misc_feature: Ceres CLONE 1990240
  misc_feature: Encodes the peptide sequence at SEQ ID NO. 37495
agcgcgccatcgtcgtcaacctcgagcagatccggtgcgtcatcaccgccgacgaggtgctcctgctcaactccctcgacagctacgtcctccagtacgccgccgagctccagcgacgcctgctccagcgcgccgagggcgacgagctgcccttcgaattccgcgcgctcgagctcgccctcgaggccgcttgttccttcctcgatgcacaggcggcagaattggaaattgaagcatatccactattagatgagctgacatctaaaatcagtactttaaatttggaacgtgtccggcgactcaaaagtaggttagttgctttgaccagaagagttcagaaggttagagatgaaatagaacagctaatggatgatgatggtgatatggctgaaatgtatctcaccgagaaaaagttgaggatggaatcatctgtgtttggtgatcagtctttgttgggttacaattcagcaggcgctgctgggacgtcagcttcagctcctgtatctccagtctcatcacccacagaatcacgaaagctggagaaagctttcagcttgtgtagaagtaggcatgatagtgtgaagagctcagataacacaacaacagaacacattcaggagttggagatgttactggaagcttatttcgttgtcatcgacagtactctcaacaagctgacatcgcttaaagagtacatcgatgacacggaagacttt

SEQ ID NO: 37495 - protein, 237 aa, Panicum virgatum
  misc_feature: Ceres CLONE 1990240
  misc_feature (1)..(237): Pfam Name: CorA Pfam Description: CorA-like Mg2+ transporter protein
RAIVVNLEQIRCVITADEVLLLNSLDSYVLQYAAELQRRLLQRAEGDELPFEFRALELALEAACSFLDAQAAELEIEAYPLLDELTSKISTLNLERVRRLKSRLVALTRRVQKVRDEIEQLMDDDGDMAEMYLTEKKLRMESSVFGDQSLLGYNSAGAAGTSASAPVSPVSSPTESRKLEKAFSLCRSRHDSVKSSDNTTTEHIQELEMLLEAYFVVIDSTLNKLTSLKEYIDDTED

SEQ ID NO: 37496 - DNA, 1513 bp, Panicum virgatum
  misc_feature: Ceres CLONE 1990242
  misc_feature: Encodes the peptide sequence at SEQ ID NO. 37497
acacactccacaccaccgcagcccactgccagctcctcagctcgcaaccgtagagggggaaccggccggccggcgttcgtgcacgcgtcgagagcaagagcgagagcgaggacgatgaagttgagctccgccgtgcccgcggcgtcggcggcggcggtgatgctgatgctgctgctgctctcggcggcggcgaccgcaaggggccaggcgctggtgcccggcgtgatgatcttcggcgactcggtggtggacgccggcaacaacaaccggctggccacgctggtgcgcgccgacttcccgccctacggccgcgacttcccggcgacgcacgcgcccacggggcggttctgcaacggcaagctcgccacggactacaccgtggagaacctggggctgaggtcgtacccgccggcgtacctgagcgaggaggcgcagagcaacaagagcctcctccacggcgccaacttcgcctccggcgccgccggctacctcgacgccaccgccgcgctctacggcgcgatctcgctgagccggcaggcggagtacttccgggagtaccagtcgcgggtggcggcgtcggccggcgagcagcgcgccaaggcgctgacgtcggggtccatctacgtggtgagcgccggcaccagcgactacgtgcagaactactacgtgaacccggtgctgggcgccgcctacacgcccgaccagttcgccgacgcgctcatgcagcccttcacctccttcgtcgagcgcctgtacagcctgggcgcccgccggatcggcgtgacgtcgctgccgccgatggggtgcctcccggcgtccgtcaccctgttcggcggcggcaacccgggctgcgtggagcgcctcaacaacgactccctcaccttcaaccgcaagctcggcgccgccgcggacgccgtcaaacgccgccgcccggacctcaagctcgtcgtcttcgacatctaccagccgctgctcgacctcgtcaacaaccccaccagcgccgggttcttcgagtcgcggcgggcgtgctgcgggacgggcacgatcgagacgtcggtgctgtgccatcagggtgccccggggacgtgctccaacgccacgggctacgtcttctgggacggcttccaccccacggacgcagccaaccgggtgctcgccgacgcgctgctgttccagggcctgcagctcatagcctgatcgagatgcgcggcagcctccggggagaaaatacacgccaattcccgctgcccttccatcatcctacctaccagcaaatgtaccttgctttagtttttctgttgttctgtgctgcttgcttgctgtttgtttgtttgctgtctgtcttatctgtccatccatgatctctcgtagtcgttttgtgctacttagaaacagttggacttgtgtaagagtgtcgctctgtataatttttgtgttctttcgcagtcttcccaatctgttcgacgaacttggactttggagtgatcgacgttacagtgactagcatattccg

SEQ ID NO: 37497 - protein, 360 aa, Panicum virgatum
  misc_feature: Ceres CLONE 1990242
  misc_feature (37)..(351): Pfam Name: Lipase_GDSL Pfam Description: GDSL-like Lipase/Acylhydrolase
  misc_feature: SWISSPROT Homolog: EC 3.2.1.51 Alpha-L-fucosidase
MKLSSAVPAASAAAVMLMLLLLSAAATARGQALVPGVMIFGDSVVDAGNNNRLATLVRADFPPYGRDFPATHAPTGRFCNGKLATDYTVENLGLRSYPPAYLSEEAQSNKSLLHGANFASGAAGYLDATAALYGAISLSRQAEYFREYQSRVAASAGEQRAKALTSGSIYVVSAGTSDYVQNYYVNPVLGAAYTPDQFADALMQPFTSFVERLYSLGARRIGVTSLPPMGCLPASVTLFGGGNPGCVERLNNDSLTFNRKLGAAADAVKRRRPDLKLVVFDIYQPLLDLVNNPTSAGFFESRRACCGTGTIETSVLCHQGAPGTCSNATGYVFWDGFHPTDAANRVLADALLFQGLQLIA

SEQ ID NO: 37498 - DNA, 382 bp, Panicum virgatum
  misc_feature: Ceres CLONE 1990251
  misc_feature: Encodes the peptide sequence at SEQ ID NO. 37499
aagcccaccactcccccctcgtcagccgccgccgccgcctccaccacaacccagagctgcagccccccctcagctccccccacccccgcatggccaccgacgccgttgcggcggcgatggctgcgtcctccctctgcgacaacctggagcccgccaccgtccgcaccggcatccgcgacgtcctggccgcgggcgccgcgcgggccggggagcgcgtcgtggtcgggggctgggtccggactggcagggagcagggtaagggcaccttcgcctttctcgagctcagtgacggctcctgtgcttccacgctccaggtgattgtcgacgccgccgtgcacccgctcgcgcgcctcaccgccacgggcacctccgtgctcgtcga

SEQ ID NO: 37499 - protein, 97 aa, Panicum virgatum
  misc_feature: Ceres CLONE 1990251
  misc_feature: SWISSPROT Homolog: EC 6.1.1.22 Asparagine--tRNA ligase
  misc_feature: Useful for making plants with modulated biomass
MATDAVAAAMAASSLCDNLEPATVRTGIRDVLAAGAARAGERVVVGGWVRTGREQGKGTFAFLELSDGSCASTLQVIVDAAVHPLARLTATGTSVLV

SEQ ID NO: 37500 - DNA, 666 bp, Panicum virgatum
  misc_feature: Ceres CLONE 1990253
  misc_feature: Encodes the peptide sequence at SEQ ID NO. 37501
tgagagttagggaatggttctcgtggcacttccctgagcttgtcaagattgtcaatgacaactacctttatgccaagcttgctaagtttatcgtgaacaaatctgatttggcggaaaaagatattcctgctttggcggatatagttggtgatgaggacaaggctaaagaaattgttgaagcagcaaaggcctcaatgggccaagatctctcaccagttgatttgattaatgtccagcaatttgcccaaagggttatgaatctgtctgaataccgtaaaaacctttatgaatatcttgttactaagatgaatgatattgcaccaaatctgacgtcattgattggtgaagttgttggagctcgtctaatctctcatgctggcagtctttcaaatcttgccaagtgtcctgcctccactctccaaattcttggtgctgagaaggcactcttcagagcactgaaaactcgagggaacacacctaagtatggccttatattccactcctccttcattggtcgtgcttcaaccaagaacaagggcagaatggctcgttaccttgcaaacaaatgctcgattgcgtcacgcattgattgttactcagaggcaagtacatctgtcttttgccaaaaattgcgtgagcaagttgaggagagactggacttctatg

SEQ ID NO: 37501 - protein, 221 aa, Panicum virgatum
  misc_feature: Ceres CLONE 1990253
  misc_feature (76)..(221): Pfam Name: Nop Pfam Description: Putative snoRNA binding domain
  misc_feature (1)..(32): Pfam Name: NOSIC Pfam Description: NOSIC (NUC001) domain
RVREWFSWHFPELVKIVNDNYLYAKLAKFIVNKSDLAEKDIPALADIVGDEDKAKEIVEAAKASMGQDLSPVDLINVQQFAQRVMNLSEYRKNLYEYLVTKMNDIAPNLTSLIGEVVGARLISHAGSLSNLAKCPASTLQILGAEKALFRALKTRGNTPKYGLIFHSSFIGRASTKNKGRMARYLANKCSIASRIDCYSEASTSVFCQKLREQVEERLDFY

SEQ ID NO: 37502 - DNA, 1462 bp, Panicum virgatum
  misc_feature: Ceres CLONE 1990269
  misc_feature: Encodes the peptide sequence at SEQ ID NO. 37503
aagagagaggagagctaccaaccccccagaagagttcctccgtctctactaacagagcgagcagcaggactggatggtggtatccacggcgtcctcgcctccgatccctacgggaggaggaggccgccgccagcctcctcacgccctctccatacccgtgcgctccagccgccgccgctccctctccgcctccgcctcccgcgaccccgatcgttccggcgtgcccgtgccatcctcccgcggccccatctcgctgcctcaaccaacgaattcctggaatggattcagggcctctgacgagcgcggatctgatggagcctagtggggacggattgaaggtcgcctaccagggttaccccggagcctacagcgagtcggccgccaagaaggcctacccgagctgtcacaccgtgccctgtgaatacttcgagaccgccttccaggccgtcgaaggatgccttgctgatcgggcagtattacctcttgagaactccttaggtggtagcatacatcgcaactatgaccttttacttcgtcataggttgcacatcgttggtgaggtacggcttgcggttcggcattgcttgctggcaaatcaaggtgtcaagattgaaaacttgcagagcgctatgagccatccccaagcacttgcacaatgcgaacaaacactgaccaagttaggaatcgagcataaggaagctgttgatgatacagcaggtgctgcaaagcttattgcggaagaaaagctccaagacactgctgcggttgctagttcattagctgctgaactttatggactggatattcttgcagaaaacatacaggatgacacagacaacgttacccgttttatgatgctggctcgagaacccattattcctcgcacggacaagccattcaagactagcatagtcttctgtctggaagaaggacctgggcaactcttcaaagcacttgcggtgtttgctttgcggaaaatcaatctcacaaagatggaaagccgcccacacaagaaaaggcctctacgcgtagctgatgacaattgctctgcaccgctgaagcactttgactacctcttctatgtcgatcttgaggcatcaatggctgatccaaatgctcaaaatgctcttggaaacttgaaggaatttgccactttcctaagagttcttgggagctatcctacagatgtgagtgaagcttgaaccatcgagtgtgtgcttgaattgaactacaagcttgtcccttcgatggtttcctcatagttgagaaagatatcattttttaggcaggacaaaacgacacccttggggacaggacaaaacgaaggatgtcattggttcatttgtagtttaagtattctgttcatgtcttatattcatgtcttgagtttcatagcaagaaccaagtgtcttgatctatgaaaagatataataatgtctttttcatgtatgaaacctagcag

SEQ ID NO: 37503 - protein, 307 aa, Panicum virgatum
  misc_feature: Ceres CLONE 1990269
  misc_feature (21)..(199): Pfam Name: PDT Pfam Description: Prephenate dehydratase
  misc_feature (209)..(289): Pfam Name: ACT Pfam Description: ACT domain
  misc_feature: SWISSPROT Homolog: EC 4.2.1.51 Prephenate dehydratase
  misc_feature: Useful for making plants with altered lignin content
MDSGPLTSADLMEPSGDGLKVAYQGYPGAYSESAAKKAYPSCHTVPCEYFETAFQAVEGCLADRAVLPLENSLGGSIHRNYDLLLRHRLHIVGEVRLAVRHCLLANQGVKIENLQSAMSHPQALAQCEQTLTKLGIEHKEAVDDTAGAAKLIAEEKLQDTAAVASSLAAELYGLDILAENIQDDTDNVTRFMMLAREPIIPRTDKPFKTSIVFCLEEGPGQLFKALAVFALRKINLTKMESRPHKKRPLRVADDNCSAPLKHFDYLFYVDLEASMADPNAQNALGNLKEFATFLRVLGSYPTDVSEA

SEQ ID NO: 37504 - DNA, 649 bp, Panicum virgatum
  misc_feature: Ceres CLONE 1990273
  misc_feature: Encodes the peptide sequence at SEQ ID NO. 37505
ccctccttccttcccttctcccctcatccccatccccgaccccacccaaccctcgcgccgcggcctccgatcccatcccaattcccatttccaacccgccgtcccgtcgccgcaggccgcattccatcgcgccgcgcggtgccgctccgcccgcccatgtgaccgcgcgagccgcgcgctcttcgtcgtcgccagggcggacctcaccggcgacgacatctttgaggacttcgagccgtcgccagagatccggagagcttttgtgccgtcaccgcggcctggcgacgcgtcctgccccttggccgtgttccagttgactttcctcaagtgtggcggcgtggtgctgggcaccggcatccaccacgcggtgctggacggcgtgggcgcgttccagttcatccagacgtgggcggggctcgcccgcggcctcgacgccgccgaggcgtgcgggccggtgccgttccacgaccggaccctcctccgcgcgcggtgcccgccgtgcccaaccttcgaccacttcgtctactccccggccttcctcagcggccgcccgcgccccttcgtcacccggttctacgccgtctcccccaagctcctcgccgacctcaagtcccggtgcggcgccggcgtgtccacgtactgcgccgtc

SEQ ID NO: 37505 - protein, 215 aa, Panicum virgatum
  misc_feature: Ceres CLONE 1990273
  misc_feature: SWISSPROT Homolog: EC 2.3.1.144 Anthranilate N-benzoyltransferase
  misc_feature: Useful for making plants with altered carbohydrate content
PPSFPSPLIPIPDPTQPSRRGLRSHPNSHFQPAVPSPQAAFHRAARCRSARPCDRASRALFVVARADLTGDDIFEDFEPSPEIRRAFVPSPRPGDASCPLAVFQLTFLKCGGVVLGTGIHHAVLDGVGAFQFIQTWAGLARGLDAAEACGPVPFHDRTLLRARCPPCPTFDHFVYSPAFLSGRPRPFVTRFYAVSPKLLADLKSRCGAGVSTYCA

SEQ ID NO: 37506 - DNA, 1265 bp, Panicum virgatum
  misc_feature: Ceres CLONE 1990274
  misc_feature: Encodes the peptide sequence at SEQ ID NO. 37507
accagtcgtcacacacgctcgatcaaacgcaaacccccatacaagaatgatatgccactcatgacctaatcactcaattccactacctctctctctcagctcctttaattttcttcctccttagcttgcaacacccaagaacttcggctcgagctcatcgttggctcgttgcaacaagattgcagtttccccagcatcaggaggactcgcagggcgacgacgatggcaactcctgatctctccctccacatcagccctccgtcgtcagcagaagccggcggcgagatgcaggccgtggagccgaggctgctgctgctggggctagagctcgacatggctgcagcgcctccgccggcggtgatgaagacgggcgacgcggctgcgcagcggcacggcggcctccagcaggtgcagcagcagcagcgccggctgcaccagccgagccagacggcccacgggttcaagaagagctcgggcggcgccggcggagggaggaggagcgccagggctccgcggatgcggtggaccaccgcgctgcacgcgcacttcgtgcacgccgtcgagctccttggcggccatgagagagcaacaccaaagtcagtattggaactgatgaacgtgaaggatcttacactagcacatgtcaagagccacctccagatgtacagggcagtgaagggcacagacagatcatgctttgcaggccatgggcaggccagagacatggcctttctgagaagaggtgctgctggcgaagtggatggctttgatgttttcaacagcaacagctcggtcaacaccgccactaccttcaacaacgatactgctaggaggtcacggtctccatcaggagagcagcagcagcggcggcggctggatcatcaagaagcagcagtggccgcttgcgcttggatccgcgcccaccagcggctccagagctgcggcagcgatgaactgacgctgcagccaccgccatgccgcctgcggcctgcagctgatcgcctcttgacgacgacggaggagcaatgccagcagcagcagggatcaaagggaggagaacaagatcatctcggagaaggaggtgccgttgctgttcatcatctcgcggacgagcaggctcgggagaaattaccatcatccccgccaccaccccatgatcatcaccacgccggaagcggcctcttccgatggccgtcgccggcgaacaacacgagcagcagcggcgacgacacggtctcgagctcggagcggctccagcagcggca

SEQ ID NO: 37507 - protein, 347 aa, Panicum virgatum
  misc_feature: Ceres CLONE 1990274
  misc_feature (98)..(149): Pfam Name: Myb_DNA-binding Pfam Description: Myb-like DNA-binding domain
  misc_feature: The sequence is a functional homolog of SEQ ID NO 1338 in the 10/374,780 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MATPDLSLHISPPSSAEAGGEMQAVEPRLLLLGLELDMAAAPPPAVMKTGDAAAQRHGGLQQVQQQQRRLHQPSQTAHGFKKSSGGAGGGRRSARAPRMRWTTALHAHFVHAVELLGGHERATPKSVLELMNVKDLTLAHVKSHLQMYRAVKGTDRSCFAGHGQARDMAFLRRGAAGEVDGFDVFNSNSSVNTATTFNNDTARRSRSPSGEQQQRRRLDHQEAAVAACAWIRAHQRLQSCGSDELTLQPPPCRLRPAADRLLTTTEEQCQQQQGSKGGEQDHLGEGGAVAVHHLADEQAREKLPSSPPPPHDHHHAGSGLFRWPSPANNTSSSGDDTVSSSERLQQR

SEQ ID NO: 37508 - DNA, 321 bp, Panicum virgatum
  misc_feature: Ceres CLONE 1990274-R
cccccgcctctcctgcctccgccccggcggcggcgccgccggcgtccgcctcgcggccgcccgcccccccgccccgccgccgccgacgcctggagatgagcctggggaggcaggggtggcagatggagcagcgcgtcggcgacgagttcgagttcgagttcgagtcgtcgtcgccgccggcggcgcccaacgagctaaccatgctcaagtgcttgtgaaattgtttaattatttgttgttaattattaactgcttaaagcctaatttgcagtcaagactgttagccatgccgatgaaatccatgtccgacgagctaacctt

SEQ ID NO: 37509 - DNA, 641 bp, Panicum virgatum
  misc_feature: Ceres CLONE 1990309
  misc_feature: Encodes the peptide sequence at SEQ ID NO. 37510
aggcgactcgacgaccgcggcgccttcctcagctacgtcgacgaagccgttcggttggccagtggcttcagtcttcatggatcgctcgagctctgaactggagggaggcgcgtaaggcggaggtgtaccgagagggattgttcaagtttcttgatgctgtgataaccgagcatatggagagaaagtcgcaagacagcaactcgcaggaagatttgatagatgtcctcctgaggattcgaagccaaggctcatctcagttccttactatgagcataataaaaggtgttgtttttgatcttttctcagctgggactgaaactgctgcaacaacgttgcaatgggccatggcggagttgatgaggaaccctgacatgatgtccagggcgcaagctgaggtaaggggagccttcatgagctgcggaaaggttgtagaggagggattgagagaattgaagtacctgcattggatcatcaaagagaccctgcgcctgcgcattcccggcccgctgctgatcccaagagagtgccgagaaacttgcaaggtcctgggctacgatgtgcccaagggtgctatggtgctcgtgaatgcatgggcaatctcgacggatccacagtgctgggaggaaccagaaaggttcaag

SEQ ID NO: 37510 - protein, 212 aa, Panicum virgatum
  misc_feature: Ceres CLONE 1990309
  misc_feature: SWISSPROT Homolog: EC 1.14.13.21 Flavonoid 3'-monooxygenase
ATRRPRRLPQLRRRSRSVGQWLQSSWIARALNWREARKAEVYREGLFKFLDAVITEHMERKSQDSNSQEDLIDVLLRIRSQGSSQFLTMSIIKGVVFDLFSAGTETAATTLQWAMAELMRNPDMMSRAQAEVRGAFMSCGKVVEEGLRELKYLHWIIKETLRLRIPGPLLIPRECRETCKVLGYDVPKGAMVLVNAWAISTDPQCWEEPERF

SEQ ID NO: 37511 - DNA, 1744 bp, Panicum virgatum
  misc_feature: Ceres CLONE 1990311
  misc_feature: Encodes the peptide sequence at SEQ ID NO. 37512
aaaccaaacagccaaccagtcaacccgtcgcccagcacatccctcctccgcgccgcacgcaaacgcaaccaccggccaccgtcgcgtcggcagcagcttcctcctcccgcttcctttccctttcgtcgtggctccccacacccggccctccactccaccaccggatgtctccgccccccagccgaatccaccacacccgcgcatcggcagcggtagctagtggcggcggcggttggtagcccggtcgagacggcagcaggtagccaaccccggcgccgcgggacggtatatataccgccaacaaaattccaggtgccagttcttgatttgacccgagtgtaggactggctgtagatcggagttggcacacttttcctcctttcttccaccttctttattctttttttttcgtttatgtccctctcttccccgctctgagctgctgtgagcgcattctggtaggacgccaggaggcgccgatctgcggcgacatcggcgagccgctggtctcccgccgcaccgacacaatggcagaccagttagggtgcactatgagatcccatggaatggtactggcaagattacacatgtatgactggataatacttctcctccttgctgtcatagacggactgctgaatttaattgaaccttttcaccgttttgttgggaaagacatgatgactgacctgagatatccattgaaaggcaatacagtgcccttttgggctgttccaatatttggaattatactaccttgggccatcttttttggaatttacttcaaaaagaagaatttttatgatttgcaccatggcatactggggattctatactcagtacttataactgcagtgattactgatgcaattaaggatggtgttggccgcccacgtccagattttttctggcgctgttttcctgatggaaaagatgtttacgataacatcactactggtgttatatgccatggagagaagagtgtaatcaaggaaggtcacaaaagcttcccaagtggacacacttcatggtcttttgctggcctaggcttccttgcctggtacttagctgggaaaatcacggcttttgatcgcagaggacatattgcaaagctatgcatagtgtttctgcctcttcttattgctgctcttgtggctgtttctcgagtagatgattactggcatcactggcaagatgtatttgctggcgctcttataggtcttacagttgcttcgttttgctatctgcaatttttcccatatccttttgatgccgatgctttctggcctcatgcatacacggtccagctagctgaagaacgcaacagcagaaatgcaaactcctacagtgtgcgaccaaccgagatcgaaacagtcattattcccggccatggtggaatcaccctaagagacactctcaacgatgtggagtctggaagcagatcgtgacatccaagtctggagtggagatgtcttgaataccctgacttccgactcttgagatttgtctgcattagaagctgtgtgggagctgcttacatgtacacaggtagatctattttagagctgtgctctttatcaatcttctaggtctgcgtttttttttgtttatttactggatagctggtttcttaaggcttcggtgtaaaaattacctggtaagggtgttcttactttctgacaagctttcgctcttcttcatactatggtgtgaggctcgtgttgtggttaaagttcgttggtgt

SEQ ID NO: 37512 - protein, 306 aa, Panicum virgatum
  misc_feature: Ceres CLONE 1990311
  misc_feature (97)..(247): Pfam Name: PAP2 Pfam Description: PAP2 superfamily
  misc_feature: SWISSPROT Homolog: EC 3.1.3.4 Phosphatidate phosphatase
MADQLGCTMRSHGMVLARLHMYDWIILLLLAVIDGLLNLIEPFHRFVGKDMMTDLRYPLKGNTVPFWAVPIFGIILPWAIFFGIYFKKKNFYDLHHGILGILYSVLITAVITDAIKDGVGRPRPDFFWRCFPDGKDVYDNITTGVICHGEKSVIKEGHKSFPSGHTSWSFAGLGFLAWYLAGKITAFDRRGHIAKLCIVFLPLLIAALVAVSRVDDYWHHWQDVFAGALIGLTVASFCYLQFFPYPFDADAFWPHAYTVQLAEERNSRNANSYSVRPTEIETVIIPGHGGITLRDTLNDVESGSRS

SEQ ID NO: 37513 - DNA, 680 bp, Panicum virgatum
  misc_feature: Ceres CLONE 1990322
  misc_feature: Encodes the peptide sequence at SEQ ID NO. 37514
aacaatggtccctactcactatcggtgtcctcacctcttcatcctcccaaatttaggtcattggagatcacttcaaatttcagctcggtagccaagcagtacttctcagattgccattcactgaatctcttgttcagtgattcttccacaggtgctactagtgtaataactactctggaccaaccttattctaagaaacatgttgctggggatgagaccatgaacaactggatgccaggaaaagggcaagcagcaatgaagccggacatcgttgtgcccgaagctcctcgtgaggttttgccactaatttcctccaatatgaaacttgataggaagaaagaattgaagttaattgaggagactcagcagttaagacatacagtcagtgatttgtcacttgctgcgaatgatctgatcattccatggaacgagctggtgttaaaagagaagattggagcagggtcttttggaacagtccatcgtgctgattggcatggatcggatgttgcagtcaaaatacttatggagcaggattttcatccagagcacttcagggaatttatgaaggaggttgcaattatgaaaagtctgaggcatccaaatattgttctattcatgggtgctgtcactgaaccaccgaacctgtcgatagttacagaatacttgtctaggtttgaaag

SEQ ID NO: 37514 - protein, 226 aa, Panicum virgatum
  misc_feature: Ceres CLONE 1990322
  misc_feature: SWISSPROT Homolog: EC 2.7.11.1 Non-specific serine/threonine protein kinase
  misc_feature: The sequence is a functional homolog of SEQ ID NO 48 in US patent 7317140
NNGPYSLSVSSPLHPPKFRSLEITSNFSSVAKQYFSDCHSLNLLFSDSSTGATSVITTLDQPYSKKHVAGDETMNNWMPGKGQAAMKPDIVVPEAPREVLPLISSNMKLDRKKELKLIEETQQLRHTVSDLSLAANDLIIPWNELVLKEKIGAGSFGTVHRADWHGSDVAVKILMEQDFHPEHFREFMKEVAIMKSLRHPNIVLFMGAVTEPPNLSIVTEYLSRFE

SEQ ID NO: 37515 - DNA, 753 bp, Panicum virgatum
  misc_feature: Ceres CLONE 1990344
  misc_feature: Encodes the peptide sequence at SEQ ID NO. 37516
acagagcaccagaccatctcagctttgcttctcagctagctatctttaggctccggttgctgcgagaagcaaggcaggcatggaggggaaggaggaggacgtccgcctgggcgccaacaagttctccgagcgccagcccatcggcacggcggcgcaaggcaccgatgacaaggactacaaggagcccccgccggcgccgctcttcgagcccggggagctcaagtcctggtccttcctctacatcagcatcctcaccgtcatgggcgtcagcaagtcccaatccaagtgcgccaccgtcggcatccagggcatcgcctggtccttcggcggcatgatcttcgccctcgtctactgcaccgccggcatctccggcggccacatcaacccggcggtgaccttcggcctgttcctggcgaggaagctgtcgctcaccagggccatcttctacatggtcatgcagtgcctgggcgccatctgcggcgccggcgtcgtcaagggcttccagcaggggctgtacatgggcaacggcggcggcgccaacgtcgtcgcgcccggctacaccaagggcgacggcctcggcgctgagatcgtcggcaccttcatcctcgtctacaccgtcttctccgccaccgacgccaagaggaacgccagggactccccacgtccgatccttgctcccctccccattgggttcgccgtgttcctgggtcacctggccaccatcccccatcaccgcaccggcatccacccggc

SEQ ID NO: 37516 - protein, 224 aa, Panicum virgatum
  misc_feature: Ceres CLONE 1990344
  misc_feature (46)..(223): Pfam Name: MIP Pfam Description: Major intrinsic protein
  misc_feature: Useful for making plants with modulated water use efficiency
  misc_feature: Useful for making plants with modulated cold sensitivity
  misc_feature: Useful for making plants with modulated drought sensitivity
MEGKEEDVRLGANKFSERQPIGTAAQGTDDKDYKEPPPAPLFEPGELKSWSFLYISILTVMGVSKSQSKCATVGIQGIAWSFGGMIFALVYCTAGISGGHINPAVTFGLFLARKLSLTRAIFYMVMQCLGAICGAGVVKGFQQGLYMGNGGGANVVAPGYTKGDGLGAEIVGTFILVYTVFSATDAKRNARDSPRPILAPLPIGFAVFLGHLATIPHHRTGIHP

SEQ ID NO: 37517 - DNA, 622 bp, Panicum virgatum
  misc_feature: Ceres CLONE 1990350
  misc_feature: Encodes the peptide sequence at SEQ ID NO. 37518
acgggcttctcttctccgacgcgtcctctatttctgtcgcccaccaagcgttgaccggccggagcaatgaaaggagaataggcttgctcgtgagccggatcccatcccctctcgtctcgtctcatctcttgcccactgttagttctcacactctgcccatcgattgcggtgtggtacgggccaaaccttcagtactataaataaatctctactggtatcccttatggagcttgctgaaaacaaacttaccgacttcatcaaaagcagtgaaaaggcaaagtggagggcaatcaacaaccacaatataaacaacttcacagaagatgaaatcaaacggatcactaacaactatagctctctcattggcgaaggtggctttggacaagtttacaaaggccatcttgatgatgttactccagttgcagtaaaaaaatacatgcggcagaatttcatagaaggttttggtaaggaaataatcgtccattgccaaatcaaccacaaaaacgtagtgaggctcctaggctactgtgcagaggaaaatgctttaatgattgtcacagagtatgtctcggggggaaacctccgtgatcttcttcatggcagtgacgatccaatttcctta

SEQ ID NO: 37518 - protein, 132 aa, Panicum virgatum
  misc_feature: Ceres CLONE 1990350
  misc_feature (39)..(131): Pfam Name: Pkinase_Tyr Pfam Description: Protein tyrosine kinase
  misc_feature: SWISSPROT Homolog: EC 2.7.11.1 Non-specific serine/threonine protein kinase
MELAENKLTDFIKSSEKAKWRAINNHNINNFTEDEIKRITNNYSSLIGEGGFGQVYKGHLDDVTPVAVKKYMRQNFIEGFGKEIIVHCQINHKNVVRLLGYCAEENALMIVTEYVSGGNLRDLLHGSDDPIS

SEQ ID NO: 37519 - DNA, 688 bp, Panicum virgatum
  misc_feature: Ceres CLONE 1990359
  misc_feature: Encodes the peptide sequence at SEQ ID NO. 37520
acgtgtctcagccggtcacccctcaaactcctctccctccccttcttcatttccatcagcttttgtctcaccgtcacagaaattccgattgcggcgcagtcccggattgttcactccagcccgcaaatgatcatcaccgtcagcagcagcttctcgaagaattcatgatccttttgcgatgtcgaatcgccgggtcgaggtcggcgacaggacctttggacggcgtcggtagttccatggtagcggtgtcgaggaaccgcagcatcccgtctcgagtttgttggagcggcgcccgcgaaccttgcggcaggggagagaaaccgtcacgcccagcggtgaggggtgtggggggagggaagcgggaatccggcggctgcgggtgcgcaggcgggcgggggcggagctccgggagccctctgaatgggtccgatctccaatgatgcgtcgcataagaggttcttcagcatcgcgccaccggcggcactgatatttttcttcgtactaatattcgtcgctggtgcaattgtcacgcttgatcacaaggagaacttgtcgatactgcagctgcatccaagagaagcgtttgcaaccgaggagatcaggcctccagcgacgagcgcgttgcgcgctgagccacagaggaacccacctctgtgagaaccatgcagacctcaggcagcgaggcctt

SEQ ID NO: 37520 - protein, 78 aa, Panicum virgatum
  misc_feature: Ceres CLONE 1990359
  misc_feature: Useful for biocontainment applications
MGPISNDASHKRFFSIAPPAALIFFFVLIFVAGAIVTLDHKENLSILQLHPREAFATEEIRPPATSALRAEPQRNPPL

SEQ ID NO: 37521 - DNA, 691 bp, Panicum virgatum
  misc_feature: Ceres CLONE 1990370
  misc_feature: Encodes the peptide sequence at SEQ ID NO. 37522
accatcctaaagagaagaagaaacaagcaagtagcaatactctctttcttgtaacatagcgcagcaaaggttactcacttacatggcaacttccatgggttgcctcgtcttgctctgccttgtttctcccctcttccttgccagtgccgtccacggccacccatggggcggcttgttccctcagttctacgaccattcatgccccaaggcgaaggagattgtgcagtccattgtagcacaggctgtggccaaggagaccaggatggcggcatccttggtcagactgcatttccatgactgctttgtcaaaggctgcgatgcatccgtgctgttggacaacagcagcagcatagtcagtgagaaagggtctaaccccaacaggaactccctccccccgtttgaggtggtcgaccagatcaaggccgctctcgaggctgcctgcccaggcactgtctcctgcgccgatatcctcgccctcgcagcccgtgattcaactgtcctggttggaggcccatactgggacgtgcctctcggccggagggattcgctcggtgcaagcatccagggctccaacaacgatatcccagcccccaacaacaccctcccaaccatcatcaccaagttcaagcgccaaggcctcaacgttgtggacgtcgtcgccctctccggtggccacaccataggtatgtct

SEQ ID NO: 37522 - protein, 198 aa, Panicum virgatum
  misc_feature: Ceres CLONE 1990370
  misc_feature (43)..(198): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
  misc_feature: Useful for making plants with modulated phosphate use efficiency
MGCLVLLCLVSPLFLASAVHGHPWGGLFPQFYDHSCPKAKEIVQSIVAQAVAKETRMAASLVRLHFHDCFVKGCDASVLLDNSSSIVSEKGSNPNRNSLPPFEVVDQIKAALEAACPGTVSCADILALAARDSTVLVGGPYWDVPLGRRDSLGASIQGSNNDIPAPNNTLPTIITKFKRQGLNVVDVVALSGGHTIGM

SEQ ID NO: 37523 - DNA, 586 bp, Panicum virgatum
  misc_feature: Ceres CLONE 1990371
  misc_feature: Encodes the peptide sequence at SEQ ID NO. 37524
aacccatctcgctcgcgcgtccaatcctccttcttctccatcattccagctcctggcgcgagatggtttcaacgcctcttgagctgctttcgtgagtcctaactcctaagcaacgccggcggcggattctgttgccgatggcattgaggctgctgctgctggtgttcgtcctcttcgtcgcggccgccgcgagctgcgggccggcgctcgcgaaccccgcggcgggcgcgattctgccgggcctcccggtcgccgggctcgccgtcgggttctacaaggagtcgtgcccgcaggtggaggacctggtgctcgccgagatgcaagccatcgtcgccaaggactggaccctcgggccggcgctgctgcggttcatgttccacgactgcctcgtcaggggttgcgacgcgtcgatcatgctcatctcgcagaacaagaccggggagagggatgcctatcccagctacggcctccgcggctacgaacagatcgagcagatcaaggccaaggtggaggcggcgtgcccgctcaccgtgtcgtgcgccgacatcatcgccttggcggcccgggacgccgtgtacctgagcaa

SEQ ID NO: 37524 - protein, 149 aa, Panicum virgatum
  misc_feature: Ceres CLONE 1990371
  misc_feature (57)..(149): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
MALRLLLLVFVLFVAAAASCGPALANPAAGAILPGLPVAGLAVGFYKESCPQVEDLVLAEMQAIVAKDWTLGPALLRFMFHDCLVRGCDASIMLISQNKTGERDAYPSYGLRGYEQIEQIKAKVEAACPLTVSCADIIALAARDAVYLS

SEQ ID NO: 37525 - DNA, 2023 bp, Panicum virgatum
  misc_feature: Ceres CLONE 1990381
  misc_feature: Encodes the peptide sequence at SEQ ID NO. 37526
agatgaagaagaactatccggtgtactacttgaaggcctcacagtttgtgtggacttgtctgtggttctatgcaaagataccgcagagctgcagattgaccttcaggggtgatgcactcaaggagaccaacaattggagcgatgtgttgcatttgtcccctgaacagcaggaccaggttcgccgaattggggagctgagcaaccaaggcttgactggtgtagacatcatcaatgacttcctcaagcaccggattagccctttgcgccgaagggctcatttggcatgcaactacactggtccaactgatcccaccagggattcggatgaagatctttctgaggaagacattgagagcaagctaagctaccttctagatcttaagaagacagggcagaaggagcccccaaggaaacctaatgttccaatcagcctggttggagcatcagccgatgagcgaggcaatcaacatctcgacttgcggcgtgtcctgtcgactctcaaagttaagaagaaagcagttgaggagttgacagctccaggaacgattagggaatcttcattgtataaacctcttgccccagactccccacgaagatacacaaggcaatctgctgttcatagggcaattgtaggatctccacctcctgaagatgaggagattctagaagctagaacaactatgacaactgcatcttcttcaaaccggggcatcgagcagaagtcaatagagaaacctgctgagattgaaagggggaaaagagtagtgttgatgaagtctatttcctcaattattggtgataaaagaaaggtttttgcctcccattctggttatcagagaaaagcaaagcgcacatttatttccattaatggaaggaccaggatgtcatctttggacactggtcgtataaaagggacttccttggaaaaagaggcaggagtggccctgcatccacaatcaccaagatcggctcgacccgcaccttcatcttcagtggaaaagggagagaagagtgcactgatcatactcgctaatgtggtcgaccagaataaggtggctgaggagtctgtgtcgaatgtactccttgaccagcatgttaggaattctcctcccaaagagttcgatcctgcacagtctattgctgagagagttcaataccaggaagccattgaggaatcagctctcactccggtgcctaattcagaggaaataaacaatgatacgatatttgagaggatgcagaaaattaagagggaatatgcatctttgagcgagcaggccttgtctgagcttttcaaacaagcagagaagctttttatggagaacaagcgtctggaggatgagcacataatgctggaacaacaagtgaaaggcctcgaagaaaacaaaaggctattaacagacatgatgaggaaagctgggcaggaggcattaaaaagaatagaagaaaataaaaagctgaaagatgagattagaggccagaagaagacaattgaggagctgagtgagcagaatgagtcgatccaagggtccttggtcgaaaaatgcatagaggtgaaccgcctcaaagaagaggctgcagtgctagtaaaagacaaggaagagctgcaatcacgtgtgtcacatgtcaatgaaattctcgacaccgtgaggagtgctttatacgatagaagttttgatgacaagtggaaatgattgacagaaggaatgtgattggaactgaatgtagactattgagtattgacgcgtagaacttcagaaatgattgacagaagaaatgtagactaaaggattgaacgtctggaggtagacaaggttggactcttgaaaagttggactcgtatgtgctaatagcatcaggactcctattgtcaagtgtattggtgattcgtgctagatctgtaatttctggtagtaacatctcttagtatgaatgtctagttctgtaattcctggtgataatgggtaacagtctttgtacaaatgtcccatttctgaaattttgaaaagattccttattcctg

SEQ ID NO: 37526 - protein, 563 aa, Panicum virgatum
  misc_feature: Ceres CLONE 1990381
  misc_feature: SWISSPROT Homolog: EC 2.7.11.1 Non-specific serine/threonine protein kinase
MKKNYPVYYLKASQFVWTCLWFYAKIPQSCRLTFRGDALKETNNWSDVLHLSPEQQDQVRRIGELSNQGLTGVDIINDFLKHRISPLRRRAHLACNYTGPTDPTRDSDEDLSEEDIESKLSYLLDLKKTGQKEPPRKPNVPISLVGASADERGNQHLDLRRVLSTLKVKKKAVEELTAPGTIRESSLYKPLAPDSPRRYTRQSAVHRAIVGSPPPEDEEILEARTTMTTASSSNRGIEQKSIEKPAEIERGKRVVLMKSISSIIGDKRKVFASHSGYQRKAKRTFISINGRTRMSSLDTGRIKGTSLEKEAGVALHPQSPRSARPAPSSSVEKGEKSALIILANVVDQNKVAEESVSNVLLDQHVRNSPPKEFDPAQSIAERVQYQEAIEESALTPVPNSEEINNDTIFERMQKIKREYASLSEQALSELFKQAEKLFMENKRLEDEHIMLEQQVKGLEENKRLLTDMMRKAGQEALKRIEENKKLKDEIRGQKKTIEELSEQNESIQGSLVEKCIEVNRLKEEAAVLVKDKEELQSRVSHVNEILDTVRSALYDRSFDDKWK

SEQ ID NO: 37527 - DNA, 971 bp, Panicum virgatum
  misc_feature: Ceres CLONE 1990382
  misc_feature: Encodes the peptide sequence at SEQ ID NO. 37528
agagagatcccttccctcccccggactccacccctgcgtgcgcgcggcgcggggcgcggttggggcgtcgtgtccctccctccctcacctgggcaagccttcttcctccgcctggcttccgcttcaccccaaaggcaccaaccagtgggcagcggccgccgcggcaggaggaggtggaggacctgggcgccgggagccagggaatctggagggggggcagagtggtggtgggggaagaagaaaggtggagacttgctcctgacaaaagcgagggcgactgctgcggcggcaggaggaggaggagggaccatttcttgggctgcgatcatgaggtcgtctcggagagggaggagcgacagtagggccctgaggttgctgagctgagagaggcagggggccttgggaacgtagagagggaatcggggtgattgggaaagagagagggggggacggtgcgagggagaagatgagcttcacaagagcaggggagtgcggatcggcagcggcggaggggacgagctggtgctgataggctccgtctccaagaagtggaccttcctcctctgcctcggcagcttctgcatcggcctcctcttcaccaacaggatgtggacaatgccggagccgacagagatcatcaggaggtccacactcgaacttgacaagatgaatcttgtcaccggtgactgtgctccggaaagtatcggcgatgcaaaagacattcctggggaggttccaagaacccaagatgttatacagacactggacaaaacgatatcaaacctagaaatggagctagcatctgcaaaggcgacacaggaatccatgctcagtgtcgccccaacatccgaatcaacagggaagcggaaatacttcatggtcgttggcataaacaccgcgttcagcagccggaaacgaagagattcaatccgtgctacatggatgcctcaaggtgagaaaagaagaaagat

SEQ ID NO: 37528 - protein, 121 aa, Panicum virgatum
  misc_feature: Ceres CLONE 1990382
  misc_feature: Useful for making plants with altered carbohydrate content
MWTMPEPTEIIRRSTLELDKMNLVTGDCAPESIGDAKDIPGEVPRTQDVIQTLDKTISNLEMELASAKATQESMLSVAPTSESTGKRKYFMVVGINTAFSSRKRRDSIRATWMPQGEKRRK

SEQ ID NO: 37529 - DNA, 790 bp, Panicum virgatum
  misc_feature: Ceres CLONE 1990382-R
  misc_feature: Encodes the peptide sequence at SEQ ID NO. 37530
gtctccacttcttcatggtcggctttgcgccactcacctcgcgtggctcgcagcagtaccgtgccctcactgtccctgagctgacccagcagatgtgggatgccaagaacatgatgtgtgctgctgacccgcgccatggccgctacctcacagcctctgccatgttccgtggcaagatgagcaccaaggaggtggacgagcagatgatcaatgtccagaacaagaactcttcctacttcgtggagtggatcccaaacaatgtcaagtccagcgtctgtgacatcccaccgtgtggcctctccatggcctccaccttcatcggcaactccacctccatccaggagatgttccgccgtgtgagcgagcagttcactgctatgttcaggaggaaggctttcttgcattggtacactggtgagggcatggatgagatggagttcactgaggctgagagcaacatgaatgacctggtgtccgagtaccagcagtaccaggacgccactgcggacgaggatggcgactatgaggacgaggaggtaatccaggacgagtaaggtggtctggaccctgccccatgttgtccccaccagatcctggtttgctttaagctggagcttgcctatgtttggttactgttatttgcgtatgttatgctgagtatgtagtaagtacctccgtggtggtagcatgttgcatgctaccgcttattctctttcaccaccagaaagacatgttcgcctgcactgcttgatatgccatcgcgtatatgggaggagtattggattattgt

SEQ ID NO: 37530 - protein, 183 aa, Panicum virgatum
  misc_feature: Ceres CLONE 1990382-R
  misc_feature (1)..(121): Pfam Name: Tubulin_C Pfam Description: Tubulin/FtsZ family, C-terminal domain
  misc_feature: Useful for making plants with modulated flowering time
LHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPCGLSMASTFIGNSTSIQEMFRRVSEQFTAMFRRKAFLHWYTGEGMDEMEFTEAESNMNDLVSEYQQYQDATADEDGDYEDEEVIQDE

SEQ ID NO: 37531 - DNA, 735 bp, Panicum virgatum
  misc_feature: Ceres CLONE 1990386
  misc_feature: Encodes the peptide sequence at SEQ ID NO. 37532
tttaagaattttgagaaggatggagagttcttttgttttgtgggacaatcaacccaagctgtcacggggatgtataacctcaacagagcctctcagataggatttcaaggcgaggatatattgcaccgtgctaggattttctcatatgagtttctcagacaaagagaagcccaaggcatgctccatgataaatggataattgcaaaggatgtagctggagaggttatttaactcattctatcattcgatatgatcatagaccgattgaaagtttaatagagttgaaagttaattggtgctttatgctttcatcaggatttttgccttgtcttcatcttttgctgttattgtctacgtaaaatatacacaacatactataacaatttcaggtattagtagtacatacattcatgttaaaagcaatataaggaatatttgaaattctagaaataactaaaatgaggtactatactgcaaaaatactagtaatgtctatctggtcctttttgaagtagatttattagcaaataacaaatattggaaattgataaaatgattggtttgggaattattaacaaatattgatgtatgattaccttgttttatttgcattagacccataaatatatgaaaaaaacaacattcttttagctaaatatgttaataaaaacaatcaaatcaagccaagtaagataaacaaaaaggatgatggcatacataaggatcaaagttacc

SEQ ID NO: 37532 - protein, 76 aa, Panicum virgatum
  misc_feature: Ceres CLONE 1990386
  misc_feature: SWISSPROT Homolog: EC 5.5.1.13 Ent-copalyl diphosphate synthase
  misc_feature: Useful for making plants with modulated biomass
  misc_feature: Useful for making plants with modulated flowering time
  misc_feature: Useful for making plants with modulated biotic stress sensitivity
FKNFEKDGEFFCFVGQSTQAVTGMYNLNRASQIGFQGEDILHRARIFSYEFLRQREAQGMLHDKWIIAKDVAGEVI

SEQ ID NO: 37533 - DNA, 683 bp, Panicum virgatum
  misc_feature: Ceres CLONE 1990391
  misc_feature: Encodes the peptide sequence at SEQ ID NO. 37534
gaatccccacccccgctcaaatccactccgaggaatccacaacccgtctggtcgtcggcaagcatgtctgggcgcggcaagggcggcaaggggctgggcaagggtggcgcgaagcgccaccggaaggtgctgcgcgacaacatccagggcatcaccaagccggcgatccggcggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcactgccatggacgtagtctacgcgctcaagcgccagggccgtaccctctacggcttcggcggctaggctgatgcactcgccccctcgctgtctcccttctgcagctacgacgttatctgggcattgctcacaggtcttgctgtcaaaaagtctcagattcgcttgattagctcatctctggctgtagtaggtttatctgaaccatgagacattaatgaattgaagttaccttgtgaaaaaaccccctcttcctctctccgtcgcgtcacaggcgacggcggcggcgacgaaggattcccggcggctcttggtggactcgacggccgttggaggtttgccgccggcgggttcagcaggacctagctagactctgc

SEQ ID NO: 37534 - protein, 103 aa, Panicum virgatum; identical to SEQ ID NO: 12044
  misc_feature: Ceres CLONE 1990391
  misc_feature (25)..(94): Pfam Name: Histone Pfam Description: Core histone H2A/H2B/H3/H4

SEQ ID NO: 37535 - DNA, 1974 bp, Panicum virgatum
  misc_feature: Ceres CLONE 1990393
  misc_feature: Encodes the peptide sequence at SEQ ID NO. 37536
acaacaaattagtttaatcgaaattgaggatgtcccagaaaaagacaccgaatggacggaaaaagagaaaaaatcgaaagaaagtcagaaagttgaagaaattagtgatgagtcaagtatggacgaggatgaaccaaaggaggaaaaaaagaagagggcaagatctacttctaggtcatcaaaaaaggataaaaaggataagaaagataagaaagacaaaaaagataagaaggataaaaaagataagaaagataagaaagacaagaaggacaaaaagaagaaagatagagatctttcacctgaacctaaaaaaacaagaaaaagaaaagctgagactgaacttaaacgtgctccagcaaaacgtggaagaggagcaggaagggggagaggaagaggaactcctcaacctcatatttctcttgttgatttggatttaatgtgggaatctccaagttctgatattgttcatacaaatgatagtttcatagcaagtagagaattaattcgagcagttaaaacaaacaatctcgaactagctcaaaaaatctttgctgaccgttcgcctgtctccgatttgtacgctcctcaggggcctgaagtcactctcactgctctggattggggaatcatgactaataatttggaagttttgaaactttatgtaaatgaaacgaagaaaccaacaaaaagaacaccagctcctgttgtttcatttgaaaaagctgataccggaagttataatcataaaaccttcaaacatcaagtcgcagcattaacaggtgctcgtggtggaaaagaaggaaatgatgcatttcttcatgaccctccagcaaacaactatttccaaggcatccatgaaagagttttcgcttgtgagactataaatgaagatacaattaaatatttatttacttttgggcaaaattttaatacttttaattctaatcttggccaaatttgtcaattaggaaatgtgaaattagcttcacttgtaatcaaacaacttgttttagatgatcatgggtttaatgacttacatcaaaatatgcttctctacaaaaacgaagagctcaaagatagcatcagggctgtttctgttaccaagaagccttatgagtgttgtggtgctactccccttcattggtcttgtattaacccaaatccaaagtatcttaaagcgttcttggaattagttccaaatattcataccaaagatttgatgaacagatcactagttcactatgcagtagcttgtgaaggaactggtccattggattatttatttttatatgcaggagatacaggagtcttatttaaagaacccgatagaagtggaacaaccccattaatgattgctgcggcaatgggaagaatagcaaacatgaagattttattcaaaaaagagaaaattgccgatgaggcggctgctgagagagctaaagttgaggaagctgaagctgcggctgctgcagctgcaaaggcagcttctcctgatgctgaaatgactgagggtgtcaaggaaaaagaaccagagggtgaaaaagaacctgaagaagaaaaagaagcatcagaagatgaagatgaagatgaagatgaaagaccaagaagaggaagaggaagaggaaggggaggggcaagaagaggtcgaggagcccgaggaggaagggccagaggaggtcgaggaggaagagcaagaagtgcaagtgctccaccaaaaaagaaaaaacctgttggtaaaatggtcgaccaagtcgagctcctgagagctgagggaaagggatattccgctcttcattatgctgtacattatgatagatgtgaggcaacaaggtatttgattaaacatggagcaggtattgaaaaaggaacaagaaagaataaattcactcctttgcatatcgcttcccaacaaggaaacctggaagtttcaaaagtcctccttgaactaggggcaaaagttgattcacgtgatgg

SEQ ID NO: 37536 - protein, 657 aa, Panicum virgatum
  misc_feature: Ceres CLONE 1990393
  misc_feature (592)..(624): Pfam Name: Ank Pfam Description: Ankyrin repeat
  misc_feature (165)..(464): SWISSPROT Homolog: EC 2.4.2.30 NAD(+) ADP-ribosyltransferase
  misc_feature (593)..(655): SWISSPROT Homolog: EC 3.1.1.4 Phospholipase A(2)
QQISLIEIEDVPEKDTEWTEKEKKSKESQKVEEISDESSMDEDEPKEEKKKRARSTSRSSKKDKKDKKDKKDKKDKKDKKDKKDKKDKKDKKKKDRDLSPEPKKTRKRKAETELKRAPAKRGRGAGRGRGRGTPQPHISLVDLDLMWESPSSDIVHTNDSFIASRELIRAVKTNNLELAQKIFADRSPVSDLYAPQGPEVTLTALDWGIMTNNLEVLKLYVNETKKPTKRTPAPVVSFEKADTGSYNHKTFKHQVAALTGARGGKEGNDAFLHDPPANNYFQGIHERVFACETINEDTIKYLFTFGQNFNTFNSNLGQICQLGNVKLASLVIKQLVLDDHGFNDLHQNMLLYKNEELKDSIRAVSVTKKPYECCGATPLHWSCINPNPKYLKAFLELVPNIHTKDLMNRSLVHYAVACEGTGPLDYLFLYAGDTGVLFKEPDRSGTTPLMIAAAMGRIANMKILFKKEKIADEAAAERAKVEEAEAAAAAAAKAASPDAEMTEGVKEKEPEGEKEPEEEKEASEDEDEDEDERPRRGRGRGRGGARRGRGARGGRARGGRGGRARSASAPPKKKKPVGKMVDQVELLRAEGKGYSALHYAVHYDRCEATRYLIKHGAGIEKGTRKNKFTPLHIASQQGNLEVSKVLLELGAKVDSRD

SEQ ID NO: 37537 - DNA, 1305 bp, Panicum virgatum
  misc_feature: Ceres CLONE 1990395
  misc_feature: Encodes the peptide sequence at SEQ ID NO. 37538
ctcctgctgttctggttcacttgcttcccattccgagtgccgcccgccacccgggcaccaggcgaaaagcttcgtcagcatccgccgccgcttcgcgtcccttccccgcggacgcgaggtgcacgctcgcttcgtaggaagcgcgcggaggaggccggcggagaagggggaggcgcagtgttcgaggagccgcggcgcgccggggagcagaggcggcgcgagcgcgcgcgcacggtgtgcgtgtgcgccgtacgcgtacgtgcgtgagagcaggaggacgaggagcgcatggggtcgaggcggcggcggcaccaccaccaccacggcccgtggctggtgcccgcggtggcgccggcagccgcggcgttcgctgcggcggggctgctgctcgtcgtcgtcgcgttccactgcttcctgtcgccgccgctcggcgacggcggcgcgcgtgtcgtccggcgcctgaacccgccgttcctgttgaacaagccagcggaggttgccaggagtgtaatcggcgccgtggatttcactgttcctagcggcgggagcaagcgtggggaggagctctgggagtcgaaggcggcgggcaacttcttcggctgcagcaacgcgaccaagcagttcgccgatgccaggtctgtgacgaagtcggaccgttacctgatgatcgcgacgagcggcggactgaatcagcagcgaacagggatcatagatgctgttgttgcagcccgcatactgaatgcaacacttgtcattccaaagctggatgaagaatccttctggaatgacgcgagtgactttgcagagatatttgatgtggattcattcatatactcactctcaaacgatgtaaaggtcatacgacaattacctgatatgaatgggaaaaagctttcaccatataagatgcgtatccctaggaagtgtactccaaaatgctatgagaacagagtgctacctgctcttctgaaaaaacatgttgttcaattaacaaaatttgactaccgagtgtccaataggcttgagactgatcttcaaaaacttaggtgtagagtcaattatcatgcattgcaattcacagatccaatcctaagaaggggcgaattgcttgtccaaagaatgaaggagaaaagtggacgcttcattgctcttcacctgagatttgagcctgacatgctcgctttctctggttgctattatgggggtggagacattgagagaagagaactcagtgagattcgtaagaggtggaaaaccctgcatgcaagcaaccctgacagaaaacggcggcacggtaagtggccc

SEQ ID NO: 37538 - protein, 338 aa, Panicum virgatum
  misc_feature: Ceres CLONE 1990395
  misc_feature: Useful for making plants with modulated nitrogen use efficiency
MGSRRRRHHHHHGPWLVPAVAPAAAAFAAAGLLLVVVAFHCFLSPPLGDGGARVVRRLNPPFLLNKPAEVARSVIGAVDFTVPSGGSKRGEELWESKAAGNFFGCSNATKQFADARSVTKSDRYLMIATSGGLNQQRTGIIDAVVAARILNATLVIPKLDEESFWNDASDFAEIFDVDSFIYSLSNDVKVIRQLPDMNGKKLSPYKMRIPRKCTPKCYENRVLPALLKKHVVQLTKFDYRVSNRLETDLQKLRCRVNYHALQFTDPILRRGELLVQRMKEKSGRFIALHLRFEPDMLAFSGCYYGGGDIERRELSEIRKRWKTLHASNPDRKRRHGKW

SEQ ID NO: 37539 - DNA, 798 bp, Panicum virgatum
  misc_feature: Ceres CLONE 1990395-R
tatgagttggcacacatttgcatccaaagttctgacattccaaaagggattcatgggggaccccaatgagattaacccaggaagaggcgaattccatgagcatcctatggattgcatttgtgcaaaagccaagggaaaaattgggcagagcaggcctcatcaaattaaacgtgctggagaagctgcggagaaccattctagtgatgacctcgactggagggatttggactatggagagcatacaccattgggcagggattcatctaatgaatctgaatcggatgatattcgtgttggtggatcagacattcctgaattggaggacatgatgtcagactagatacttaaaaattgatatttctatataggtttgtttttcttttcaaagggcttggtgataaactattgtgcttacagaagctgctgcataggttatcatttctcctgtttatttcttggagacttatagaagagaataagagttttggctggcccagcaaagaagaaagggcaggaagagcttcctgcagaaaaagcagagaagccttcagctcagtgtgagctaaacaactgtacagtgtttgattggtcctctagtaatgctgattagtggtaaactagaagacgtttttccttcatggcttttctttcatatagtttgtactgtaaatagatgctacaaagaccattctttaagcttttacagtgtagtgttataattagaatttgctgtgggttagtatttattaccaattttgcgcctccatcgaaatttatatatataacttgaagcatgag

SEQ ID NO: 37540 - DNA, 667 bp, Panicum virgatum
  misc_feature: Ceres CLONE 1990411
  misc_feature: Encodes the peptide sequence at SEQ ID NO. 37541
aaaaaaaaaaaaaaaaactcgccgcgccgcgccgccgccaccccccaccagcaccccgagtcctggagagaagcagatcggcggcgcgtcactccaactgccggtaagcttaaatggcgacggttcctgattctctgatctgggagatcgtgaggaagaataactccttcctggtcaagcagtttggcaatggcaatggcaatgccaaggttcagttcagcaaggagcctaacaacctctacaatgtccactcctacaagcactctggccttgccaacaagaagaccgtgactgtgcaaccagccagtggcaaggagatagcggtggtcctcttgacaaccaagacaaagaagcagaacaagcctgccagcctcaaccacaagtctgtcatgcgcaaggaattccgcaagatggccaaggctgtcaagaaccaggtcggtgacaattactacaggcctgatcttaccaagccagctcttgcaaggctgagcgcagtgtaccgcagcctccaggttgccaagtctggtgtcaagaagaagaacaggcaggcgaactaagtcacaaggagttgttttgatgggtggtgtttatgtttcatggtttctagatctggagtatgatggatgatgtgcgtaccttaccgtgtgtttggttgggggttgggggg

SEQ ID NO: 37541 - protein, 147 aa, Panicum virgatum
  misc_feature: Ceres CLONE 1990411
  misc_feature (5)..(139): Pfam Name: Ribosomal_L28e Pfam Description: Ribosomal L28e protein family
  misc_feature: Useful for making plants with altered oil content
  misc_feature: Useful for making plants with modulated cold sensitivity
MATVPDSLIWEIVRKNNSFLVKQFGNGNGNAKVQFSKEPNNLYNVHSYKHSGLANKKTVTVQPASGKEIAVVLLTTKTKKQNKPASLNHKSVMRKEFRKMAKAVKNQVGDNYYRPDLTKPALARLSAVYRSLQVAKSGVKKKNRQAN

SEQ ID NO: 37542 - DNA, 1294 bp, Panicum virgatum
  misc_feature: Ceres CLONE 1990426
  misc_feature: Encodes the peptide sequence at SEQ ID NO. 37543
accagtgcaaagcatacagcactctccactgtttggggaagcagcagcagagggcaggtcgatcgatcagctagcaatgatggctcgaccagcggtctggtttcttctccttcctctcggcctcttatgcctgtgtctgtgtagctccgccgcctctctctccggcggcgccacggcggcggacgactacgtcgtcgtggccacgagctcgctcaagccgaagccggtgtgccaaggcctcagggtggatgcgccggggaaccttaccggcagcggctgggtgccgctgagccactcctacggcccgtgctcggcggcgggaagctggtggtcgccggtggcggacgacgtgctgcttctggaccagcgccgcgcgggctacatccagaggaagctcgccggcagcaccccccaggacgacaacggcagcgacctgccggagtcggactgcaagagcggccagtcggagcatgctcccaccattcaacccaacgttggccaagacagtagccccacgtcagagggctcggaggcggtgtccgtcatcgaaccgacggcgggcggtggcggcggcagcggcagcggcgggcagcgggtgccgggcgtgaagcagacgatggtgctggacacggcgagcgacgtggcgtgggtgcagtgcgccccctgccccatgccgcagtgccaccctcagacggacaccatctacgacccctcgcagtcgtcgacgtacgcgcccttcgcctgcggctcccccgtctgccggcagctcggcccctacggcaacggctgcgccgccgggtcccggcagtgccagtaccgcgtcctgtaccccgacgggcgctccaccatgggcacctacatctccgacgtgctccgcctcaaccccacctccgtcatcggcgggttccagttcgggtgcagccacgccgtgcagggccacttccccaacgacaccgccgggatcatggcgctcggccgcggcgcgcagtcgctggcgtcgcagaccaggctcacctacggcggcgtcttctcctactgcctcccgcggacggcgagctacagcggcttcttcgtcctcggcgtgcccagggtcgctgccacccggtacgccctcacgcccatgttcgccgtcccgcaggcgccgatgctctacctcgtccgcctccgggccatcgtcgtcgccggccaggccctcgccgtgccgccggcggtgttcgcgccgggctccgtcgtcgactcgcgctcggtgatcacgcgcctcccgccgacggcctacgccgcgctgcgcggcgcc

SEQ ID NO: 37543 - protein, 405 aa, Panicum virgatum
  misc_feature: Ceres CLONE 1990426
  misc_feature: SWISSPROT Homolog: EC 3.4.23.12 Nepenthesin
MMARPAVWFLLLPLGLLCLCLCSSAASLSGGATAADDYVVVATSSLKPKPVCQGLRVDAPGNLTGSGWVPLSHSYGPCSAAGSWWSPVADDVLLLDQRRAGYIQRKLAGSTPQDDNGSDLPESDCKSGQSEHAPTIQPNVGQDSSPTSEGSEAVSVIEPTAGGGGGSGSGGQRVPGVKQTMVLDTASDVAWVQCAPCPMPQCHPQTDTIYDPSQSSTYAPFACGSPVCRQLGPYGNGCAAGSRQCQYRVLYPDGRSTMGTYISDVLRLNPTSVIGGFQFGCSHAVQGHFPNDTAGIMALGRGAQSLASQTRLTYGGVFSYCLPRTASYSGFFVLGVPRVAATRYALTPMFAVPQAPMLYLVRLRAIVVAGQALAVPPAVFAPGSVVDSRSVITRLPPTAYAALRG

SEQ ID NO: 37544 - DNA, 334 bp, Panicum virgatum
  misc_feature: Ceres CLONE 1990426-R
acacacacacacacacacacacacacacacacccacacacacacacccccacacacacccccccctctctctctctctatatatatatatatatatatatatatatatatatatatatatatatatatatatatacctaccgtcattttgggccattgtatatggtggtcgcgttagaataagccgagttaactcgtgcacatgtatttgcgtggtctatcttaagcttcttgtaggtgtgaaatgaagcttaagaactattttctgggcaagtctgtccaaaaaggaaatacatatatattttgacaaataaagtacatttttgttgtggtct

SEQ ID NO: 37545 - DNA, 1854 bp, Panicum virgatum
  misc_feature: Ceres CLONE 1990442
  misc_feature: Encodes the peptide sequence at SEQ ID NO. 37546
aacaaacgctaaaaaagtaacagtttctgtactttattgttaccgatggccgacgatctcgattcaaccttggcacagcagcgcgaacgcctgcaaaacatgaaagcgcagcgtctggcgaagcgcagttcgtccgctcagtcgatgagtggctctgcacctaccgtgccagatgcaatccaggtgggcgagagacacgcgggcgctcagacccctttcgcatcaagcagcagtcctcgtgacagcgttgatttgctcgcgctgcagttcgtcaacgaacatcggctggattcccgttcacggttgccaaccaccgcgccggtgagcattgggcgaccgcgcacgtcgagtgcgtcgagcatgccggaatcggcgtcgccacgatcagctaccgtccaagcccttgatgcgcagcaccaaaccaagtgccgcgtggaaagagggcacgtggagctgctcgaactcacgcaacgacgaggggtcgaacaattagaagctgtgatgtggagcgatattgaacaccagtgcgccgtacaaatgaccacccacgcggccacgcttgcaacacgcctgcgcgatgccgacgccatgcttgcagcgaactgcaaggcgacaaccgcattacgatcattggtttcaggcgttaaagttaacagctcggagccactctccgatcaagaaatgacgactttcgcgacagctatcgatcaagcgcgggcactgcggtcggaagcatcgaaactgtcgagcctacttgctgaccgcgacgcgaccatcgtgacgctccgagagcagctgcgcggcgccgaggcaacgaagttgaaagttgagatcgattctcgcggagtgttggcacgtattcaatccgccgaagaatcatgtcgactcgatctccaaatacttcgtcgacagcagattgagaccgtcacgatgctacaacgggaaattggcggattggtgcaacaagttgcgcaatcggaccgagagtcgcagagatgccaagaggagattaactcgctgtttcaaaacagacgcgcagcagacacggcacttatccagaactgcgaaaaccagcgtgccgaggcgttgcgcagcactcgtcttgaaatgcaagaagtcattgatcgggtttctgaccgcgcagtaagagcggagcacctggctgaaaatttgcagaagaagctgctgcgagttgaacgagtcgcggcggagaccgctgcgtcgcgcaccgaactgttgcgacgtgtggatttcgttattcgtgagcgcgacgccgcactcgcggaagccagtcgtcgcataaatgagacagtggctgcttcgacgaaaattcacgttgaacaaaagcgtcatacagcagcactcgaagccgccttggccgtgagacaacgccagggatcgaaagagcgtcacagtcttgtggttgactcacgtcagaaggagtcgccttcggtaagccgcggtccgcaagcactcgccctcgcgcaccctggtcaggcacttgtggtttctcaaccaccatctccgatcgccacgcctggacgcttcacgtcgatccttgataccgtttccaagtacagtggcgtgtctgcaagcacgatgccatcgccgcctccaatgggcgaaagtccgttcgtgtccagcgacgcccacccgagatctgccgtgagcaaagttcgcgaggttgtccgtgcgttggcgtcacgtacgccgccaccaccgcatccggtgaacgaaaggttcgcatccctttcgcctcgagcacattcagccgcatccgataccgcaaccaggcctttgttcgacgcgttttctgccgaggcgcagctgtgaaccgttgtactcttcttgccg

SEQ ID NO: 37546 - protein, 595 aa, Panicum virgatum
  misc_feature: Ceres CLONE 1990442
  misc_feature: SWISSPROT Homolog: EC 2.7.11.1 Non-specific serine/threonine protein kinase
MADDLDSTLAQQRERLQNMKAQRLAKRSSSAQSMSGSAPTVPDAIQVGERHAGAQTPFASSSSPRDSVDLLALQFVNEHRLDSRSRLPTTAPVSIGRPRTSSASSMPESASPRSATVQALDAQHQTKCRVERGHVELLELTQRRGVEQLEAVMWSDIEHQCAVQMTTHAATLATRLRDADAMLAANCKATTALRSLVSGVKVNSSEPLSDQEMTTFATAIDQARALRSEASKLSSLLADRDATIVTLREQLRGAEATKLKVEIDSRGVLARIQSAEESCRLDLQILRRQQIETVTMLQREIGGLVQQVAQSDRESQRCQEEINSLFQNRRAADTALIQNCENQRAEALRSTRLEMQEVIDRVSDRAVRAEHLAENLQKKLLRVERVAAETAASRTELLRRVDFVIRERDAALAEASRRINETVAASTKIHVEQKRHTAALEAALAVRQRQGSKERHSLVVDSRQKESPSVSRGPQALALAHPGQALVVSQPPSPIATPGRFTSILDTVSKYSGVSASTMPSPPPMGESPFVSSDAHPRSAVSKVREVVRALASRTPPPPHPVNERFASLSPRAHSAASDTATRPLFDAFSAEAQL

SEQ ID NO: 37547 - DNA, 649 bp, Panicum virgatum
  misc_feature: Ceres CLONE 1990443
  misc_feature: Encodes the peptide sequence at SEQ ID NO. 37548
ctcgtcagccgtccgtcttttttagcggcttctgcgactgctcccagccttcccctctccctctatctccctcgtcagccgcctagctagcttccttcacaagcaccacggcagagcgaaccaagccggtgaccggtggttgccgctgcagcggcgactggtggctcgccgtctgcttcggcgctaggcgctttttatgcccgcggcagctcggttcctggactcatcgagcctttctgctaaagcggagattccggtatggaggtggaggcgacgcccacgacggcggccgtgtcgtcttccggcggggccgcgcagctgccgccgcccgggccgcccgccaagaagaagcgtgccctccccggcatgccagatcctgacgcggaggtgatcgcgctgtcgcccaagacgctgctggcgacgaaccggttcgtgtgcgagatctgcaacaaggggttccagcgggaccagaacctgcagctgcaccggcggggccacaacctgccgtggaagctccggcagcggagcggcaaggaggcccggaagcgggtgtacgtgtgcccggagcccagctgcgtgcaccacgacccctcgcgagccctcggcgacctgacggggatcaagaagcacttctgccgcaagcacggcg

SEQ ID NO: 37548 - protein, 130 aa, Panicum virgatum
  misc_feature: Ceres CLONE 1990443
  misc_feature (58)..(80): Pfam Name: zf-C2H2 Pfam Description: Zinc finger, C2H2 type
  misc_feature: Useful for making plants with modulated biomass
  misc_feature: The sequence is a functional homolog of SEQ ID NO 1086 in the 10/666,642 US patent application
  misc_feature: Useful for making plants with altered lignin content
  misc_feature: Useful for making plants with altered terpenoid content
  misc_feature: The sequence is a functional homolog of SEQ ID NO 312 in the 10/666,642 US patent application
  misc_feature: The sequence is a functional homolog of SEQ ID NO 214 in the 10/225,066 US patent application
  misc_feature: The sequence is a functional homolog of SEQ ID NO 2450 in the 10/374,780 US patent application
  misc_feature: The sequence is a functional homolog of SEQ ID NO 604 in the 10/412,699 US patent application
  misc_feature: The sequence is a functional homolog of SEQ ID NO 1524 in the 10/666,642 US patent application
  misc_feature: The sequence is a functional homolog of SEQ ID NO 1719 in the 11/479,226 US patent application
  misc_feature: The sequence is a functional homolog of SEQ ID NO 650 in the 10/666,642 US patent application
  misc_feature: The sequence is a functional homolog of SEQ ID NO 960 in the 11/435,388 US patent application
  misc_feature: The sequence is a functional homolog of SEQ ID NO 178 in the 10/225,068 US patent application
  misc_feature: The sequence is a functional homolog of SEQ ID NO 358 in the 10/374,780 US patent application
  misc_feature: The sequence is a functional homolog of SEQ ID NO 584 in the 10/666,642 US patent application
  misc_feature: The sequence is a functional homolog of SEQ ID NO 902 in the 11/435,388 US patent application
MEVEATPTTAAVSSSGGAAQLPPPGPPAKKKRALPGMPDPDAEVIALSPKTLLATNRFVCEICNKGFQRDQNLQLHRRGHNLPWKLRQRSGKEARKRVYVCPEPSCVHHDPSRALGDLTGIKKHFCRKHG

SEQ ID NO: 37549 - DNA, 1693 bp, Panicum virgatum
  misc_feature: Ceres CLONE 1990452
  misc_feature: Encodes the peptide sequence at SEQ ID NO. 37550
tacaaaaaccaaaaaggtaggggattgggcgccccccttctccctcccagaaaggcggcagcacctcctctcctgtcgggttcagggagaagcgctaggcgggggaggaagacgccgccggccgccggccgccgcccccctccctccggcctccgccaccaccagcccgcctgctatccacgcggggcctgaggaaaggggagaagcgctcgccctatccagcttccggagcggctgcaacctgaggttgagccagacctatattttctaagcaatggcggcaacgatggtggcgatgactgccaagagcaagaacagcgttttagccgtggagaagaagcagggctggtctattcagctccctgagctccggttcccatgggattcgcatgatgacaagggcttctctctaagcctgcaaggctctgggcctgctcatggcgggctgtttgctagtgttggtcttaaagtgtcgacgggtgcgccagcagtggcacacagttcgggggagaaggacattaagattcccttcgcggatcattgtataaagtatgtctctgaggcggttgggtaccaagttattagcaccgaggctgagacagtaaaggaggaggtggttgatggtaaggcaaagaagaaggccaggaaacatgggctgaagctcaaaatcaagattgggaacccacatttgaggcggctggttagtggagcaattgcgggggctgtttccaggacatgtgtggcaccgttggagacgattaggactcacttgatggttggaagcaatggggactcaatgacggaggtgttcaggtcgatcatgaacactgaggggtggaccgggctgttccgtgggaatcttgtcaatgttatccgtgttgcgccaagcaaagcaattgagctgtttgctttcgatacagccaagaaattcttgactcccaaggctgatgagtccccaaaaacattcctccctccgtcgcttgttgctggagcaattgctggggtcagctcaacattgtgcatgtatcctttggaattgattaagaccagattgacaatagagaaagatgtctacaacaacttccttcatgcctttgtcaagattctacgagaagaaggcccatcagagctgtaccgtggtctgacaccgagtctgataggagtggtgccatatgccgcgactaactactacgcgtatgacaccctgaagaagctctaccggaagacattcaagcaggaggagatcagcaacattgctactctcttcatcggctcagctgccggtgccatctcaagcactgccactttcccactcgaggtggcccgcaagcaaatgcaggttggagcagttggtgggaggcaagtctacaagaacgtgttccatgccctttactgcataatggagaaggaagggattggtggcctgtacaagggacttggacccagctgcatcaagctgatgcctgcggcgggcatctccttcatgtgctacgaggcctgtaagaagatcctggttgaagatgatgaggagagcgagtgaagtatttgcccctgattagtcctggaaggtggaagtggagattataccgccatttttgtttctatcgagaattggattatcaactcatgaaaatttaggtctaatacttgaagtgtgttaggtcaatttttggctcaagttagttttgtgtag

SEQ ID NO: 37550 - protein, 421 aa, Panicum virgatum
  misc_feature: Ceres CLONE 1990452
  misc_feature (325)..(417): Pfam Name: Mito_carr Pfam Description: Mitochondrial carrier protein
  misc_feature (231)..(319): Pfam Name: Mito_carr Pfam Description: Mitochondrial carrier protein
  misc_feature (137)..(224): Pfam Name: Mito_carr Pfam Description: Mitochondrial carrier protein
MAATMVAMTAKSKNSVLAVEKKQGWSIQLPELRFPWDSHDDKGFSLSLQGSGPAHGGLFASVGLKVSTGAPAVAHSSGEKDIKIPFADHCIKYVSEAVGYQVISTEAETVKEEVVDGKAKKKARKHGLKLKIKIGNPHLRRLVSGAIAGAVSRTCVAPLETIRTHLMVGSNGDSMTEVFRSIMNTEGWTGLFRGNLVNVIRVAPSKAIELFAFDTAKKFLTPKADESPKTFLPPSLVAGAIAGVSSTLCMYPLELIKTRLTIEKDVYNNFLHAFVKILREEGPSELYRGLTPSLIGVVPYAATNYYAYDTLKKLYRKTFKQEEISNIATLFIGSAAGAISSTATFPLEVARKQMQVGAVGGRQVYKNVFHALYCIMEKEGIGGLYKGLGPSCIKLMPAAGISFMCYEACKKILVEDDEESE

SEQ ID NO: 37551 - DNA, 731 bp, Panicum virgatum
  misc_feature: Ceres CLONE 1990456
  misc_feature: Encodes the peptide sequence at SEQ ID NO. 37552
atctcgcccaaaatccccaaatcttcctcctcccaaatccttcgaatcctccgcgcctccggcaagctccaggtcgtcgtcgcagcagaagctatgtcgggccgcggcaagggaggcaagggcctgggcaagggcggcgccaagcggcacaggaaggtgctccgcgacaacatccagggcatcacgaagccggcgatccggcggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagcctggccgccccccgcccgcgccctgtgggtcgcgtgcaggcacctagctagggttcctgatgggttagaggagttgatgtgctgcgttctgtcctgtgcctagctgcgttgtggtgttgacttaatagtaggtgtttatggttgtaatggtgaattggaagcctatcaattgaatgaatcgatgttctgaggcaaaaaaaaaggccggccacactcactcccctccaattcgatcctcccatccatccacccccacgcccagctcacctcctacgatcaattgctgatgggtttccccgttgggtactcggagatgcccaggcc

SEQ ID NO: 37552 - protein, 103 aa, Panicum virgatum; identical to SEQ ID NO: 12044
  misc_feature: Ceres CLONE 1990456
  misc_feature (25)..(94): Pfam Name: Histone Pfam Description: Core histone H2A/H2B/H3/H4

SEQ ID NO: 37553 - DNA, 1187 bp, Panicum virgatum
  misc_feature: Ceres CLONE 1990461
  misc_feature: Encodes the peptide sequence at SEQ ID NO. 37554
agaacccagcttgctagtccaaccgggaggactctaccgaggggggcaggtgtccggaacggatcaccaaatcccgcccgggcagccgagagatccgagcccgccgcgatccatggccgccacggcggcggcggcggcggcgcgcctcctcatcgtcctcgccgccttcctccacgccgcgccggagtcgttcgcggtcgtcgagttcttcgcccactggtgtccagcctgcagaaactacaagcctcactatgagaaggttgcaaaacttttcaatggtccagatgctgcacatccagggattattgtgatggcacgggttgattgtgcatcaaaggtgactgtggatctttgcaataaattctctgttgaccattatcctttcctagtgtggggtccgccagcaaaatttgattcccctcagtggaaacccaagcaagataatagtgaattagaattaattgacgatggaagaacagcagagcgtttacttmaatggataaataagaagatgggaagctcgcccagtttagatgacaaaaagtatgagaatgaaagtgcgctcccaaaaaatgcttcagatcctgaacagattgtccgagcaatttatgatgtcgaggaagcaacagctcatgcatggcagataattttggagcataagatgatcaaaccggagacccgtgactcactcattaggtttttacaaattttggtgtctcatcatccatccaagaggtgtcgaagaggatctgctgacctacttattaactttgatgatcactggcatacaaacatctcactaaattcacaagagagttcaacattgttaacaagtgttgcgggagacaacatctgtggaaagggggtgccacgtggatattggatgttctgccgtggaagtaaaaaggaaacaagaggatttagctgtggtctatgggttttgctgcattcactaactgttcgaatcggagatggagagagccaatcaacatttacatcaatttgtgatttcatccacaatttcttcatctgtgaggaatgccgcaagcacttctacgaaatgtgttcaagtgtaccagtccccttcaaatctgcccgtgacctcaccctctggctatggagagcacataacatagttaacgagaggttgatgaaagaagaaaaggatttagacacggctgatcctt

SEQ ID NO: 37554 - protein, 358 aa, Panicum virgatum
  misc_feature: Ceres CLONE 1990461
  misc_feature (274)..(357): Pfam Name: Evr1_Alr Pfam Description: Erv1 / Alr family
  misc_feature (3)..(133): Pfam Name: Thioredoxin Pfam Description: Thioredoxin
  misc_feature (257)..(358): SWISSPROT Homolog: EC 1.8.3.2 Thiol oxidase
  misc_feature (23)..(92): SWISSPROT Homolog: EC 5.3.4.1 Protein disulfide-isomerase
  misc_feature (128)..(128): Xaa is any aa, unknown, or other
MAATAAAAAARLLIVLAAFLHAAPESFAVVEFFAHWCPACRNYKPHYEKVAKLFNGPDAAHPGIIVMARVDCASKVTVDLCNKFSVDHYPFLVWGPPAKFDSPQWKPKQDNSELELIDDGRTAERLLXWINKKMGSSPSLDDKKYENESALPKNASDPEQIVRAIYDVEEATAHAWQIILEHKMIKPETRDSLIRFLQILVSHHPSKRCRRGSADLLINFDDHWHTNISLNSQESSTLLTSVAGDNICGKGVPRGYWMFCRGSKKETRGFSCGLWVLLHSLTVRIGDGESQSTFTSICDFIHNFFICEECRKHFYEMCSSVPVPFKSARDLTLWLWRAHNIVNERLMKEEKDLDTADP

SEQ ID NO: 37555 - DNA, 2076 bp, Panicum virgatum
  misc_feature: Ceres CLONE 1990462
  misc_feature: Encodes the peptide sequence at SEQ ID NO. 37556
tggcaccggctgcctctggagctcccctctcctccccggcagcctccgcgcctgagccgcctccctccgatgacctcgacgccggggagctttggaacgctggccaactccggacccgtggcgctctcgctcgcgaccagctccttcgccagctttcttggcggcccggcttccggcggagcagacagcagcgggctgtccaagttcaaggccatgccgctgccgtccctcccgctgtcgcacccgccggcgtcgccgtcgtcgttcctcaacgcgctctccggcttcctcgactcgccgatccttctgacgcccagcttgttcccgtcgccgacgacgggcgcgatcccgtcggagcccttcaactggatgggcacgggggagaacctgcggcctagcgtaaaggatgagcagcggcagtacaccgacttcacgttccagacggcggcggcgtccgtgccggagacgggggccggagccgcgcggcaggcggcgtcctttccacaatcgtcgtccatgctgatggcgccattgggtggacttggagattcctacaacggcgagctgcagcaacagcagccatggagctaccaggagcccgctgcgcaattcgaagcgccgccggcggcggcgacgcagcctgacatgctcgggaacggcggctacaccgccgtgcccgctgcggtaccgggcttccgcgagcagagcaaccggccgccgtcggacgacggctacaactggcgcaagtacgggcagaagaacatgaaggggagcgagaacccgcgcagctactacaagtgcagcttccccagctgccccaccaagaagaaggtggagcggtcgccggacgggcaggtcacggagatcgtgtacaagggcacgcacaaccatcccaagccgcagagcacgcgccggaactccagctcggccccggcgccggcggcatcgtcgtcgtacgggctgcagagcgccagcgacgcggcggcggagtactccttcggcgcgctgtccggcgcgccagtggcgacgcccgagaactcgtcggggtcgttcggggacgacgagatcaacggcgtgagctcgaggcttgccgggaacctcggcggcgaggagctcgatgacgatgaacccgactccaagaaatggaggaaagccggcggcgacggcgaggcggcctcggtggccggcaaccggacggtgcgcgagccgagggtcgtcgtgcagacgatgagcgacatcgacgtcctggacgacggctaccggtggcgcaagtacgggcagaaggtggtgaagggcaacccgacccctcggagctactacaagtgcacgacggcggggtgccccgtgcggaagcacgtggagcgcgcgtgccacgacacgcgcgccgtggtcaccacctacgagggcaagcacaaccacgacgtgccccccgcgcgcggcagcagcgcctcgctctaccgcgccgcgctggaggcgcagcaggccgcgggctaccaccaccacggcttcgtcgccggcggaggcggcggcagcagcagccacggcgcgttctgcggcggcctgctcgacggcggcgcgccgacgcaggccgcggagaccggattctccatgtccgggttcggcaacactgtgggcacggcgtactcttacccgagccactaccagcaacagcaacagcagcagagcgaggcgatgtactacgccgccccatcagccaaggacgagccacgagacgacatgtcatttttcgagcagccattgctgttctgatgacaggatgagccgcggccaaaaggccaaaccgatttggcaagacatgatcgtactcgtggttctttttgactcggcagattatgtgcacactatcatagtagtactagtagttggttgatttttgatttgtttggaggccccagctttgcaggcaccagcagaaggggtagcctcctgtaacatgtacaagaaacgtaggacacatcacacacatcggcgtaggaagcaaggtcatggcacatgattttcatcagcttggctgcaagttctttttaccaatgaaaaatgttgttgcaagttctc

SEQ ID NO: 37556 - protein, 566 aa, Panicum virgatum
  misc_feature: Ceres CLONE 1990462
  misc_feature (393)..(452): Pfam Name: WRKY Pfam Description: WRKY DNA -binding domain
  misc_feature (218)..(276): Pfam Name: WRKY Pfam Description: WRKY DNA -binding domain
  misc_feature: The sequence is a functional homolog of SEQ ID NO 1326 in the 11/479,226 US patent application
  misc_feature: The sequence is a functional homolog of SEQ ID NO 618 in the 10/412,699 US patent application
  misc_feature: The sequence is a functional homolog of SEQ ID NO 140 in the 10/225,068 US patent application
  misc_feature: The sequence is a functional homolog of SEQ ID NO 2444 in the 10/374,780 US patent application
  misc_feature: The sequence is a functional homolog of SEQ ID NO 592 in the 10/412,699 US patent application
  misc_feature: The sequence is a functional homolog of SEQ ID NO 734 in the 10/225,066 US patent application
  misc_feature: The sequence is a functional homolog of SEQ ID NO 223 in the 11/479,226 US patent application
  misc_feature: The sequence is a functional homolog of SEQ ID NO 84 in the 10/412,699 US patent application
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MTSTPGSFGTLANSGPVALSLATSSFASFLGGPASGGADSSGLSKFKAMPLPSLPLSHPPASPSSFLNALSGFLDSPILLTPSLFPSPTTGAIPSEPFNWMGTGENLRPSVKDEQRQYTDFTFQTAAASVPETGAGAARQAASFPQSSSMLMAPLGGLGDSYNGELQQQQPWSYQEPAAQFEAPPAAATQPDMLGNGGYTAVPAAVPGFREQSNRPPSDDGYNWRKYGQKNMKGSENPRSYYKCSFPSCPTKKKVERSPDGQVTEIVYKGTHNHPKPQSTRRNSSSAPAPAASSSYGLQSASDAAAEYSFGALSGAPVATPENSSGSFGDDEINGVSSRLAGNLGGEELDDDEPDSKKWRKAGGDGEAASVAGNRTVREPRVVVQTMSDIDVLDDGYRWRKYGQKVVKGNPTPRSYYKCTTAGCPVRKHVERACHDTRAVVTTYEGKHNHDVPPARGSSASLYRAALEAQQAAGYHHHGFVAGGGGGSSSHGAFCGGLLDGGAPTQAAETGFSMSGFGNTVGTAYSYPSHYQQQQQQQSEAMYYAAPSAKDEPRDDMSFFEQPLLF

SEQ ID NO: 37557 - DNA, 1309 bp, Panicum virgatum
  misc_feature: Ceres CLONE 1990469
  misc_feature: Encodes the peptide sequence at SEQ ID NO. 37558
gagcgcaacggaaagcaacccaagcctctccttttccgccattgccccccccccccccccattcccacacaggactcacgcgctcttcaatcgctcgccgcctcgcccccgtttcttcctcccccggccttccttcgatccagcccctccatatgtcgtcttcgcccgcccccaaagctccaacctttccccgttttacttggcgtctacggcctggtccgcccaggaaaacaacggagtttgttttcgttgcgttgttcgctgccgtgctgttggtggtgcggtttttgtccgttcctgggagttcagtgcgtccctcctccatttcttgagaacgcccctcggtggggtgggggtgggctgcgttgttcgcgttggggttccgcagcttggttgccgtccccgtccgtctcttgattcggaagcctcggctcttggtttgggaagcccctttcaaggcgaggaatttggtgtgggttgatggcatcctgcgaggattccgcgatgcaatgatgggtttcttgaagccgaggtgaatctttgaccagctggatttcccgaattttgagctgaagtcccttggtttctgatccgccggccgccatgggcctctgccacggcaagtcggtggcggtctaggagccagcggaggaggaggaggaagcccaagtagccgccggcgcggcgcccccggctgcgggtcgcgatgacggggttgcctcgccggcgaaggcgcctgcgacacccaagcagcccaagttctcattctacctgccgagcccgctcccgccctccagctacaagggctcaccggcccactccagcgtcacctccacgccggcgcgcaagcgcccgttgccgttcccgccgccgtcgcccgccaagcacatccgcgcgctcctggcgcgccggcatggctcgatcaagcccaatgaggcgtccatccccgagggcgccgagccggacctggggctggacaagaccttcggatactccaagcacttcacggccaagtacgagctcggccgggaggttgggcgcggccacttcggctacacctgcgccgccaaggccaagaagggcgagctcaagggagaggacgtcgccgtcaaggtcattccaaaggccaagatgactactactattgccattgaagatgtcagaagagaagtcagaatattgagttctttaacaggtcacagcaatctagtgcagttttatgatgcttttgaggatgaagaaaatgtatatgtcgttatggagttatgcaatggaggtgaactgctggacaggattttggctagaggtg

SEQ ID NO: 37558 - protein, 59 aa, Panicum virgatum
  misc_feature: Ceres CLONE 1990469
  misc_feature: SWISSPROT Homolog: EC 2.7.11.1 Non-specific serine/threonine protein kinase
  misc_feature: The sequence is a functional homolog of SEQ ID NO 2 in US patent 7084323
MTTTIAIEDVRREVRILSSLTGHSNLVQFYDAFEDEENVYVVMELCNGGELLDRILARG

SEQ ID NO: 37559 - DNA, 804 bp, Panicum virgatum
  misc_feature: Ceres CLONE 1990469-R
  misc_feature: Encodes the peptide sequence at SEQ ID NO. 37560
ctgcattgagggctcttgcaaagacactgacgatagatcagctcttctacctaagagggcagtttgcattgctaggtccgaacaagagtggccaaatctccttgcaaaatatgaagatggccttgatgaagaattcctcgggtgcaatgaatgattctagggtggttgactttgttaactcaatatgcaatatcccgtatggaaagtttgattttgaggagttctcggcttcggctattagcgtttatcaaatggagggcctggagacatgggaacaacatgctcagcaagcatatgaattatttgacaaggagggcaaccgaccaattatgatagaagaacttgcatcggaacttggacttggcccttcagttccacttcatgttgttctccaagattggatcaggcaggatggaaaactcagtctgctcggattcatgaagctattgcatggagtttctttgcgcacaatccctaaagtctaagacaccctgttgcatcaagccatcaaccaaggagaaaagtgacaactaagctaatctctggccagggcatgacatggctggttgtagaagttgcatgaaaccagtacaaaggttaacagatgattgtagtgtaaaggtctatactgtcgcccgcctctgacgacatttattgacattgtactcgagatgttcagaggtatagatttggtttggggaagaatggaaggaaaagatctgaggctgactttgtgggtgtatcaacaacgtttgtatctggtgctccctttgtctccgtaaatgggttgaggacattgccttc

SEQ ID NO: 37560 - protein, 160 aa, Panicum virgatum
  misc_feature: Ceres CLONE 1990469-R
  misc_feature: SWISSPROT Homolog: EC 2.7.11.1 Non-specific serine/threonine protein kinase
ALRALAKTLTIDQLFYLRGQFALLGPNKSGQISLQNMKMALMKNSSGAMNDSRVVDFVNSICNIPYGKFDFEEFSASAISVYQMEGLETWEQHAQQAYELFDKEGNRPIMIEELASELGLGPSVPLHVVLQDWIRQDGKLSLLGFMKLLHGVSLRTIPKV

SEQ ID NO: 37561 - DNA, 574 bp, Panicum virgatum
  misc_feature: Ceres CLONE 1990472
  misc_feature: Encodes the peptide sequence at SEQ ID NO. 37562
aacccacctccatttagctctctctctcacctctcgctctcttcctcttccccatccccaacccaaccaacaaatcgagctagccgagcaagaggaccagagcagcgcagcacagcaccacgcggaggcaggggcagcggcggcggcaattgcaatctagagggagcggaggccgggcgctcgtggggatgggcgcgccggcgcacggcgcccttctattctccctcctgctcctggcaggggcggcggcccaggacgcggcgctgcaggaacccacattgcccgccgcggccgccggcaccccgccgccggcgggcgtcggggtgaactccaactcggtgctggtggcgctgctggactcgcactacacggagctggcggagctggtggagaaggcgctgctgctgcagacgctggaggacgccgtcgggaggcacaacgtcaccatcttcgcgccccggaacgaggccctcgagcgggacctcgaccccgagtgcaagcgcttcctcctcgagccacgcaacctcaagtcgctccaggcgctgctgctctaccacgtcctccccgcccgcct

SEQ ID NO: 37562 - protein, 128 aa, Panicum virgatum
  misc_feature: Ceres CLONE 1990472
  misc_feature (59)..(128): Pfam Name: Fasciclin Pfam Description: Fasciclin domain
  misc_feature: Useful for making plants with altered carbohydrate content
MGAPAHGALLFSLLLLAGAAAQDAALQEPTLPAAAAGTPPPAGVGVNSNSVLVALLDSHYTELAELVEKALLLQTLEDAVGRHNVTIFAPRNEALERDLDPECKRFLLEPRNLKSLQALLLYHVLPAR

SEQ ID NO: 37563 - DNA, 102 bp, Panicum virgatum
  misc_feature: Ceres CLONE 1990472-R
cgacacaagaaaaagaggacgccccgccgagggcagggcccagaagcacccgccaacaccgcggaccacgccggcgggcgcgggcacagcacgggcgcccag

SEQ ID NO: 37564 - DNA, 1906 bp, Panicum virgatum
  misc_feature: Ceres CLONE 1990479
  misc_feature: Encodes the peptide sequence at SEQ ID NO. 37565
gcaatctgttttgacactttaacatggtccgaaagaagcgtcaaagtaagagggtcactttgaaggacaagtacaaagttcaaaaaaaggttagtgagcatcataagcaacaaagaaaagatgccaaaaagaatccatcccttcgaaaaaagcttactaaagatccgggagtgcccaacttgtggccacaaaaacaagagatgcttagaaagcttgttgattcaaagagggagggtattgtcgaaaaaaaagagaaagagcaatcaaagaagagaaaaagaggaacagaagaacaacttgaggcaatgttgaatagtgcacttcaacgtcaagaccagtttgaagaacaagaaaatttggaagttcatactctcggcaattttaatcaaaaggattcatccaaaaaagccttcttcaaagaatttaaaaaagttgtagcagcagcagatgtagttctagaagttcttgatgcaagagatccattaggatcaagatcaccaaccgttgaaaaacaaatcttgaaacttgacccaaacaaaaagatcatcttggttctcaacaaaatagatttgattccaaagaaaaatgtagaggaatggctcgcatatttgagaaatgactatccaacaatcgcatttaaagcatcaacccaacaacaaagaactaatctaggaagaggaaaagtaagtacaagatcagctagaagtaatcaacttggtatgaatgaatgcttgggagctgatacattgattgatcttctcaagaattacagtcgtagtctttcccttaaacaagctatctctgttggaattataggatttcctaatgtaggaaaatcatccatcattaatagtttaaaaagaagcagagcggtaactgtgggtgcaaaaccaggtatcacccgaaccactcaggaagttgttcttgataaggatataaagttaatagattgtccggggattatatttgcggatgatatgtcagaaggggatgctgctcttaggaattgtcttaatattgatcagcttactgattatacattacctgtatcggctatacttcaaagatgtacaaaggaacaactcgttacaatatataagattccattgtttgctgatgtaactgatttcttgagattagtagctgaaagaagaggaaagattggaaggggatctgtaccagattaccaagcagcagcaaagatggtagtacaagattggaatggaggaagaataccttattattgtattcctccggaagttgatccatctattcacgttggtgctcagattgtatcagactggagtgctgcttttaatcttgaagatgttatgcaaactgagaaagaaactgtaatgagcgaattaagggataatgatgctcaattcgtcttcactaaagcatcgacatcaaagtttgcggcaaccaatcaaatatttgatgatcttgatgatgaagaagaacaacctattgaaactgaagttccatatcgtaaggaatctgttcttactattgctcctataaaggagaaaacagaagaatctccaaacaaaaggagaaagattacacctcagaaagatcctcaaaatcctcaaactaattctgaacaaaagaaaaaacgagaaaaggtcaagaaacttgatagaaaagcagaaaatagagaaactgccatgcagactgaaactagcgctccagcaaatgagactttcgattttggcgttgacttttggaaaaatcatccttctgctgccactacaccaacaaagagcgatgcattgaatccttttcaatttgattagaagctatctgctccaaaaaactgttttttttttttggttttcaagtttatttggattccacctttggacaaagaaatattttttgaatacacttgtatcctctttgt

SEQ ID NO: 37565 - protein, 591 aa, Panicum virgatum
  misc_feature: Ceres CLONE 1990479
  misc_feature (259)..(361): Pfam Name: MMR_HSR1 Pfam Description: GTPase of unknown function
  misc_feature (14)..(93): Pfam Name: GN3L_Grn1 Pfam Description: GNL3L/Grn1 putative GTPase
MVRKKRQSKRVTLKDKYKVQKKVSEHHKQQRKDAKKNPSLRKKLTKDPGVPNLWPQKQEMLRKLVDSKREGIVEKKEKEQSKKRKRGTEEQLEAMLNSALQRQDQFEEQENLEVHTLGNFNQKDSSKKAFFKEFKKVVAAADVVLEVLDARDPLGSRSPTVEKQILKLDPNKKIILVLNKIDLIPKKNVEEWLAYLRNDYPTIAFKASTQQQRTNLGRGKVSTRSARSNQLGMNECLGADTLIDLLKNYSRSLSLKQAISVGIIGFPNVGKSSIINSLKRSRAVTVGAKPGITRTTQEVVLDKDIKLIDCPGIIFADDMSEGDAALRNCLNIDQLTDYTLPVSAILQRCTKEQLVTIYKIPLFADVTDFLRLVAERRGKIGRGSVPDYQAAAKMVVQDWNGGRIPYYCIPPEVDPSIHVGAQIVSDWSAAFNLEDVMQTEKETVMSELRDNDAQFVFTKASTSKFAATNQIFDDLDDEEEQPIETEVPYRKESVLTIAPIKEKTEESPNKRRKITPQKDPQNPQTNSEQKKKREKVKKLDRKAENRETAMQTETSAPANETFDFGVDFWKNHPSAATTPTKSDALNPFQFD

SEQ ID NO: 37566 - DNA, 1333 bp, Panicum virgatum
  misc_feature: Ceres CLONE 1990486
  misc_feature: Encodes the peptide sequence at SEQ ID NO. 37567
aattggcaatgccatgccatggcgcctccccctccttccccggttcctccacttctgtaaaccctaatcaatctagagccctccaaattgatggctcctcgtctcagaatctgaatcaaatcgaacgagcagaacgaaaaacgaagcagccgctcccgaatccggcagcgatggatcgttcccgctccaagcgcggctaccactacgaccaggactcgccgccgccccgctccaagcagcgcttcgaccgccgcagcggtggcggcggccagaacccaaactctggttaccaccgccgcgggccacccggaggcggcggctcctccgaccgccgcggcttccttccccctgatgccgcgccgcccccgcccccgcccccgcctcccccaccgtcggccgctgcgggggcgccgggcgccgcgtccaccatcacctccttccgcatcctgtgccccgaatgcaaggcctacggcttatcgcccggcttcgtcgccaaggtccgcgacgacagcggcgcgctcgtcaccgtgcatccgcccttcgctggcgactacgtccgggtcatcgagacggtcgacggcgcgcggcgcgaggctgacggccgcccgcccatgtactctccggcgcaggaggcgctcctcatggtgcaccgccggatcctcgagacggaagccgaggatggcgacgaggatggcgagtacgggcccagggggaaggacccgcgggacagggggaagaccaccacgcgcctcatcgtgcccaaacttcacgttggatgcctgctcggcaagggcggtaagatcatcgagcagatgaggatggagaccaagacgcacatcaggattctgccgcgcgaccagcatacgccgcgctgtgtgtccttgtccgaggaggttgtacaggttgttggagatggaaattgtgttaggaaggctgtagcaataatcactgatcgcctaaaggaaagcttacaccgcgatcgtggtcctttccgagggcgaatgaattcaccagagcctcgaatttctcaggaagatgaatacctgggtggtgttcagcagatgcctttatatgaagaaacttacggacgacctgatcagattaggaacaatattggcatggagccaccagggtatgagtttgattcaaatggtggcaaggtcattgaacacccagatattctgtatgatgctatcgtatttcgaattctttgcccaaatgacaaggctagcagtttagtttcgacacgtgatggaataatagagatgctacaggcagatgttggtgttgatgttaggcttactgatattattgctggttctgatgaaagggt

SEQ ID NO: 37567 - protein, 387 aa, Panicum virgatum
  misc_feature: Ceres CLONE 1990486
  misc_feature (191)..(259): Pfam Name: KH_1 Pfam Description: KH domain
MDRSRSKRGYHYDQDSPPPRSKQRFDRRSGGGGQNPNSGYHRRGPPGGGGSSDRRGFLPPDAAPPPPPPPPPPPSAAAGAPGAASTITSFRILCPECKAYGLSPGFVAKVRDDSGALVTVHPPFAGDYVRVIETVDGARREADGRPPMYSPAQEALLMVHRRILETEAEDGDEDGEYGPRGKDPRDRGKTTTRLIVPKLHVGCLLGKGGKIIEQMRMETKTHIRILPRDQHTPRCVSLSEEVVQVVGDGNCVRKAVAIITDRLKESLHRDRGPFRGRMNSPEPRISQEDEYLGGVQQMPLYEETYGRPDQIRNNIGMEPPGYEFDSNGGKVIEHPDILYDAIVFRILCPNDKASSLVSTRDGIIEMLQADVGVDVRLTDIIAGSDER

SEQ ID NO: 37568 - DNA, 805 bp, Panicum virgatum
  misc_feature: Ceres CLONE 1990486-R
  misc_feature: Encodes the peptide sequence at SEQ ID NO. 37569
ttatgcatataactacaaaactaaggagttatctataccgtgagatgtctggtcctattcaagttggtaacattaatgtacatggagccatttctccagcaactggctcacctcgaggaccataccagggaaatgatattccaatgggtccttaccaccaagcaccacaactgacagcttcatggcactcaaaggatagtggaggcagtgcaagtggatcatttgagcaaggtagcaacattaatgatgatatcaggcaaaatgcttcaaaaagatttgctgttcctctagtgactagaagcacgttagaagttgtcataccaaacagtgctgttgcaagcctcaccatgagggctggtagcaagcttgcccaaataagcgagatgtctggtgctactgtaactctcgctgatgatagacctggcatcttggagaaagttgtacaaatatctggtacccctgagcagactgaaaaagctaaaagtttgctgcagggatttattcttagcatccaagatgacagttgaagacgtgactacactctactgcatgtcataggtgttttctcgttgaatctcccgttgatttttttttctggtacaatacatctcagtccatgtggtttatttgtaatagttgtctaattgagcgtcatgcttttcgtgtgtaaagtgttaagatatgttcacattctttttttcatagttgtaatgctaagtagccaaaatatgtctgtttctagtttaccctaactggtgtaacatagtataaatcttattgattgatttaatttccaaattcatac

SEQ ID NO: 37569 - protein, 174 aa, Panicum virgatum
  misc_feature: Ceres CLONE 1990486-R
  misc_feature (101)..(163): Pfam Name: KH_1 Pfam Description: KH domain
MHITTKLRSYLYREMSGPIQVGNINVHGAISPATGSPRGPYQGNDIPMGPYHQAPQLTASWHSKDSGGSASGSFEQGSNINDDIRQNASKRFAVPLVTRSTLEVVIPNSAVASLTMRAGSKLAQISEMSGATVTLADDRPGILEKVVQISGTPEQTEKAKSLLQGFILSIQDDS

SEQ ID NO: 37570 - DNA, 1706 bp, Panicum virgatum
  misc_feature: Ceres CLONE 1990490
  misc_feature: Encodes the peptide sequence at SEQ ID NO. 37571
gcttggcttggcttgcgcacatcaaactcaaccgcccgcgcgttgccttccctgctctgcttccttcctgattctcgcagcaggcggcagccagccatggcggcgacgactcgcctccgctgcctcctcttccccttcctcgtgcagctcctcctgctgctctcggcggccgccggtacccggtggcaggacttcctccgcctgccgtcggagggcgatggcgccgccgggaccaggtgggcgatcctcatcgccggctccaacgggtactacaactaccgccaccaggcggacgtgtgccacgcgtaccagatcatgaagaagggcgggctcaaggacgagaacatcgtcgtcttcatgtacgacgacatcgccggcagccccgacaaccccaggccgggcgtcatcatcaaccacccggccggcggcgacgtctacgccggggtgcccaaggactacacgggcgaggacgtcaccgtcggcaatttcctcgccgcgctgatcgggaacaggtccgccgtcacgggcggcagcggcaaggtcgtcaccagcggacccgacgaccacgtcttcgtcttctacagcgaccacggcgggcccggggtcctgggcatgccctccgacgactacctctacgccaaggacctggtgcgcgcgctcaagcagaagcgcgccgccggcgggttcaagagcctggtcttctacctggaggcgtgcgagtccgggagcatcttcgagggcctcctgcccaaggacatcggcgtctacgccaccacggcggccaacgccgaggagagcagctggggcacctactgccccggcgacaaccccggcccgccccccgagttcgacacctgcctgggcgacctctacagcgtcgcctggatggaggacagcgatgtgcacaacctgcgaaccgagtccctgaagcagcagtacgaggtggtgaaggaccggacgtcggcgcacggcacctacagcctgggctcccacgtcatgcagtacggcgaccagcgcctcggcgcccagagcctggcccagttcatcggcaccaaccccgccaacgacaacgccacgttcggccgggacaactcgctgcgccgcttctccggcgccgtcaaccagcgcgacgccgacctcatctacttctggcagaagtacaagaaatcggcggaggggacgccggagaaggcggaggcccggaagcggctgctggaggtgatgtcccggcggtcccgcgtggacagcagcatggagctcatcggcgccctcctgttcggctccgaggaaggctccagggtgctcggcgccgtccggccggcggggcagccgctggccgacgactgggactgcctcaaggccatggtgcgcgcgtacgaggcgcactgcggcccgctggcgcagtacgggatgaagcacatgcgctctttcgccaacatctgcaacgccggcgtcggggaggaggccgtggccaaggtggcgtcgcaggcctgcgccgtcgcccgttgaccaccacgtatatatgtgttgcattgcagacatctcgatccgcatgtgctgcaacaagatgtggatatacggatgtcgtttgcccatttcaattatgtgcagtcactgtaaataattcattcacaatgaacgaaaggtgttcagtgattctcagcttcaattttagtttcctttcctttctcagaaaagagagcagc

SEQ ID NO: 37571 - protein, 470 aa, Panicum virgatum
  misc_feature: Ceres CLONE 1990490
  misc_feature (47)..(319): Pfam Name: Peptidase_C13 Pfam Description: Peptidase C13 family
  misc_feature: SWISSPROT Homolog: EC 3.4.22.34 Legumain
MAATTRLRCLLFPFLVQLLLLLSAAAGTRWQDFLRLPSEGDGAAGTRWAILIAGSNGYYNYRHQADVCHAYQIMKKGGLKDENIVVFMYDDIAGSPDNPRPGVIINHPAGGDVYAGVPKDYTGEDVTVGNFLAALIGNRSAVTGGSGKVVTSGPDDHVFVFYSDHGGPGVLGMPSDDYLYAKDLVRALKQKRAAGGFKSLVFYLEACESGSIFEGLLPKDIGVYATTAANAEESSWGTYCPGDNPGPPPEFDTCLGDLYSVAWMEDSDVHNLRTESLKQQYEVVKDRTSAHGTYSLGSHVMQYGDQRLGAQSLAQFIGTNPANDNATFGRDNSLRRFSGAVNQRDADLIYFWQKYKKSAEGTPEKAEARKRLLEVMSRRSRVDSSMELIGALLFGSEEGSRVLGAVRPAGQPLADDWDCLKAMVRAYEAHCGPLAQYGMKHMRSFANICNAGVGEEAVAKVASQACAVAR

SEQ ID NO: 37572 - DNA, 1939 bp, Panicum virgatum
  misc_feature: Ceres CLONE 1990491
  misc_feature: Encodes the peptide sequence at SEQ ID NO. 37573
ggtgagggtgagggcgtacgccacctgagctgactcgtcgtcaagccctgtctctctctcttcctcacttccctcacggggggcaggcagccacgtacaaagggcgctcgccaacgcccagcgccccctcgccgcaccacccgccaccccacgccgtgcgcctttaaagtgagcccgcgccatcttaaagaggtcagagagagagagggccagcggcggcgtcgcgcgcgcgcggaatcagaggaggagcggcgcggcaatggcggtgaccgcgcggcggctccgcgccgtcgtggcgtgcgtcgtcctggcggcggtggcggcggcgccgcggtcggcggcgggcatcctcgacccgaacgacttcctggcgctgcaggcggtgcggcggtcgctggacgacatgccggggtcggcgttcttcgacggctgggacttcaccgccgacccctgcgggttccccggcgtgttctgcgacggggaccgggtggcgtcgctcgcgctcggggacccccgggccgggtcgccggggctgacggggcggctcgacccggcactgggcaggctgtccgcgctcaccgagctctcgctcgtgcccggccgcgtcgagggccagctcccgccgtcgcttgcgtcctgctccaacctccgcttcctggccgtcagcaagaacatcctgtccggcccgataccggacggcttcggcgcgctgtccaacctccggacgctcgacgtcagcttcaaccagatctccggcgccatcccgccgtccatcgccgcgctgccgtcgatcaccaacctcatcctctgccacaaccagctcaccggcgtcgtgccgtcgttccaggactcgtccccgctgctccggctggacctcaagcacaacgcgctcaccggcggcgtgcccaccctcccggccgggctgcagtacctctcgctgtccgcgaacaagctgagcggcacggtcgaccaggtgctgccccggctggcccggctcaacttcctcgacctcagcatgaaccagctggaaggcccgatcccgccggcggtgttcgcattgcccctctccgtgctgcagctgcagcgcaacttcttcgcggggcccgtgcagccgtcgagcgacgtgacgatcccggtggtggacctgagctacaaccggttctggggccagctgtcgccgctgctggccggcgtcgggcagctgtacctgaacaacaaccggttcaccggcgaggtcccgtcgcggctggtgcaggagctggtgggctccggcgggctgcaggtgctgtacctgcagcacaacttcctgacgggcatcgagatatcgccgtcgtcgtcgctcccctccaccgtctcgctctgcctcatgtacaactgcatggtgccgccggtgtacgcgccgtgcccgatcaaggccgggtcgcagaacacgcggccggcagaccagtgcccggagtggaggggctgagcaccgagctagctccaggctgatcgtgcctcagcaacgccaatgccaatgccggatcgcctcggatcatcggtcggaaatcgaagaactgatgaagaacagactgaacagtggagattgcaaagcgccgtgtggtctctgattctttgattgatttgtccagttgttacttgtgttcttgattctttttttttttctggtttgggaggatagttacagacaagtaagtgcctcaataatcgggtgttacaggtgtagtaagtttttgcttaggtgtactccgatgtgcattgtgtctcccccctctgcttgtatagtgagctagctactgtcacactggctcctgatgctgctggatcagacgagaagatggatggtgctgagagccggtgacgctatttatctcatcatgtcgctgaacaaatcaatgggaacaagcatgcactgtgcttggtttttgttcgcctcgcc

SEQ ID NO: 37573 - protein, 402 aa, Panicum virgatum
  misc_feature: Ceres CLONE 1990491
  misc_feature (32)..(73): Pfam Name: LRRNT_2 Pfam Description: Leucine rich repeat N-terminal domain
  misc_feature: SWISSPROT Homolog: EC 2.7.11.1 Non-specific serine/threonine protein kinase
MAVTARRLRAVVACVVLAAVAAAPRSAAGILDPNDFLALQAVRRSLDDMPGSAFFDGWDFTADPCGFPGVFCDGDRVASLALGDPRAGSPGLTGRLDPALGRLSALTELSLVPGRVEGQLPPSLASCSNLRFLAVSKNILSGPIPDGFGALSNLRTLDVSFNQISGAIPPSIAALPSITNLILCHNQLTGVVPSFQDSSPLLRLDLKHNALTGGVPTLPAGLQYLSLSANKLSGTVDQVLPRLARLNFLDLSMNQLEGPIPPAVFALPLSVLQLQRNFFAGPVQPSSDVTIPVVDLSYNRFWGQLSPLLAGVGQLYLNNNRFTGEVPSRLVQELVGSGGLQVLYLQHNFLTGIEISPSSSLPSTVSLCLMYNCMVPPVYAPCPIKAGSQNTRPADQCPEWRG

SEQ ID NO: 37574 - DNA, 374 bp, Panicum virgatum
  misc_feature: Ceres CLONE 1990495
  misc_feature: Encodes the peptide sequence at SEQ ID NO. 37575
acgagcgacagccagtcaccacctacccgaagccgccgcgaccgatcgagccgagcgccccgcccccacgccgcgccgcgccgcgccgccaccgaaaccctagctcctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcaactgcagcaacatcggcgtcgcgcagatcgtcgccgcggcgtggtcggactgccccgccggccgcccccactccggcggcggcggaggcggcggccgcggcgcggacgccgccgacccagcc

SEQ ID NO: 37575 - protein, 82 aa, Panicum virgatum
  misc_feature: Ceres CLONE 1990495
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGGGGGGGRGADAADP

SEQ ID NO: 37576 - DNA, 107 bp, Panicum virgatum
  misc_feature: Ceres CLONE 1990497
  misc_feature: Encodes the peptide sequence at SEQ ID NO. 37577
gagaggagctgctccggtcactgctccatgctgatctgattgggttccacacctttcactatgccaaacgcatcctgagctgtcgcatctgggcgctcaggctcccg

SEQ ID NO: 37577 - protein, 34 aa, Panicum virgatum
  misc_feature: Ceres CLONE 1990497
  misc_feature: SWISSPROT Homolog: EC 2.4.1.15 Alpha,alpha-trehalose-phosphate synthase (UDP-forming)
  misc_feature: Useful for making plants with altered carbohydrate content
EELLRSLLHADLIGFHTFHYAKRILSCRIWALRL

SEQ ID NO: 37578 - DNA, 1932 bp, Panicum virgatum
  misc_feature: Ceres CLONE 1990505
  misc_feature: Encodes the peptide sequence at SEQ ID NO. 37579
acggttgactgtataatcagcatcgcgtcttccgcgtccggtccggcgcgtcgctccccccaacgccctccccgccgcggcccgcccaccacctccccaccaccactgccaccgaacgtccgaacccgcgcccagaccccgatgccgcaccactgtaaccgcccagctcggatccttaccgtcgccgctccttcttcccgagactcgctctcaatcccggcgcccagctcggattcgcgcccccaatcccggcacgcagtcgccgctccctcatccagagagaccccaatcccggcgcccagctcggatcctgacggcgccgcagcaacctgccatcggcgctccttcatcccccagatgcatccccaaccccggcgccgcaccacccccatcccggcgcgtctcggcctcccgtcggcgaccctcgcgccgtcccggcgaagtgctgaacggccggttgccgtcagcccccctcccccggcgagctgcagcatccgtccagcgcaattgatctaagggcgagatacttatagttcattctttctattactggattcattctgtctattacgcatcgtaggttcccgccggcgaggaggacctgccggcgcatgtgccagtgagatggagcagccggcacaggtgcagacttatgaactggaggtcatcctgatgccaatttgagtaaaccatgtgtcaatctcgccgtggtcgatctagtttagctgttcttattgggactacccagcaatgtgaaggaaggaggtaccgcatcgggatttaaccatcttcgtcgtcgatgatccccccccccccctcattgtcttctttaatcaattgttttttgtgtttttgggatcgccaagcactggcaagaatcttgctaacacagccagatcattcagacaacccaatgcaaagcactattcatagcaaaccattgtaagtctgcgccgctgtccggccttcctcagtgccaagcagctctcctattatctgtactacccatggttttctacacattcgtcctcaccgatggagtctcctgaatcgctgcccttacatactgaactcttcagtgagttccatcacgggactgctcaactagaagatctggtttttgatggatataagaagtagcacggggagaggtagctggatctggttttctctggccgctagaagccagacctgaatcatgtcatcatcctctccctccaaaatgcctagccatccctcttcagtctacatcgctatcgctcgcatccatccttctgcctgtcatgttgaaagatactaacaatacaaattctcccacagcactgaagaatcagggcacaagggaatacgagccatagggtcaaggatctacagaatacagggtcctctttatcaggcagatatgaatgggtgcaatctgtatgatagagcactctaaggaacttcagaatcttgttaatgacgctattgacaaaggtgccgaaattgctgtcagggagttttggcaatcttggtgaagatgcagttgatcaatttttccctccaactatcccggtgaatgttaatcacacaatgaaaattatgcaagaagaggcatttggaccaattctaccaatcataaaattcagttctgacgaagaggctattaaactggcaaaggattcaaaatttggtctttgtggatgactctgtcctgttggtgtttgcagcttgtgcttgggaacgtagctttgagaaccttttctggtttacacctgttgcctgggcattgaaatgaaattgaaattctactaactatggttgtgcaaggatgtgtcatgtgctgctcttggacaccatcggtgttgagtgtctgtgtgcggttgataaatctcagcagcttcatcggcatgtacaaagtgtggggaagaaaagaccttgtacttttgctcc

SEQ ID NO: 37579 - protein, 75 aa, Panicum virgatum
  misc_feature: Ceres CLONE 1990505
  misc_feature: SWISSPROT Homolog: EC 1.2.1.3 Aldehyde dehydrogenase (NAD(+))
MTLLTKVPKLLSGSFGNLGEDAVDQFFPPTIPVNVNHTMKIMQEEAFGPILPIIKFSSDEEAIKLAKDSKFGLCG

SEQ ID NO: 37580 - DNA, 1353 bp, Panicum virgatum
  misc_feature: Ceres CLONE 1990512
  misc_feature: Encodes the peptide sequence at SEQ ID NO. 37581
gtccaaagcagctgacctagctagctagctagctcatcgatccatctttgttggcacctcgatctccgctgctagctagacgccgccaatcagcagcgacatggcggcacgcgagctcgtggccatggcggcgcgcttcgtgcgggagtacgtgcgggcgtcggacctggccgtggcggcggcggcgctgttcgcctggagcgcggtccggagccggctggccaccaagcccggcgcgccgatgctgtggccggtgttcggcatcatccccgcgctcttcgcccacttcgacgacctctacgactggggcgcggcggcgctggcccgggcggggggcacgttcccgtaccgcgggatgtggggcggcggctccaagggcgtcatcacctccgtccccgccaacgtcgagcacgtcctcaagaccaacttcgccaactaccccaaggggccctactaccgggagcgctttgcggagctgctcggcgacggcatcttcaacgccgacggcgactcgtggcgctcgcagcgccgggccgcctccgccgagatgcactcggcgcggttcatccagttctcggcggccaccatcgccggcctggtgcgcggcaagctggtgccgctgctggaggcgctcgccgagcgcggggccgccgtggacctgcaggacgtgctgctccgcttcaccttcgacaacatctgcgccgccgcgttcggggtggacgccgggtgcctcgccgagggcctccccgacgtgccgttcgcgcgcgcgttcgagcgcgccacggagctctcgctggcgcgcttcgtcaccccgcccttcgtgtggaaggccaagcgcctcctcggggtcggcagcgagcgcgcgctcgtcgaggccacccgcgccgtgcgggcgttcgcggagcggaccgtcgccgagcgccgcgccgagctccgcaagacggggaccctggccggccgctgcgacctcctctcgcggctcatgtcgtcgccgccgccccccgactgccccgggggctactccgacgagttcctgcgggacttctgcatcagcttcatcctcgccggccgcgacacgagctccgtggcgctggcctggttcttctggctcctcgcgtcccacccggacgtggagtcccgcgtcctcgccgacatcgcccgcgccggcggcggcgacgccacggacagcagcagcatggactacctccacgcggccctgacggagtccatgcggctgtacccgcccgtgcccgccgacttcaaggaggccctggaggacgacgtgctccccgacggcacggcggtgcgcgcggggcagcgggtgatctactacacgtacgccatgggtcggga

SEQ ID NO: 37581 - protein, 417 aa, Panicum virgatum
  misc_feature: Ceres CLONE 1990512
  misc_feature (44)..(417): Pfam Name: p450 Pfam Description: Cytochrome P450
  misc_feature: SWISSPROT Homolog: EC 1.14.13.98 Cholesterol 24-hydroxylase
MAARELVAMAARFVREYVRASDLAVAAAALFAWSAVRSRLATKPGAPMLWPVFGIIPALFAHFDDLYDWGAAALARAGGTFPYRGMWGGGSKGVITSVPANVEHVLKTNFANYPKGPYYRERFAELLGDGIFNADGDSWRSQRRAASAEMHSARFIQFSAATIAGLVRGKLVPLLEALAERGAAVDLQDVLLRFTFDNICAAAFGVDAGCLAEGLPDVPFARAFERATELSLARFVTPPFVWKAKRLLGVGSERALVEATRAVRAFAERTVAERRAELRKTGTLAGRCDLLSRLMSSPPPPDCPGGYSDEFLRDFCISFILAGRDTSSVALAWFFWLLASHPDVESRVLADIARAGGGDATDSSSMDYLHAALTESMRLYPPVPADFKEALEDDVLPDGTAVRAGQRVIYYTYAMGR

SEQ ID NO: 37582 - DNA, 271 bp, Panicum virgatum
  misc_feature: Ceres CLONE 1990512-R
tatatatatatatatatatatatatatatatatatatatatatatatatatatatatatatatatatatatatatatatatatatatatacgtggtgtatgtatgtacgtgtttctcgctgcgtgtaagttgtgtcgtgtggacgcagttccgatgagaatcacagaactgcgttcccaatgaacagatgcgtgtgtgtgataagttcttttattttttttatataaactgtgtataataattaagtcgagagaaccgactgttccaccgc

SEQ ID NO: 37583 - DNA, 675 bp, Panicum virgatum
  misc_feature: Ceres CLONE 1990515
  misc_feature: Encodes the peptide sequence at SEQ ID NO. 37584
aagcacaacaactgctgcggccaagtctgcaagaaagcaaaagagagagatggccatggccagaagcagcctaccgccgccggcggtgctcatcaccttcgccttcttgttctgctgctacgcctcccaagcctcgtcgtccgacggcttcctccaatgcctctcggcgagcatccccagccagctcgtgttcacgccgagctcgccgtcgttcacgccgctgctcaagtcctccatccggaaccccaagttcttcacgcccgccacggtgcgcccgctctacatcgtcacgcccacgaacgcctcccacgtgcaggccgccgtggcctgcggccgccggagcggggtgcgcctccgcgtgcgcagcggcggccacgactacgagggcctctcgtaccgggccgtgcgcaatgagacgttcgcggtgctcgacctgtccggcctccgcgccgtgcgcgtcgacccgcaggcgtccaccgcgtgggtggactccggcgcgacgctcggcgagctctactacgctgtcggcaaggcgagcgggcggctggggttcccggcgggcctgtgcccgaccgtcggcgtggggggccacttcagcggcggcggcttcggcatgctgctgcgcaagtacggcatggccatcgacaacgtcctcgacgccgtgctggtggacgc

SEQ ID NO: 37584 - protein, 208 aa, Panicum virgatum
  misc_feature: Ceres CLONE 1990515
  misc_feature (76)..(208): Pfam Name: FAD_binding_4 Pfam Description: FAD binding domain
  misc_feature: SWISSPROT Homolog: EC 1.21.3.3 Reticuline oxidase
MAMARSSLPPPAVLITFAFLFCCYASQASSSDGFLQCLSASIPSQLVFTPSSPSFTPLLKSSIRNPKFFTPATVRPLYIVTPTNASHVQAAVACGRRSGVRLRVRSGGHDYEGLSYRAVRNETFAVLDLSGLRAVRVDPQASTAWVDSGATLGELYYAVGKASGRLGFPAGLCPTVGVGGHFSGGGFGMLLRKYGMAIDNVLDAVLVD

SEQ ID NO: 37585 - DNA, 1322 bp, Panicum virgatum
  misc_feature: Ceres CLONE 1990523
  misc_feature: Encodes the peptide sequence at SEQ ID NO. 37586
gcctcacatgcgcgaggcggcgagctattcgtcgtcatagcagtaaaaaaggcacgcggaaaagcgcaggcagcgccgcgcccgcacgccaccagcgatcgactgatcgaccgccggcggcacgcgagatgatgaaggacgccaagtggccgcacgcggcggcgggcgccggcgggaggcgcgccgcgggggcgccgtacgtgctcctcgcctcctccccgcccgccagcgtcggctgctcgccgcactaccctcccgccccggcgtccgacgacggcgggggccccgcttcgttcgacgcggccgtcgcctcggccaggccgccgttccagcagcagcagcagccggcgcagagggacaacgcgccccagctcggcgtcgcgaactggatgctgctgcagcagcagtccagcgggagcagcgtcggtggcgacgacggcgaggggtcgtccacggcctccaccctcgccaacgccgcaccggagtcctacagggacaggggcgacgcggaccggccgccgagcagcagcggcggcaagagctgggcgcagcaggcggaagaggcctaccacctccagctcgccctcgcgctccgcctctgctccgaggcctcctacgccgcggacccgaacttcctcgactcctcatccaacgccgccgccgaccacctccagcacattgcgtcgccccaatcactctcccaccgcttctgggtcaatgggagcttgtcctactccgacaaggtcccggacggcttctacctcatccaggggatggatcccttcgtatggacgctctgcaacgacgtgcacgacggtggccgcgtcccctccatcgagtccctcaaggctgtcaatcccaccgagtctgccattgaggcagtcatcgtagacaaagtggctgactatgagctgaggcagctgataagcatggcgattgatgtttctcggaaccgtgccgactccaaggagatcgccactcgactcgctggcatcgtgtccgcaaagatggggggatcagtagcagctactgaggaacacgagttgggtccccggtggagagagactgctgggttcctgaagattagctcagggtctgttgtccttccaatcggaaagctatcaattggcttttgctgccaccgcacgttactgttcaagaccctggcggactccatcaatctcccttgtcgcattgtgaagggatgcaagtactgcaaagctggtgctgccacttcttgcttggtgcgctttggtcatgacagggaatatctaattgatttgatagggaacccaggattcttatctgaacctgactccctc

SEQ ID NO: 37586 - protein, 397 aa, Panicum virgatum
  misc_feature: Ceres CLONE 1990523
  misc_feature: SWISSPROT Homolog: EC 2.7.11.1 Non-specific serine/threonine protein kinase
MMKDAKWPHAAAGAGGRRAAGAPYVLLASSPPASVGCSPHYPPAPASDDGGGPASFDAAVASARPPFQQQQQPAQRDNAPQLGVANWMLLQQQSSGSSVGGDDGEGSSTASTLANAAPESYRDRGDADRPPSSSGGKSWAQQAEEAYHLQLALALRLCSEASYAADPNFLDSSSNAAADHLQHIASPQSLSHRFWVNGSLSYSDKVPDGFYLIQGMDPFVWTLCNDVHDGGRVPSIESLKAVNPTESAIEAVIVDKVADYELRQLISMAIDVSRNRADSKEIATRLAGIVSAKMGGSVAATEEHELGPRWRETAGFLKISSGSVVLPIGKLSIGFCCHRTLLFKTLADSINLPCRIVKGCKYCKAGAATSCLVRFGHDREYLIDLIGNPGFLSEPDS

SEQ ID NO: 37587 - DNA, 735 bp, Panicum virgatum
  misc_feature: Ceres CLONE 1990523-R
  misc_feature: Encodes the peptide sequence at SEQ ID NO. 37588
tatcaagaggtagcctgtacaggcttttacacaggcatagtgcaagggaaaatctggatgagcgacggcgcttgagtatggcttttgacgtggcgaaagggatgaattatcttcataagcgcaatcctccaatagtccatcgggaccttaagtcaccaaaccttctggttgacaaaaagtacactgtgaaagtctgtgactttggtctctcccgattgaaggcgaacacctttttgtcttctaagactgcagcagggacgcctgagtggatggcaccagaagtcctacgtgatgagccatcaaatgagaagtctgatgtttacagctttggtgttatcctatgggagctcatgacattgcaacagccttggagcaatttaaatccagctcaggtggtagcagctgttggtttcaagggacgaaggcttgagattccaagtagcatggatccaaaagtagcagctttaattgagtcctgttgggtcagagaaccctggagacggccctcttttgccagtatcatggaatccctgaaaccactcatcaaaacactaccacccaatcaactcctggacgaaaattagcagtccaggaaacacaagcttctgacatcttaggcagcaaaagatcatacagattgctgcactggttatattcgtcaagaacgcggggtttggggacaatatgtataatcattatacattgtagtgtatatagaaaagcaaacaaactctg

SEQ ID NO: 37588 - protein, 193 aa, Panicum virgatum
  misc_feature: Ceres CLONE 1990523-R
  misc_feature (1)..(177): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: The sequence is a functional homolog of SEQ ID NO 48 in US patent 7317140
SRGSLYRLLHRHSARENLDERRRLSMAFDVAKGMNYLHKRNPPIVHRDLKSPNLLVDKKYTVKVCDFGLSRLKANTFLSSKTAAGTPEWMAPEVLRDEPSNEKSDVYSFGVILWELMTLQQPWSNLNPAQVVAAVGFKGRRLEIPSSMDPKVAALIESCWVREPWRRPSFASIMESLKPLIKTLPPNQLLDEN

SEQ ID NO: 37589 - DNA, 1320 bp, Panicum virgatum
  misc_feature: Ceres CLONE 1990542
  misc_feature: Encodes the peptide sequence at SEQ ID NO. 37590
gtttcgtttgggccgtgtgtgtttccgtcctcctgttctgacttctctgtttctctcgatcccctcccccatcctgccagcctccccgccggccaccgctctccgccgccgccgccgccgccgccctcggcctccagctagttaggcgatatccgtcctcctaccaggttcagttcctctggcgaaacaagccgtgcagacgggagcaagagcgaggagacgagaggagggatgcagcagctgcagccgaagcagatgcactgggtgagggccgactcctccgacttcgggggcgaccgccccgccccccgcagcgggcacacggcggtgagcattggcaagtccaaggtggtcttcttcggcggattcgccgacaagcgcttcctctctgacgtctccgtctacgacgtcgagaataagctatggtactcgcctgagtgtaccgttaatggatcggatgggcaggcaggcccgagcccaagggcgtttcacgtagctgtcgtgattgactgcaacatgttcatatttggtggccgttctgggggcaagcggttaggtgatttttggatgctagacaccgacctatggcagtggtcggagatgactggctttggtgatttgccgtcacctcgggagtttgctgctgcttcagccataggaaatagaaaaattgttatgtatggtggttgggatggcaaaaaatggctttcagatgtatacatcatggacacaatgtcactggagtggacagaattagcagttactggatccgtgccgcctccaagatgtgggcattctgcaactatgattgagaagagactgcttatatttggaggcagaggtggagcagggccgataatgggtgatttatgggctttaaagggaattacggaagaagacaatgagacaccaggttggacacaattgaagcttccagggcaatctccctcaccacgatgcggccattcaataacgtccggtggaccttatctcttgctatttggaggacatggaactggtggttggctaagtagatatgacgtgtactacaatgaatgcatcattttagacagggtctctgtccagtggaagcgcctaccaacaagcaatgaaccacctcctcctcgggcatatcactccatgacttcaatagggtctcaatttcttttatttggcggctttgatggaaagaatacatttggcgatttgtggtggcttgtccctgaagatgatcctattgccaaacgagattcagctcctaatatcgattcaaacagcaaacctagcactatgactggtgatgcccagcaatccaactaa

SEQ ID NO: 37590 - protein, 362 aa, Panicum virgatum
  misc_feature: Ceres CLONE 1990542
  misc_feature (83)..(128): Pfam Name: Kelch_2 Pfam Description: Kelch motif
  misc_feature (134)..(179): Pfam Name: Kelch_2 Pfam Description: Kelch motif
  misc_feature (241)..(293): Pfam Name: Kelch_1 Pfam Description: Kelch motif
  misc_feature: SWISSPROT Homolog: EC 3.1.3.16 Phosphoprotein phosphatase
MQQLQPKQMHWVRADSSDFGGDRPAPRSGHTAVSIGKSKVVFFGGFADKRFLSDVSVYDVENKLWYSPECTVNGSDGQAGPSPRAFHVAVVIDCNMFIFGGRSGGKRLGDFWMLDTDLWQWSEMTGFGDLPSPREFAAASAIGNRKIVMYGGWDGKKWLSDVYIMDTMSLEWTELAVTGSVPPPRCGHSATMIEKRLLIFGGRGGAGPIMGDLWALKGITEEDNETPGWTQLKLPGQSPSPRCGHSITSGGPYLLLFGGHGTGGWLSRYDVYYNECIILDRVSVQWKRLPTSNEPPPPRAYHSMTSIGSQFLLFGGFDGKNTFGDLWWLVPEDDPIAKRDSAPNIDSNSKPSTMTGDAQQSN

SEQ ID NO: 37591 - DNA, 797 bp, Panicum virgatum
  misc_feature: Ceres CLONE 1990542-R
tcaattcaggtacttcgtgatcattggaaaaattctccagcaagctcgctacaactgcacgaactaggacctttgctgagagactatcaacgtctcatcctccggcgctattcgggagatccattgacagcatttcctgaaacggaagctctacgtttcttccatttgaaaagtgcttcacagttgcgcatggatgacattcccctcttgttgagtgaatatggaaggcttctttcgacatgagatggcatcttccaagttgtgccattttctttggtttcaattgagcatttgtaacttccgaacaacacaagggaaccgttgctcaaatgtgccatctatctgacttttgggtaggaccgggcacaacagaatgatgactatgatggtatgataccaaaccttctttgtccaaagatagttgaagaatactcgcagaagtacagaactgtgcatcatggacatatataggatgtttcatttcaaaactgaagcaactactcctgggatcaacaaatcagacaggaatttttttttccaataaggagacaggaagaaacttttcgcttcttctcaaatcctttttgttccctgcctttgctttcttgtgtcatgttcttttcattttgggtaattgtatgttctgtccaggctggctgtacaaatgcacacaagtatcaatgtaatatcacgcatacattggcgcgtacatgatacatggttccgtggccatgcgtggcacgacttctcttggagccatttcttactgtcagttgttgcgagtcaacagtcatatc

SEQ ID NO: 37592 - DNA, 2020 bp, Panicum virgatum
  misc_feature: Ceres CLONE 1990564
  misc_feature: Encodes the peptide sequence at SEQ ID NO. 37593
gtagggggcatgtgaaggtcacagtccatcgcaattcgcaaggcctcggcgccgcttgagcactaccggcgcctcgccactctcactcacccgccacagtagtaacgggcttgttctctggcggccagctctctgcagcttgcctgctgccatggcggccgcaacgccagcagcagtggagaggaatgcagatggagatgagcagggtaggaggaggaagaagggaggcttcaggaccatgccgctcatactagcgagcgaggtctgcgaccggttcgccatggccggcttcaacgccaacctgatcacgtacctgacgcagcagctgcacctgccgctggtggaggcgtccaacacgctgaccaacttcggcggcacgtcggcgctgacgcccatcctgggcgcgctcgccgccgacgccttcatcggccgcttctggaccatcatcgccggctccgcgatctaccaggtcggcatggtcggcctcgtcgtgtccgcgctcctccccacgctgcgcccgccgccgtgctccccgccggccaccccgtgccagcgcgcctccgggtggcagctcgcggtgctgtacctctccctcctctgcacctcgctgggctccggcggaatccgcccctgcgtcgtggcgttcggcgccgaccagttcgaccaggagcagcgggacggcggcgaggccgccaaggcggcggcggagcggaagcgccgctacttcaacctctacttcttcaccatggggctcgccatgctgctggccttcacggtggtggtgtacatccaggataacgtgggctggggctggggcttcgggatcccggccatcggcatgctcgtctccatcctggtgttcctggtcgggtaccccatctacatgctgctcaagcccgagggcagcccgttcacgcggctggcgcaggtcgtcgccgccgcgttcaggaagcggagcgccgccgtgccggaggaccccagcatgctgtaccaggacaaggagctcgacgcgcccatctccaccaacggcaggctgctgcacaccaaccagctcacgttcttcgaccgggcagcgatcgtgacgccgggcgacatggccccctccgggcagccgaagccgtggcggctgtcgacggtgcaccgcgtggaggagctcaagtccatcgtccgcctgctgcccatctggtccgccggcatcatgctcgccaccgccggctcgcacaactacaccttcaccatcgcgcaggcgcgcaccatggagcgccacatggggccccacttccagttcccgccggcgaccctgtccatcttctccaccgccgccatgctgctgaccctggccttctacgaccgggtcttcgtgcccctggcgcgccgcgtcacgggcctgccgtccgggatcacctacttccagcgcatgggcatcgggctggccatctccatcctcagcgtcgcctccgccgcgctcgtcgagaccaagcgccgcggcgccgccgcccggcacggcctcctcgacgaacctaccgcggtcgtcccgctcagcgtcttctggctggtgccgcagttcgccgtccacggcatcggcgacgccttctcatcggtggcgctcatggagttcctgtacgaccaggcgcccgagagcatgcgcagcagcgccgtcgcgctcttctggctcgccagcgccatcggcaactacatgggcacggtgctcgtcacggtggtgcagcgcgccacgcgcggccgcggcgagtggctgcaggacaacatcaaccggggctggctcgtcacctgcatcatgctgctcaacttcggctacttcctcgtctgcttccatttctacaccatgaagccgctggaggtggcggaagaacacggcgaccatgacaaggagtgcgagctcccgtctctccagagaaatggcggcggcggagccaatgggatggtgtaatgtaattaattaaggaggatattataggacaattactcaagttataaaggaattagtgtcttcgagcttgtc

SEQ ID NO: 37593 - protein, 598 aa, Panicum virgatum
  misc_feature: Ceres CLONE 1990564
  misc_feature (95)..(510): Pfam Name: PTR2 Pfam Description: POT family
MAAATPAAVERNADGDEQGRRRKKGGFRTMPLILASEVCDRFAMAGFNANLITYLTQQLHLPLVEASNTLTNFGGTSALTPILGALAADAFIGRFWTIIAGSAIYQVGMVGLVVSALLPTLRPPPCSPPATPCQRASGWQLAVLYLSLLCTSLGSGGIRPCVVAFGADQFDQEQRDGGEAAKAAAERKRRYFNLYFFTMGLAMLLAFTVVVYIQDNVGWGWGFGIPAIGMLVSILVFLVGYPIYMLLKPEGSPFTRLAQVVAAAFRKRSAAVPEDPSMLYQDKELDAPISTNGRLLHTNQLTFFDRAAIVTPGDMAPSGQPKPWRLSTVHRVEELKSIVRLLPIWSAGIMLATAGSHNYTFTIAQARTMERHMGPHFQFPPATLSIFSTAAMLLTLAFYDRVFVPLARRVTGLPSGITYFQRMGIGLAISILSVASAALVETKRRGAAARHGLLDEPTAVVPLSVFWLVPQFAVHGIGDAFSSVALMEFLYDQAPESMRSSAVALFWLASAIGNYMGTVLVTVVQRATRGRGEWLQDNINRGWLVTCIMLLNFGYFLVCFHFYTMKPLEVAEEHGDHDKECELPSLQRNGGGGANGMV

SEQ ID NO: 37594 - DNA, 727 bp, Panicum virgatum
  misc_feature: Ceres CLONE 1990598
  misc_feature: Encodes the peptide sequence at SEQ ID NO. 37595
acgcgccgcaccaccccctcaccggcggctcctactcctccgcccccgccgccgtcgccgcagcagttccggagctcgcctcgccggagaatatgtaccgcgccgcggggagccacctccgctccctcaagcatcacggtgctgccaggcttgctagtacaagtgttgtgaagcagtcccaaggtggtctgtttagctggcttcttggggggaaatcaagccaacttcctccccttgatgttccgctcccaggaattaccattcccccacctctaccagattatgtcgagccatccaagacaaaaatcaccactcttccaaatggcatcaagattgcctcggagacatcaccgggcccagcagtatcagtgggtctgtacattgactgtggttccatttatgaaacacccgcttcatctggagtgtcacatctattggagagaatggccttcaagagcacagtaaatcggagtcacttgcggctagttcgtgaggtagaagccattggcggaaatgtctctgcatcggcttcccgtgaacagatgagctatacatatgatgcgttgaagaactatacacctgaaatggttgaagttctcattgacagtgtgaggaatccggcatttcttgaatgggaggtcaaagagcagctccagaagataaaatctgaaatagctgaagcgtctgctaatcctcaaggtctacttctggaggcccttcattcggc

SEQ ID NO: 37595 - protein, 211 aa, Panicum virgatum
  misc_feature: Ceres CLONE 1990598
  misc_feature (80)..(211): Pfam Name: Peptidase_M16 Pfam Description: Insulinase (Peptidase family M16)
  misc_feature: SWISSPROT Homolog: EC 3.4.24.64 Mitochondrial processing peptidase
MYRAAGSHLRSLKHHGAARLASTSVVKQSQGGLFSWLLGGKSSQLPPLDVPLPGITIPPPLPDYVEPSKTKITTLPNGIKIASETSPGPAVSVGLYIDCGSIYETPASSGVSHLLERMAFKSTVNRSHLRLVREVEAIGGNVSASASREQMSYTYDALKNYTPEMVEVLIDSVRNPAFLEWEVKEQLQKIKSEIAEASANPQGLLLEALHS

SEQ ID NO: 37596 - DNA, 586 bp, Panicum virgatum
  misc_feature: Ceres CLONE 1990599
  misc_feature: Encodes the peptide sequence at SEQ ID NO. 37597
catggctattagtgactcgtcagtgatgtgtccagtgggtatgcaacgacaggtagctcatatgattccaactccaggatttagccatcatcagcttttatctcccaatcctgcttactcaaatggagctggatacctcaatggggagtcgaatgtcatacaacaagtgcacgagcagaaaccggtgccattttctatcaaccaaagtagctattcaatgcagcatctaggtacccatgtcggttctggagtacattcaagaatattggaggattcctccccatatggtttgtcagatccacaaatcaatggtgatatgggtttgcctggcccgaatatgcagctaccatacagaactgtaggagcaaaagaatttatgaatttacctccttatggcaattcaccggaaaaaccgctgcagcaagaattcatttgtcatctcccacggggaacaccaacatcttcttgtgtttctgggaatttttatggcaccgtttcttcaagttcaacacctacaggtaaccagaacatgaatgctgcacaaatattatccacttcaagaatggagtttgctttgcttacaagt

SEQ ID NO: 37597 - protein, 194 aa, Panicum virgatum
  misc_feature: Ceres CLONE 1990599
  misc_feature: SWISSPROT Homolog: EC 2.3.1.48 Histone acetyltransferase
MAISDSSVMCPVGMQRQVAHMIPTPGFSHHQLLSPNPAYSNGAGYLNGESNVIQQVHEQKPVPFSINQSSYSMQHLGTHVGSGVHSRILEDSSPYGLSDPQINGDMGLPGPNMQLPYRTVGAKEFMNLPPYGNSPEKPLQQEFICHLPRGTPTSSCVSGNFYGTVSSSSTPTGNQNMNAAQILSTSRMEFALLT

SEQ ID NO: 37598 - DNA, 682 bp, Panicum virgatum
  misc_feature: Ceres CLONE 1990628
  misc_feature: Encodes the peptide sequence at SEQ ID NO. 37599
agcatcggcttcgtctggctgaaggaagagagcagagagacacgacatggccacccacgctgccctcgccgcgtcgcgcatccccaccagcgcccgcctgcacagcagggcggcgtccaggcagagggtggacttggttgacttctccgggctcaggccgggatcatgctccgtcagcgccgccgccagggaggcgtccttctccgatgtgctcggcgcgcagctcgtcgccaaggccaccggtgagaacgcggtgagggcgcccgctgaggcgaagctcaaggtggcgatcaacgggttcggccgcatcggccggaacttcctccggtgctggcacggccgtgaggactccccgctcgacgttgtcgtcatcaacgacagcggaggcgtcaggaacgcgtctcacctcctcaagtacgactcgatgctcggcaccttcaaggccgacgtcaagatcgtcgacgacagcaccatcagcgtcgacggcaagaacatcgcggtcgtctccaacagggacccactcaagctcccatgggctgagctcggcatcgacattgtcatcgagggtaccggagtgttcgtggacggcccgggcgccgggaagcacatccaggccggcgcgaagaaggtgatcatcactgctccggccaagggcgcccacatcccgacctacgtcgtcggt

SEQ ID NO: 37599 - protein, 211 aa, Panicum virgatum
  misc_feature: Ceres CLONE 1990628
  misc_feature (78)..(211): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MATHAALAASRIPTSARLHSRAASRQRVDLVDFSGLRPGSCSVSAAAREASFSDVLGAQLVAKATGENAVRAPAEAKLKVAINGFGRIGRNFLRCWHGREDSPLDVVVINDSGGVRNASHLLKYDSMLGTFKADVKIVDDSTISVDGKNIAVVSNRDPLKLPWAELGIDIVIEGTGVFVDGPGAGKHIQAGAKKVIITAPAKGAHIPTYVV

SEQ ID NO: 37600 - DNA, 1705 bp, Panicum virgatum
  misc_feature: Ceres CLONE 1990635
  misc_feature: Encodes the peptide sequence at SEQ ID NO. 37601
gtgcacattgaggagtgtgtaactcatcagctcgtccgtgcgccggaagagtcggagcggagatggcgccggcggtgtccgggcgctcgaactggtcgggcgagtgcaagaacctgtggcgcgtcgcgggcccggtcatcctggcctcggtcttccagttcctgatcgccttcgtcaccgcggccttcgtcggccacatcggcaaggtcgagctcgccgccgtctccatcgtcaacggcgtcatcgagggcctcgccttcggcctcctgctcggcatggggagcgcgctggagacgctgtgcggccaggccgtgggcgccgggcagctccagatgctgggcgtctacatgcagcgctcctggatcatctgcctcgccacgtcgctcgccctgctcccgctctacctcctcgcgtccccggtcctgcgcctgctccggcagtcgccggccatcgcggcggtgtccgggcggtacgcgcgctggtgcgtgccgcagctgttcgcctacgccgtcaacttccccatccagaagttctaccaggcgcagagcagggtgtgggtcatgacggccatctcgggcgccgtgctcgccgcgcacgcgctgctcaactgggtcgtcgtggccaggctcgggcgcgggatggtcggcgcggccgtcgtcggcgacgtctcgtggtggctgctcaacgccgcgcagttcgtgtacctcgtcggcgggtcgttcccggaggcgtggacggggttctcgcgcaaggcgttcgccaacctcggcggcttcgtcaagctctccatcgcgtcggctgtcatgctatgcctagagatgtggtattatacggcagtgctcattctggtggggtgcctaaagaacccagagattcaagttggagcgatttccatatgcatgaactatcagctttggaccctgatggttgctcttggcttcaatgctgcagtaagtgttcgcgtctcgaacgagcttggcgccaaccacccgaaggcggccaagttctcagtggtcgtcgccacgaccacatcggccgccatcgggttggtcttcacggcggtcgctctggcggcgaggaagcagatgcctcggctcttcaccggcgatggcgcggtcgtcaaggagaccgccaagtttgggtacctcctggccgccaccatattcctcaatagcatccagccggtgctttcaggggttgcgatcggtgccgggtggcagtccttggtcgcgttcgtcaacatcggctgctactacctcgtcggcctgcccctcgcagccgtgtttggcctcaagctgaagctcaatgcaacagggatttgggtgggagtgttgattggaacggtgttacagactgcgattctgtttgtgatcctcttcagaaccaaatggcagaaagaggctatgctagcagaagagagaatacgggtgtggggaggaaacgttgagctgccacggactcaagaatcaagataaagtgaaaacattgctgcacctgtttgacagaaaactatttgttgcggaataaaaacaacaattaccagtttcagtcatcagaatcatccagggtgtgaggtttacaacagtagtgtagtactactacagtacttggtagtaacagaatttgacgtcgggacaaaccagatcgagtaagcaggtactatctttgattgtacgaaaacgaggacaaaaacaaattcatatgg

SEQ ID NO: 37601 - protein, 470 aa, Panicum virgatum
  misc_feature: Ceres CLONE 1990635
  misc_feature (244)..(407): Pfam Name: MatE Pfam Description: MatE
  misc_feature (24)..(184): Pfam Name: MatE Pfam Description: MatE
MAPAVSGRSNWSGECKNLWRVAGPVILASVFQFLIAFVTAAFVGHIGKVELAAVSIVNGVIEGLAFGLLLGMGSALETLCGQAVGAGQLQMLGVYMQRSWIICLATSLALLPLYLLASPVLRLLRQSPAIAAVSGRYARWCVPQLFAYAVNFPIQKFYQAQSRVWVMTAISGAVLAAHALLNWVVVARLGRGMVGAAVVGDVSWWLLNAAQFVYLVGGSFPEAWTGFSRKAFANLGGFVKLSIASAVMLCLEMWYYTAVLILVGCLKNPEIQVGAISICMNYQLWTLMVALGFNAAVSVRVSNELGANHPKAAKFSVVVATTTSAAIGLVFTAVALAARKQMPRLFTGDGAVVKETAKFGYLLAATIFLNSIQPVLSGVAIGAGWQSLVAFVNIGCYYLVGLPLAAVFGLKLKLNATGIWVGVLIGTVLQTAILFVILFRTKWQKEAMLAEERIRVWGGNVELPRTQESR

SEQ ID NO: 37602 - DNA, 734 bp, Panicum virgatum
  misc_feature: Ceres CLONE 1990639
  misc_feature: Encodes the peptide sequence at SEQ ID NO. 37603
gactaactctctcatgtggcttcgagatactgcaaatcctggttttcagtcgttaaattttggtggacttggtgtgaatccttggatgcagccaaggctggatgcttccttacttggtctgcaacctgacatgtatcaggcgatggccacagctgctttccaggatccaacgaagcaagtgtcatccacgatgctgcagttccagcagccacagaacatatctggtcgagctgcgccacttctgtcgagccagattttgcagcaagtgcagcctcagtttcagcagcagccataccttcaaaacatccctgagaccacaatccatggccagggtcaatctgagctcctcaagcagcagattcaacgcacccaatcatttaatgagcagaagccccagctgcaaccccagcaacagcagcaagaatcacagcagcaatcacagtgcctgcaagtgcctcaacatcagcaaatgcaacagcagaacaacatgaccaactaccagtcagtgtctaatgcattgtcagcattttctcaattgtcatcagcccctcagtcttcacctgcggtgctgcaaacaatactaccattctcacaggcgcagagctttgcagaaacgactatcagctcattgtctccatctaatgccgccaccatgcaaaatacgctgaggcctttctcatcagaagctgcttctcacctgagcatgccaaagcccactgcagtatctgttgctg

SEQ ID NO: 37603 - protein, 244 aa, Panicum virgatum
  misc_feature: Ceres CLONE 1990639
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
TNSLMWLRDTANPGFQSLNFGGLGVNPWMQPRLDASLLGLQPDMYQAMATAAFQDPTKQVSSTMLQFQQPQNISGRAAPLLSSQILQQVQPQFQQQPYLQNIPETTIHGQGQSELLKQQIQRTQSFNEQKPQLQPQQQQQESQQQSQCLQVPQHQQMQQQNNMTNYQSVSNALSAFSQLSSAPQSSPAVLQTILPFSQAQSFAETTISSLSPSNAATMQNTLRPFSSEAASHLSMPKPTAVSVA

SEQ ID NO: 37604 - DNA, 1384 bp, Panicum virgatum
  misc_feature: Ceres CLONE 1990640
  misc_feature: Encodes the peptide sequence at SEQ ID NO. 37605
aacaaacgctaaaaaagtaacagtttctgtactttattgttgccaccggaaacaatgcttggcgcgttgcttgctctcgccgcgtgcgtcggcgttgcccacgtcgaggcgtacttctacatccccggcatgctccccatcgagcacaacgacggggcgccgcttaacatcaccgtcaactcgctgcggtcgttgtcagcggtggtcccgtatgactactatcacttacccttctgccagccggcgtcgcgccaagccgtcggcgcggagtcgatggggcaaatcctcgcgggcgacaagatggaggccagcctctaccaagtccgcatgaagcgcaaccagtcgtgcgtgcgcctgtcctgcgggtccaacaacgccaacgagctgaagaagcgtgcggacgagatgatcaagtctatcgagcagaactatcgtggtcacatgagcatcgacaacttgcccggcttcaatgaccacacgcctgtgtttggcggccgctgcaagaacgcggcgccggcgaactggcacgataccgcaaagcgcgggtacgctattggtgtgccgagctggtgcaccggcaagccgctgctgaacaaccatttggacttcacgatccggtaccaccagccggagggtgcggaagggtaccgcgtggttggcttcagcatcgtgccgcggtccatctatttcgacggcgacgactcctgcatcgagtcgttcgacccctcgtcgggcgtccaccagcccgtggacatggaggcagtcaaggcgggcacgcagaaggatgtgcagtggacctactccgtcacgtggatcgaggacacgaagacgacgtgggcgacgcgctgggacaagtacctcgacacctcggaggcggacacgaacgcgaaggcgcacgtcaagtacatcatcaacagcttgctcatcacgatctgcctcgtggtcatcgcgggcatgatgctgatgcggacgctgcacaaggagtgcaacgagtacaacgcgcaggatcccgactcgctcgcggaggagatgggctggaagctggtgcacgccgacgtgttccgcacgccgcagcacgtcgagttcctcgccatcgccatcggcaacggcctgcagttcgtgctcgtgttcgcggcgatcatcgtcttcgcgctactcggcttcctctcgcccgccaaccgcggcggcctcgtgacggcgatgctcatcacgttcgccctcttctccatggcgtccggctacattacggcgcgcgtgctgaagatcgtcgacaagaaacaatggaaggtcatcttcggcagcgcgatgctgttccccggcgccctcttcggcatgttcctcgtcatcgatatggtgaactggcacctcggcgcctccgacgccc

SEQ ID NO: 37605 - protein, 443 aa, Panicum virgatum
  misc_feature: Ceres CLONE 1990640
  misc_feature (51)..(443): Pfam Name: EMP70 Pfam Description: Endomembrane protein 70
MLGALLALAACVGVAHVEAYFYIPGMLPIEHNDGAPLNITVNSLRSLSAVVPYDYYHLPFCQPASRQAVGAESMGQILAGDKMEASLYQVRMKRNQSCVRLSCGSNNANELKKRADEMIKSIEQNYRGHMSIDNLPGFNDHTPVFGGRCKNAAPANWHDTAKRGYAIGVPSWCTGKPLLNNHLDFTIRYHQPEGAEGYRVVGFSIVPRSIYFDGDDSCIESFDPSSGVHQPVDMEAVKAGTQKDVQWTYSVTWIEDTKTTWATRWDKYLDTSEADTNAKAHVKYIINSLLITICLVVIAGMMLMRTLHKECNEYNAQDPDSLAEEMGWKLVHADVFRTPQHVEFLAIAIGNGLQFVLVFAAIIVFALLGFLSPANRGGLVTAMLITFALFSMASGYITARVLKIVDKKQWKVIFGSAMLFPGALFGMFLVIDMVNWHLGASDA

SEQ ID NO: 37606 - DNA, 756 bp, Panicum virgatum
  misc_feature: Ceres CLONE 1990640-R
gctctcatcttcctgctgtgggtcggctcgtgcatcccgctgaacgtgctcggcgcgacgtacgggttccaccaggaatcgatggagcagccgtgcaaggtcggccgtctcccgcgtgagatccccgcgcagcgttggtggttgtcggccccggcgctgtacatcctgcctgcaacgttcccgttctgcgcgatcttcctcgagctgcgcttcatcttcgacgccgtgtggctcggcgccgtgtactacgcgttcaccttcctgacggtgtcgttcctcgtgtgggtcgtcacggtgatgctgacgaccgtcatcatggtgtactacctgctcgcgcacggcgactaccgctgggcgtggcacagcttcatcatcggcggcggcatggggttccacgtgatgctgtacgcggcgtggttcttcttcacgacggccaacatcacgaccaagacgggtacgttcatcttcttcacgtacatgagcttcttcgccaccgcgtacggcctcgccgccggcgccattgggttcctcacatcgtacgtgttcgttcgcgccatctactcgagcattcgcatcgattagtcgtcgaatgtggaagaggaggaagaacggccggaaagagatacacaacacactatgcgcccaggcaaagacaacggagcggatctgctgctgcagctcgctagagagaggattgggctgcgtgggtgcattgcttgctattcgtaaccgcccgcaagtttgagcacgctcatc

SEQ ID NO: 37607 - DNA, 1576 bp, Panicum virgatum
  misc_feature: Ceres CLONE 1990644
  misc_feature: Encodes the peptide sequence at SEQ ID NO. 37608
actcgcacgcaaccaaccgagcagccagtcgagcgagagagggagagaaagcaaagcaaggcacatcaatcgaaatccgatcgaaaccctagcacgcagatccgaaccgatcgatggcccgctcgccgccgcctcccccgtcggccggcggcgctcagtacgcgcagcagttcctcaacacggcgctctcgcagcgggggccctccgcgctgccctacgccgaggacgtcaagtggctgatccgcaaccacctggtggcgctggccgaggccttcccctccctccaccccaaggccgccctcttcacgcacaacgacggccgcgccgcccatctcctccaggccgacggcaccatccccatccaccacgccggcgcctcctacaacctccccgccgtcatctggcttcccgagccctatccgcgttccccgccgctcgtcttcctctcccctacccgcgacatggtcatcaagccccaccacccgctcgtcgaccgctccggccttgtcgccaacgcgccctacctccgctcctgggtcttcccctcctccaacctcgtcgacctcgtccgatccctctcccacctcttcggcctcgacccgcccctcttcaccaggaaccctcctcctcctgccgccgctccgacgcctaccaatccctcgccgcagcctccgcccccgcgggtctccccctccccctccccctcctacaggctcggcggcttccccgcatcgccccagctcgccccccgcccgccccccaccgaggaccccgccgaggtcttcaagcgcaacgccgtcgtcaagctcgtcgacatggcctacgcggatgccgccgccctgcggaccgcgcgcgagaccgaggttgacgccctcttcaccgtccaggcggagctgcgccacaggggtgatctcgtcgcccaaggggtgcgcaagatgggggaggagaaggaggcgcttgagcgccgcctgcaggacgtcatgatggccaccgatgtcgtcgaggcctgggtcacggagaacaccaggagaggcaacacccaggcctcggaggacgccatccagccagcagatgtgctctccaggcagatgatcgagtgcacggccgcagatttggcactcgaggataccatctacgcgcttgacaaggccattcaggagggatctgtgccctttgacggctacctcaggagcgtgcgcgcactgtcacgcaagcagtttttccaccgcgccttgtctgccaaggttcacactgcacaacagcaggctaaagttgctagcatggcagcccgggcaccacagtatgcatcctagtgatgatggtcagtatacttgcttggtctacaaccaatccgattttgtctgtctcaagtgacttataagtgattctctgtgtaaagttgtatgccatgcctgtttataacgattacttgataggactggatggatagcaaagaacttgtgtcaataataactttgagtttgagttgggtcacatgatgtcatgtatggtttttgagcttgcagtccatgttgtgtgctttgtttctgttcattacaattactttatagtccag

SEQ ID NO: 37608 - protein, 399 aa, Panicum virgatum
  misc_feature: Ceres CLONE 1990644
  misc_feature (43)..(165): Pfam Name: UEV Pfam Description: UEV domain
MARSPPPPPSAGGAQYAQQFLNTALSQRGPSALPYAEDVKWLIRNHLVALAEAFPSLHPKAALFTHNDGRAAHLLQADGTIPIHHAGASYNLPAVIWLPEPYPRSPPLVFLSPTRDMVIKPHHPLVDRSGLVANAPYLRSWVFPSSNLVDLVRSLSHLFGLDPPLFTRNPPPPAAAPTPTNPSPQPPPPRVSPSPSPSYRLGGFPASPQLAPRPPPTEDPAEVFKRNAVVKLVDMAYADAAALRTARETEVDALFTVQAELRHRGDLVAQGVRKMGEEKEALERRLQDVMMATDVVEAWVTENTRRGNTQASEDAIQPADVLSRQMIECTAADLALEDTIYALDKAIQEGSVPFDGYLRSVRALSRKQFFHRALSAKVHTAQQQAKVASMAARAPQYAS

SEQ ID NO: 37609 - DNA, 682 bp, Panicum virgatum
  misc_feature: Ceres CLONE 1990645
  misc_feature: Encodes the peptide sequence at SEQ ID NO. 37610
aaatacaaccagagtttcccaccttgcagaagatgagcgactaagagcattccagggccatctcaagaaactgtccaagcatggggttttctccatggcttgtcttcttgatcagtgttcttgtgcagacttctgcaatcttggccgatacggatccgcgagactcttctgccctcaccgcaattgctgataactggaaaaataagccatcaaactggaatggcaatgacccgtgcagagacaagtgggtcgggataatttgcacagggaaccgagtcacctctgtacgactatcaagttttggactgtcagggactctttcaggggacatccagtctttgtcggaactcgtatacttggacttatcctacaacaaggacttgggtggtcctctacctgcaaccattggatccttgagcaacctccaaaacttaattcttgttggttgcactttctctggtgaaataccaaaagaattaggacagttgttaaaccttatattcctatcactgaactccaataagttctctggctccatcccggcaacactaggtaacctctcaaagctatactggtttgatctggctgacaataagctcactggagaacttcccatattcgatgggacaaatcttgggttggataatctaacaaatacaaaacacttccacttcggtatcaa

SEQ ID NO: 37610 - protein, 200 aa, Panicum virgatum
  misc_feature: Ceres CLONE 1990645
  misc_feature (25)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MGFSPWLVFLISVLVQTSAILADTDPRDSSALTAIADNWKNKPSNWNGNDPCRDKWVGIICTGNRVTSVRLSSFGLSGTLSGDIQSLSELVYLDLSYNKDLGGPLPATIGSLSNLQNLILVGCTFSGEIPKELGQLLNLIFLSLNSNKFSGSIPATLGNLSKLYWFDLADNKLTGELPIFDGTNLGLDNLTNTKHFHFGI

SEQ ID NO: 37611 - DNA, 1324 bp, Panicum virgatum
  misc_feature: Ceres CLONE 1990659
  misc_feature: Encodes the peptide sequence at SEQ ID NO. 37612
accatagacaaataatcctacctcctcctccctttcttcttcttcttcttcttccccgtccgtctcagaacaaatttgttccactaggattgttattggttgtttcattcttattactaccttcttggagttgaggatagaggtatgtgtactcatgagcggattcctgtctgcggcttactaccttaagtagttgactagcaagcaagcaggcaggcaggcgggtactaaggcggacgagaagagtcagtacgtcgttgagtggtcggtcggatcggaattctcaattcctaagctgaaagctgataatcaatcaatccatcagctgcagatctaggcgaggcaattcatcatcgatccaaaagatagatagatactaggaatggcgatggagcctgcgttgaaggtggccctggggtccggcgcgttcgccatcttctgggtgctggccgtgttccccgcggtgcccttcctgccgatcgggcgcacggcggggtcgctgctgggcgcgatgctgatggtggtgctgggcgtgatgagcgccgacgaggcgtacgcggcggtggacctcccgatcctgggcctgctgttcggcaccatggtggtgagcgtgtacctggagcgcgccgacatgttccggcacctggggcggctgctgtcgtggcgcagccatggcgggcgcgacctgctggtgcgcacctgcgccgtgtcggcgctggcgtcggcgctcttcaccaacgacacctgctgcgtggtgctcaccgagttcatcctcaagatcgcgcggcagaacaacctgccgcccaagcccttcctcctggcgctggcctccagcgccaacatcggctccgccgccacgcccatcggcaacccgcagaacctggtgatcgccgtccagagcggcatctccttcggccagttcgtcttcggcatcctcccggccacgctcgtgggctccgtcgtcaacgccgccatcctgctctgcctctactgggggcagctcgacggggggatgaagcccgccgccgaggaggtggtggccgtgcccaccgaggtggtcgaggaggaggacgtgacctcgcaccgcttctcgccggccaccatgtcgcacctgcgctcgcgctcgcagccgcagtcgcactcgtccgacgccgccggcgaggactaccacgccaacggcaacggcaagcagcagcaggctttggccagcaacggcctccaccagaggcggcacacgaccttgctgccgtcggagtcggaggggaaggtcgtcgacgaccagcactccttgtccttgcagcagtcggagcaagagcaggaggag

SEQ ID NO: 37612 - protein, 313 aa, Panicum virgatum
  misc_feature: Ceres CLONE 1990659
  misc_feature (16)..(259): Pfam Name: CitMHS Pfam Description: Citrate transporter
MAMEPALKVALGSGAFAIFWVLAVFPAVPFLPIGRTAGSLLGAMLMVVLGVMSADEAYAAVDLPILGLLFGTMVVSVYLERADMFRHLGRLLSWRSHGGRDLLVRTCAVSALASALFTNDTCCVVLTEFILKIARQNNLPPKPFLLALASSANIGSAATPIGNPQNLVIAVQSGISFGQFVFGILPATLVGSVVNAAILLCLYWGQLDGGMKPAAEEVVAVPTEVVEEEDVTSHRFSPATMSHLRSRSQPQSHSSDAAGEDYHANGNGKQQQALASNGLHQRRHTTLLPSESEGKVVDDQHSLSLQQSEQEQE

SEQ ID NO: 37613 - DNA, 784 bp, Panicum virgatum
  misc_feature: Ceres CLONE 1990659-R
cgggtgtggaagacgtgcgtgtacgtgatcaccggcggcatgctggtggcgctgctgctgggcctcaacatgtcgtggagcgccatcaccgccgccctggcgctgatcgtgctggacttcaaggacgcgcgcccctgcctggagaaggtctcctaccctctgctgctcttcttctgcgggatgttcatcacagtggacggcttcaacaagacgggaatccccagcgccttctgggagttcatggagccctatgcgcggatcgacacgcccaccgggaccgccattctcgccctcgtcatcctgctcctctccaatgtggcctccaatgtcccgaccgttctcctgctgggcgcccgggttgccgcctccgccgccgccatctccccggccgcccagaccaacgcgtggctcatcctggcctggaccagcacggtggccggcaacctctccctgctgggctccgccgccaacctcatcgtgtgcgagcaggcgcgccgctcccagcactacggctacacgctctccttcttgggccacctccagttcggcttcccggccaccatcatcgtcaccggcatcggcctcctgctcatcagaacctactgatcgatgccgaaccacgtgtgttgccgtactgctagtagctctacatcaaagtaagattattttagtatgttgattggttgaagaaggaagaagattgtacattttggatcgagtagcacacagatagtagtattgtatatcatgcatcccaatgccatacagaatgtataccctgtct

SEQ ID NO: 37614 - DNA, 555 bp, Panicum virgatum
  misc_feature: Ceres CLONE 1990664
  misc_feature: Encodes the peptide sequence at SEQ ID NO. 37615
agagaggcaacctccccggagcactcactccccctcaccctcgtcgccatcgccccccgcctcctcggagaccgtctcccccttctccccttccctccccgatcggaaccggggactcagatcgatctccgggatgcggatctagcgcggtggggcggggccgaacgatatccggacggaacccctgactaccagggcgccacgaggggggcggggttgtgtgagcgtgacattcccaccgagggctcccgccgcctcggccgctcacgcggggggcgtggcctgctgctcgacgcgtcctgcgtgggctgccagctcgaggacgaggcgcggtcccgggtgccggccacgcccgaggggatgcacgagtgcatcgcccacggcggggacgtcggcggcgtcaccaccggcttcggcggcaggtcacaccgacgcaccaaggacgggcccgcgctccaggtcgagctgctcaggcatctcaacgccagaatcttcgggaatggttccgacggccacacgctcccttccgaggtggcacgcgcggccatgatcgtc

SEQ ID NO: 37615 - protein, 184 aa, Panicum virgatum
  misc_feature: Ceres CLONE 1990664
  misc_feature: SWISSPROT Homolog: EC 4.3.1.5 Phenylalanine ammonia-lyase
REATSPEHSLPLTLVAIAPRLLGDRLPLLPFPPRSEPGTQIDLRDADLARWGGAERYPDGTPDYQGATRGAGLCERDIPTEGSRRLGRSRGGRGLLLDASCVGCQLEDEARSRVPATPEGMHECIAHGGDVGGVTTGFGGRSHRRTKDGPALQVELLRHLNARIFGNGSDGHTLPSEVARAAMI

SEQ ID NO: 37616 - DNA, 701 bp, Panicum virgatum
  misc_feature: Ceres CLONE 1990665
  misc_feature: Encodes the peptide sequence at SEQ ID NO. 37617
acgcaccaccgcaactcccaacgaccccgccaccgccgccgctctcttcgccggagaagagagacacgaggaggggaaggaacagcagcctccgcgacccgatccccgacgagccccccccctcccctccgggcgtggccgagtggtaggcatcacggctagcgttgcagccccccggcgcggccccgcagctgcgcaggtggagcccacgggcaccatcgcctccgccgtcgccaccagccccgccccgcacggcggccgcggggcgctgccctcggccggagggagcccgtccgacctcctcttcctcgccggcggcggttgcctctgagccgctcccccacccctctcccctccctccctctctctgacccctccccctcctcctcctgacaaccgtcgtctgctgagccccccgaccccgacaaacacacacccgagagattgattgacaccgcccgagagcgagccgccggccgccatggagatgaagctcaccatcaggagggtgcccaccgtcgtctccaactaccaggaggacgccgacaagccccgagccggatgcgggaggaactgcctcggccactgctgcctgcctgtttccaagcttcccctctatgctttcaaggcaaatccggcaaaacctgcacaggaggatgctgcttcaactaagtcccttgtcaatatccttctagctgagt

SEQ ID NO: 37617 - protein, 73 aa, Panicum virgatum
  misc_feature: Ceres CLONE 1990665
  misc_feature: Useful for making plants with modulated nitrogen use efficiency
MEMKLTIRRVPTVVSNYQEDADKPRAGCGRNCLGHCCLPVSKLPLYAFKANPAKPAQEDAASTKSLVNILLAE

SEQ ID NO: 37618 - DNA, 598 bp, Panicum virgatum
  misc_feature: Ceres CLONE 1990705
  misc_feature: Encodes the peptide sequence at SEQ ID NO. 37619
gatttcgcgagctctgcttcttcgtctccctgctgctgcgggcggagggggagcggaattgtggttcagccgtgggctgccctgctccttcctcttcgtcagatcattgtttgccgaattgaatctgcggggctaggctgtgcaggcgatgtgggtgccggtggcgccgatgtggatgcggtggtgggtggtggctgctggcctgctcgccgtgaccctgccgccgtccaccgccacgctctccccggccggcatcaactactaagtggtggcactgatggccatcaagacggagctggaggacccccacaacgtgctggacaactgggacatcaactccgtcgacccctgcagctggaggatggtcacctgttcctccgacggctacgtctccgccttatgattgcccagtcagagcttgtccgggaaattgtcacccggcatcggcaacctcaccaggctacaatctgtgctgttacagaacaatgcgatttctggccccattcccagtaccataggaaggttggggatgctaaagactcttgacatgtcagataaccagctcacggggagcatcccaagttcacttgggaatctc

SEQ ID NO: 37619 - protein, 41 aa, Panicum virgatum
  misc_feature: Ceres CLONE 1990705
  misc_feature (1)..(33): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature: Useful for making plants with modulated nitrogen use efficiency
MAIKTELEDPHNVLDNWDINSVDPCSWRMVTCSSDGYVSAL

SEQ ID NO: 37620 - DNA, 588 bp, Panicum virgatum
  misc_feature: Ceres CLONE 1990706
  misc_feature: Encodes the peptide sequence at SEQ ID NO. 37621
ggagaggcagaaattacgggttcaccaactgaaaaggccattctttcttggggtcttaagatagggatggatttccatgacatgaggtcgaaatctgcagttattcatgttttcccatttaactcggagaagaaacgtggtgctgttgcagtacagtcagatgaaggtggtcacgtacattggaaaggtgcagctgaaatagtgttatcttcttgcaaaagctggctttctgtcgacggctcagttcagccaaggagtgctgagaagcacgatgaatacaagaaattgattgaacacatggcagcgaattcattacgctgtgttgcttttgcatattgtgcttctgacattgaaatgattccaaaggaagacatagtaaactggaagttgcctgaggatgacctgactctgcttggcatagtaggaataaaggacccctgtcgcccaggagtaagggatgctgtacgactatgcactactgctggtgtaaaggtgcgcatggttacaggagataatatcgaaactgctaaggctatagctttggagtgtggaatactagatgcaaatggtctttatttcggagccagt

SEQ ID NO: 37621 - protein, 195 aa, Panicum virgatum
  misc_feature: Ceres CLONE 1990706
  misc_feature: SWISSPROT Homolog: EC 3.6.3.8 Calcium-transporting ATPase
GEAEITGSPTEKAILSWGLKIGMDFHDMRSKSAVIHVFPFNSEKKRGAVAVQSDEGGHVHWKGAAEIVLSSCKSWLSVDGSVQPRSAEKHDEYKKLIEHMAANSLRCVAFAYCASDIEMIPKEDIVNWKLPEDDLTLLGIVGIKDPCRPGVRDAVRLCTTAGVKVRMVTGDNIETAKAIALECGILDANGLYFGA

SEQ ID NO: 37622 - DNA, 698 bp, Panicum virgatum
  misc_feature: Ceres CLONE 1990711
  misc_feature: Encodes the peptide sequence at SEQ ID NO. 37623
atttctactactgctagtattccccccacaagaagcccccctccatgatagtgctccctctgagctaaggctctcccaactaccacccactctcctccgctgcccgccggcgatggccgcaatgccggcgccggccgtgggcttggccgtcctggtgctcttcgccgccgccctgccggccctccgcgcggatgacctcaactctgacgcgcaggccctgcaggcgctgcgctcggcggtggggcgctccgcgctgccatcgtggaacagcaccacgcccacgtgccagtggcagggcgtgacgtgcgagaacggccgcgtcgtcgagctccgcctccccggcgccgggctcatgggcaccctcccctcgggcgtgctcggcaacctcaccgcgctccgcacgctctccctccgctacaacgcgctcacggggcccctccccgacgacctctcccgcctgtccgagctccgggcgatctacttccagcacaacagcttctccggcgaggtcccggcgtctctgttctcgctcaagaacctcgtgaggctggacatcgcagacaacaagttcaccggcgagatctcgccggacttcaacaagctgatccggctcgggacgctgtacctcgacgggaacagcttcaccggcgagatccccaagctggaccttcccgcattggagcagttcaacgtgtcgt

SEQ ID NO: 37623 - protein, 195 aa, Panicum virgatum
  misc_feature: Ceres CLONE 1990711
  misc_feature (29)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAMPAPAVGLAVLVLFAAALPALRADDLNSDAQALQALRSAVGRSALPSWNSTTPTCQWQGVTCENGRVVELRLPGAGLMGTLPSGVLGNLTALRTLSLRYNALTGPLPDDLSRLSELRAIYFQHNSFSGEVPASLFSLKNLVRLDIADNKFTGEISPDFNKLIRLGTLYLDGNSFTGEIPKLDLPALEQFNVS

SEQ ID NO: 37624 - DNA, 813 bp, Panicum virgatum
  misc_feature: Ceres CLONE 1990721-R
  misc_feature: Encodes the peptide sequence at SEQ ID NO. 37625
gctcggttacgcacgcacgcacacaaataggagtacctgttttacaccaccaagatactagcaagcccaagccgagtcgacaaacaagcagcaggaagaggcatggcgctcgcggaggggaacggcgcggccatcttcggcgaggaacaggaggcgctggtgctcaagtcgtgggccctcatgaagaaggactcggccgacctcggcctccgcttcttcctcaagatcttcgagatcgcgccgtcggcgaagcagatgttctcgttcctgcgcgactccgacgtgccgctggagaagaaccccaagctcaagacccacgccatgtccgtcttcgtcatgacctgcgaggcggcagtgcagctacggaaggccgggaaggtcaccgtcagggagacgacgctcaagcggctgggcgcaacgcacttcaagtacggcgtcgccgacggccacttcgaggtgacaaggttcgcgctgctggagacgataaaggaggcgcttcccgccgacatgtggagcctggagatgaagaacgcctggagcgaggcttacaaccagctcgtggcggccatcaagcaggagatgaagcctgccgcatgatgctgcatgctgctacatactcggcctccgagtcccccctacgatgcaccaccatctccaagttcttcatcgctatttttttccgttttgactttgtcaattgtcttgtgcattttccaattctctcgatggagaaaagtgtgatgtactaatttgcattgtgatagcatgtatattgcgatgagcacggaataaagatgcaacttgcttgtagcc

SEQ ID NO: 37625 - protein, 164 aa, Panicum virgatum
  misc_feature: Ceres CLONE 1990721-R
  misc_feature (16)..(125): Pfam Name: Globin Pfam Description: Globin
  misc_feature: Useful for making plants with modulated cold sensitivity
  misc_feature: Useful for making plants with modulated salt sensitivity
MALAEGNGAAIFGEEQEALVLKSWALMKKDSADLGLRFFLKIFEIAPSAKQMFSFLRDSDVPLEKNPKLKTHAMSVFVMTCEAAVQLRKAGKVTVRETTLKRLGATHFKYGVADGHFEVTRFALLETIKEALPADMWSLEMKNAWSEAYNQLVAAIKQEMKPAA

SEQ ID NO: 37626 - DNA, 1224 bp, Panicum virgatum
  misc_feature: Ceres CLONE 1990721
aaaaccgcaaaagcgaaggggggaaacagaaaaagtgagcccccaaaccctagaccccatggaagcgtggccgcctctcgcccccgcggccgccgccacccccgcggcccctgcctccgacgatgcagccgtcccaccacctccccctcccgccgccggggcgtggggggccgcggccaccgcgcagcggaagcccgtggtgcaggcgtcggctgcgcaggcggtgagccggctcgtggcgagctgcgccaactccagcggcgtggccgtggccgtggtggacgccaacgccgtcatcgccggcggctccgcgctctccaccaccgccgggcgcctggtcactgtgccggaggtgatggaggaggtccgcgacgcggccgcgcggcggcgcctggcgctcctccccgtccccgtcgagaccgttgagcctccgccggagttcgtcaagaaagtcaccaaatttgccagggagacaggtgacatccaaacactttcagatgttgatatcaagattattgctttggcttacatgttagaagccgagatccatgggactagccatttgcgggagcaccctcctcctctgcgtgaggtgaatgtcagaaaactgtctgaagctccgcttcctggttggggctctaatgtccctaatctgaaagaatgggaagagttggatcagatttctgaagcaagtggagatatcaattctcggatacttccactgaaggatcttgagaatcaagatatccccatgagtgagaccaacagtgtttgtgaggcacaagaggatgcaggactccagcctaacaaagatgcacgcactgcatgggaagatgatgagaataacgaaggttggacacctgctgttagccgcagcacacacaaaagatatctgcggaggaaggcaaggcgtgacgcccttaaggaatctggacaaagtcttgagacaagttctgttgctccatcaattgatgctgacaaagtcctctctgaaaatggtgggtttgagcatgatttgactccaacagatggcccttcttctgccactgagaaaatcaattcaagtactgacggattggaatgtcgagcagagaatgaacatgaaattgctggagaacatttacattctgatcaactagccaaatatgatgatactgatgcatgcactaaggaattggataacctcgacataaaaagcgagagtgatggaggtgatgatgcaca

SEQ ID NO: 37627 - DNA, 2121 bp, Panicum virgatum
  misc_feature: Ceres CLONE 1990722
  misc_feature: Encodes the peptide sequence at SEQ ID NO. 37628
ggacaaggggagagccacaaataaagccacatcgatcggagccacagccatcgccgtcgccgttggcgctccgttgatcgcgcgccgtccgtcgtcggcgccccactcgccgggatccgatcgcataagtaccacaccctagctgcggcggcaacgagcggcggcaccggggaaaaaaaatcctccccccactatgccgtccccttcctctgcccactggctgagcttggtcgggagcgtctggctccagagcatcaacggccccaacgccgacttccccgtctactcgtcgcagctcaaggaggtcaagggcatctcccaggtgcggctcaacttcctcgccttcgcctccgacgccgggaagctcttcggctggctcgccggggtggccgcgctgcacctcccgctctgggtggtcgcgctcaccggcgccgccttcggcctcgtcggctacggcgtccagttcctcttcctcgagaggcccgggctcgtgtactggcacctcttcctgctcacctccctcgccggcaacggcatctgctggatcaacaccgtgtgctacctcctctgcatcaacaacttcccctccgacagccgcgtcgccgtcagcctcgccacgagctatctcgggctcagcgccaagctctacaccaccgtggccgagaccctccccagggcggccagggccaggtactccaccaccaaggtgtacctcctcctcaatgccgtcgtcccgatggtcgtcacgctcgtggcggcgccgtccctccgggtgatcgacctcaaggaccgcaagaggaccgaggcgccgttcctcgccatgttcgtcatcaccctggccaccggagcctgcgccatcgtcggcagcgtaggcgccaagtccatcggcctctcgaccagggagcacattgtcagcttcttcgtgctgctcgccctgcctctgctgatcccggtggtgctcagggtcagggagagcatggccaagatacgggagaccaagtgggagaacaggatccacgaccacgactccgacggtcccgagacggcggtgtcggtgtcggtggtcgagattgaggtggaggacaaacaggaggaggagcaggggcaggagcccgagcaacagaggggtagtcaagaggaggtcggcggcctccgcctgctgaggaaacttgacttctggctctactttttcagctacatgttcagcggcacgcttgggctggtcttcctcaacaacctaggccagatcgccgagtcccgaggactcgccgacgcgtccaccctggtctccctgtcctcctcgttcggcttcttcggtcgcctccttccggccttcttggaccactatactgccaagagcggctactccctgtcgaggacggcgtccatggcgtcgctgatggcgcccatgtccggcgccttcttcctgctgctgcacccgcgggacatgttcctgtacgccagcacggcggtggtcggcacctgcacgggcgccatcacctcggtggcggcctcggcgaccaacgagctgttcggcaccaagaacttcggcgtcaaccacaacgtggtggtcgccaacatccccctgggctcgctctgcttcggctacctggcggggtacctgtaccagaggggcgcccgcggcggcaaccgctgcatgggcgccgcctgctaccgggacaccttcctcctctggggcgcgacctgcgccctgggcacggcgctgtgcgcggtgctgtacgcgcggtcgcgccgctccgccggggggctaccccgctagggcctaggactaggaggcgccatgcgtgtgcggcgctggttggctaacgtagacgatggtgatgatggtaacttgataagaactaagaaggggccagaagtttctgatgcccgaatttagctgcttaattcggtgccacacaattaagaggggaataagatacctagagagtaccgctatgctaggtgatttatagcatttttttttgttagtttgttgactcaacttacatgcactccctttggaggttttgaaaagccccatgcatgtgtatgcttacggatgaaaaggaacagagaacatgtaaacatattgcttggaatggcattcttttttgctcg

SEQ ID NO: 37628 - protein, 528 aa, Panicum virgatum
  misc_feature: Ceres CLONE 1990722
  misc_feature (8)..(254): Pfam Name: Nodulin-like Pfam Description: Nodulin-like
MPSPSSAHWLSLVGSVWLQSINGPNADFPVYSSQLKEVKGISQVRLNFLAFASDAGKLFGWLAGVAALHLPLWVVALTGAAFGLVGYGVQFLFLERPGLVYWHLFLLTSLAGNGICWINTVCYLLCINNFPSDSRVAVSLATSYLGLSAKLYTTVAETLPRAARARYSTTKVYLLLNAVVPMVVTLVAAPSLRVIDLKDRKRTEAPFLAMFVITLATGACAIVGSVGAKSIGLSTREHIVSFFVLLALPLLIPVVLRVRESMAKIRETKWENRIHDHDSDGPETAVSVSVVEIEVEDKQEEEQGQEPEQQRGSQEEVGGLRLLRKLDFWLYFFSYMFSGTLGLVFLNNLGQIAESRGLADASTLVSLSSSFGFFGRLLPAFLDHYTAKSGYSLSRTASMASLMAPMSGAFFLLLHPRDMFLYASTAVVGTCTGAITSVAASATNELFGTKNFGVNHNVVVANIPLGSLCFGYLAGYLYQRGARGGNRCMGAACYRDTFLLWGATCALGTALCAVLYARSRRSAGGLPR

SEQ ID NO: 37629 - DNA, 564 bp, Panicum virgatum
  misc_feature: Ceres CLONE 1990724
  misc_feature: Encodes the peptide sequence at SEQ ID NO. 37630
cccctccatttcttacccccacctcgaacactcgaacggtgggatcaaatttcctcttagccttcgtcccgcacccttgccgagtacatacagctgctcccacggatcgaggcggggaaagggaggaggaggctagggtcgctgccagctcgcgatggcggcggcgaggctgacccacaacgccatgacagcaaggctggcgggggacgtccacctcgggccggtggggcaggtcgcccacctccacagcatctcggtcaccggccccccgggtgccgggcccacgctccgcaccatcatctgcgacggcgtcgccacgacgcgtgcgctgttcaccgcgcatctctgcaagatcgcgcgctccggtctcgatggccgcggagcgatcgtgcagatcctcgactacatcatggaggacgtacgtggcaggagggctatggtcattcttagcatggaagttcttgttccagagtgcgagattattggaaatccagaattgcctcctgagtctgtggcttctatttccaattccatgaaagcagagcagtttaacagcgcgcctgg

SEQ ID NO: 37630 - protein, 136 aa, Panicum virgatum
  misc_feature: Ceres CLONE 1990724
  misc_feature (5)..(105): Pfam Name: Rep-A_N Pfam Description: Replication factor-A protein 1, N-terminal domain
MAAARLTHNAMTARLAGDVHLGPVGQVAHLHSISVTGPPGAGPTLRTIICDGVATTRALFTAHLCKIARSGLDGRGAIVQILDYIMEDVRGRRAMVILSMEVLVPECEIIGNPELPPESVASISNSMKAEQFNSAP

SEQ ID NO: 37631 - DNA, 575 bp, Panicum virgatum
  misc_feature: Ceres CLONE 1990740
  misc_feature: Encodes the peptide sequence at SEQ ID NO. 37632
cccctcccgttccccaattcgaaatcgaatcgagtcggtcgtgcgtgcgtgcgcgagcgattcgcccgcacaactcctcccccccccccccccccccccggtcctctcctcaccccaccccgccgccgccagctcgccccctagggttccgccgcgatgtctctccggccgagcgagcgggagcagatgcggaagggcaactacaagcagtcgggggacgcggacgagagccgccgccgccgcgagaatcagatggtggacatccgcaaggccaagcgcgaggagagcctccagaagaggcgccacgtcgggttccccgccgccggcgccgcgccggggggacactcctcggcgctccagcagaagctcgagggcttgccggcgttggtgcaggcggtgctctccaacgaccccaacgtgcagctggaggccaccacgcagttcaggaagctgctctccatcgagcgtagtcctccaattgaagaggttatcagcacaggagtggtgcctcggtttattgagttcctcacacgtgaggaccatccccaactccagtttgaggctgcttgggcgct

SEQ ID NO: 37632 - protein, 139 aa, Panicum virgatum
  misc_feature: Ceres CLONE 1990740
  misc_feature (4)..(95): Pfam Name: IBB Pfam Description: Importin beta binding domain
MSLRPSEREQMRKGNYKQSGDADESRRRRENQMVDIRKAKREESLQKRRHVGFPAAGAAPGGHSSALQQKLEGLPALVQAVLSNDPNVQLEATTQFRKLLSIERSPPIEEVISTGVVPRFIEFLTREDHPQLQFEAAWA

SEQ ID NO: 37633 - DNA, 1581 bp, Panicum virgatum
  misc_feature: Ceres CLONE 1990745
  misc_feature: Encodes the peptide sequence at SEQ ID NO. 37634
aacaaacgctaaaaaagtaacagtttctgtactttattggcgcgcggatggcagcggatgctgttgatgacggctcaccgcaatactttcgagttgtgaaagtccaccacgagcgaaattggctgcggcaaaagcgttcgctgattattacggcgacagccgtcttgaaagcggatgctgtgggggacgcggacacgtggcctcgagaaccctctgagcttcgcccgaccaagtcacatcccctggactcattggttggcttgagcctgacatcgcgcaacgatttttcgctacatttccgcggtgatcattcgtatcactattccagtcccgacgccgttgccatcgccaatcttctcgagcgacgtgttggtgtgttgaacgccgcacttgccctcgctccatcaaatccgcagcttatgttgagcgtgattcgtgaaggccgcattttgctgccctccgaatgcgatgtcgcgcaacttcaagttccgaaattagacttgattcagtcacttcgcgcatctgcgcttgacaagagcgatgacgtggaagctctccgtcggagattcgaggcgttaagcaactgcccaggaatgtggcctgccaatccgacaaacgacttccgcgccgccctagtcgcgttgaaggaaaacttgacgcaccagctcatgacgcgagaacgttcgctgttatcgaaattgcacggaaaggcagaacgccgcaaattgccgaagttcgaagatgccgacgacgcgaggctttgcgctgaagaaacacttcagtcgatgctgctgtcgcgccccgtgtttcacgtgctttggaccaacgttgctcaacgctacgcgcatgagcaagagatttttgatgggaacggcgatcgccttgcctcgcaacccgtcagctatttcggcatccaccgcgacttcgaagtggttcagtttgacctcgtgcgtcttcatttagcgaagctggagcggtgccacactccaagctcgatgttgtcagtcatccttgctgccgtgaagagtatcgtcacgtgcgtcgaggcgcactatctgatgtgtgaagaagacgccgcgcaagctgccgcctcgccgacaagcgaacactctatgtccaactcccggacatcaggcgagtacacgacggacgacgtgctcccgatgctcatctatatcatcgtatgcggcgcagtcaagaacctcgcggtggcgcggcggttcatcgaggcagttggcgatccgaacgaatcaaccgaacgcgcgtactacttcacggtgttttcgtcggccgtgcagttcctgatcgactggaaagatccggacgcgcggggcagccagtgtaccttagcggacagcgactgcgagcgaagcgacatggccatacgctcacagatgcactcccccttctcgacgccgcgcctcttcaaggaaccgtcgccgatctcgtcgcaattcaaccctggataaccagcgattgttgtgaataactcaacagggaagccgagagcagaaatcgaagtgccttcgagcacacgacttgacgacgctgttacaccccccgatgtgaagttcctgcttc

SEQ ID NO: 37634 - protein, 473 aa, Panicum virgatum
  misc_feature: Ceres CLONE 1990745
  misc_feature (298)..(424): Pfam Name: VPS9 Pfam Description: Vacuolar sorting protein 9 (VPS9) domain
MAADAVDDGSPQYFRVVKVHHERNWLRQKRSLIITATAVLKADAVGDADTWPREPSELRPTKSHPLDSLVGLSLTSRNDFSLHFRGDHSYHYSSPDAVAIANLLERRVGVLNAALALAPSNPQLMLSVIREGRILLPSECDVAQLQVPKLDLIQSLRASALDKSDDVEALRRRFEALSNCPGMWPANPTNDFRAALVALKENLTHQLMTRERSLLSKLHGKAERRKLPKFEDADDARLCAEETLQSMLLSRPVFHVLWTNVAQRYAHEQEIFDGNGDRLASQPVSYFGIHRDFEVVQFDLVRLHLAKLERCHTPSSMLSVILAAVKSIVTCVEAHYLMCEEDAAQAAASPTSEHSMSNSRTSGEYTTDDVLPMLIYIIVCGAVKNLAVARRFIEAVGDPNESTERAYYFTVFSSAVQFLIDWKDPDARGSQCTLADSDCERSDMAIRSQMHSPFSTPRLFKEPSPISSQFNPG

SEQ ID NO: 37635 - DNA, 724 bp, Panicum virgatum
  misc_feature: Ceres CLONE 1990746
  misc_feature: Encodes the peptide sequence at SEQ ID NO. 37636
acacagatacactcgtcgatccaccagaccaccactgtccagtgctcggctcggttacgcacgcacgcacacaaataggagtacctgttttacaccaccaagatactagcaagcccaagccgagtcgacaaacaagcagcaggaagaggcatggcgctcgcggaggggaacggcgcggccatcttcggcgaggaacaggaggcgctggtgctcaagtcgtgggccctcatgaagaaggactcggccgacctcggcctccgcttcttcctcaagatcttcgagatcgcgccgtcggcgaagcagatgttctcgttcctgcgcgactccgacgtgccgctggagaagaaccccaagctcaagacccacgccatgtccgtcttcgtcatgacctgcgaggcggcagtgcagctacggaaggccgggaaggtcaccgtcagggagacgacgctcaagcggctgggcgcaacgcacttcaagtacggcgtcgccgacggccacttcgaggtgacaaggttcgcgctgctggagacgataaaggaggcgcttcccgccgacatgtggagcctggagatgaagaacgcctggagcgaggcttacaaccagctcgtggcggccatcaagcaggagatgaagcctgccgcatgatgctgcatgctgctacatactcggcctccgagtcccccctacgatgcaccaccatctcccagttcttcatcgctatttt

SEQ ID NO: 37636 - protein, 164 aa, Panicum virgatum; identical to SEQ ID NO: 37625
  misc_feature: Ceres CLONE 1990746
  misc_feature (16)..(125): Pfam Name: Globin Pfam Description: Globin
  misc_feature: Useful for making plants with modulated cold sensitivity
  misc_feature: Useful for making plants with modulated salt sensitivity

SEQ ID NO: 37637 - DNA, 685 bp, Panicum virgatum
  misc_feature: Ceres CLONE 1990751
  misc_feature: Encodes the peptide sequence at SEQ ID NO. 37638
acactactgcacacgcgaccgacttgagagcaaagaaacctagccgagctaagctagcaagcacagaagccgatcgagcaaatatcggtcgatcggccatggctaataagaagcagcttgccgtcctcgtcgccttgctcgcgctcctcgttgggccatcggcgggcctgctcggcatcagcatcagcatcggcaccggcaccgactgcgtcgtcttcgttggttggccgcggcttttattcctgcgctctctcatctgcgggctcctgggccaaccctacacgcctcccatctggagggacccgcccacaggcgcagggctcagcgtcggctactacaacaactctgactacgccgactcctactgccccggcgcggaggcggccgtgaggacggccgtgcagagcgccatcgaccagcagggccgcggcatcggcgccggcctcatccgtctcttcttccacgacgccttcgtccgggggtgcgacgcgtccgtcctcctgcagagcacggccctcgccggcaccggcacggagatggagggggcccccaacaaggacagcctgcgcgggttcgaggtgatcgacgccgccaaggaggccaccaaggccgcctgcggcaacagggtgtcgtgcgccgacatcctcgccttcgccgcgcgcgacgcgtccgacatcctcagcgg

SEQ ID NO: 37638 - protein, 195 aa, Panicum virgatum
  misc_feature: Ceres CLONE 1990751
  misc_feature (97)..(195): Pfam Name: peroxidase Pfam Description: Peroxidase
  misc_feature: SWISSPROT Homolog: EC 1.11.1.7 Peroxidase
MANKKQLAVLVALLALLVGPSAGLLGISISIGTGTDCVVFVGWPRLLFLRSLICGLLGQPYTPPIWRDPPTGAGLSVGYYNNSDYADSYCPGAEAAVRTAVQSAIDQQGRGIGAGLIRLFFHDAFVRGCDASVLLQSTALAGTGTEMEGAPNKDSLRGFEVIDAAKEATKAACGNRVSCADILAFAARDASDILS

SEQ ID NO: 37639 - DNA, 706 bp, Panicum virgatum
  misc_feature: Ceres CLONE 1990757
  misc_feature: Encodes the peptide sequence at SEQ ID NO. 37640
aatctgctccggccaccgtcgccaaccatcagcggtgcagcacggcagccacgcccgcagcctgttcgacggaatgcctccggggagccaggaggacggggccgcatccatggaagctgccggctgcgaggaccggatcagtgccctcccggacgaggtcatccaccacctcctcggcctcctgccggcgccggaggccgtgcggacgagcctgctcgcgcggggctggcgccaccactggaggtccatgcgcagcctccgcttcaccgtgtccgacggcccggcgctgaccgccgagtggctgaaccggttcatgtcccgcctcctgcgcggccctctcgacgtctgcgacatctacgtcgagttcgggcagtgcgacgacgtcgctgcgctcgagtccaaccgctgggttcgccaggccgtgtgcaggcaccacgcgcgtgagctaatcgtcgacctcgagctcaactgcgacatgccctcctcctttttggcggggaagcctctcgcgtccaggcaccttgcgaggctggagctctgttacgtgctgttctgtgaccggatcctcgatttcgcaagatgctcggccttggaggacctgatgctgttcgcttgcgacatcggggctaagaagatctcatctccatccttgaagcggctgcggatcgattcctgtaatttctgtaagaggggttcccggacccgt

SEQ ID NO: 37640 - protein, 210 aa, Panicum virgatum
  misc_feature: Ceres CLONE 1990757
  misc_feature (20)..(67): Pfam Name: F-box Pfam Description: F-box domain
MPPGSQEDGAASMEAAGCEDRISALPDEVIHHLLGLLPAPEAVRTSLLARGWRHHWRSMRSLRFTVSDGPALTAEWLNRFMSRLLRGPLDVCDIYVEFGQCDDVAALESNRWVRQAVCRHHARELIVDLELNCDMPSSFLAGKPLASRHLARLELCYVLFCDRILDFARCSALEDLMLFACDIGAKKISSPSLKRLRIDSCNFCKRGSRT

SEQ ID NO: 37641 - DNA, 1836 bp, Panicum virgatum
  misc_feature: Ceres CLONE 1990761
  misc_feature: Encodes the peptide sequence at SEQ ID NO. 37642
gtgtgctcggatgcagcttcttttcttggttctgattgtcatcaaagcttcgccatgtctgataaatcttcaacctgatcaaattcataaccttgaatggacaataacaacaaaatggcataatccagatggggtttggaggatcgtctattgtatagaagatcgtcatcatccagaattgggttgtcaatttcctgggccaacaattaatgtggatggtgggaagcaattaaatgttacaattcagaatggattaatgttggaatctgtttcaatacattggcatgggatttcacaacagaattcggtttttatggatggagttgcttttgtaacccaatggccaatccctcctggtgggacatttacatattgctttactttgtcaaatgagtttggaacagcgtggtatcattcccatatggcaattcaatatggggacggattatttggtgcattaattgtaaaaaatccaaacgatccaaaatatccagaagatgtaataatgatctcagaatggtttcattgttccggaaatgaaattgaatctcgtcaacaccacgggttattcaatgaaccatttttagctggatttcctccattccaatctgcacttcttaatggaattggaagatttaattgtgctagtccatgtagaagaaattgtctagctgaatgtccaggggattgtgctggtgcaacagactgggttggagatttttatactctaacagcaacccaaaatgaaacaagaagattaagaataattggagcaacatctggatctccatttatattctcaatcgataatcataatttaaaagtttttgaaattgatggagaagccgttgagacatttctaactaatcaaataactgtttatgttggacaaagatatgatgtacttctagaaccaactcaagatattggaaattattggattcgcgcaaatactataaaatcaaatgaaacttacaaggaagaagcttttgggattttacattattcgggagcgccaaccccaaatgcaaccaatgtaaacacgcttgaatggaaaaaatcagtttctgatttaatctacacaactcaactctccccaccccaaaaaaaacaactcccccctccagacagaacaataatcctctacacagactgttctccactagacgcccacgaatgcaccttctcaggctaccaattcatgatgccaaaacaaccaacaatgttctcaaaaaaagaaccaatgctctatggaaaatcaatgatcccagatgacctaatcattgaaatcccatatggatcaatcgtccgtgtgatcctaaataaccttgacacccgtactcatccaatgcatcttcatggatttttttttgatgttcttggaattggaaaaaaaggagcaggaaatttctctgaagtgagggaccttctccaacaaaatccagttcatagagataccgatgaagttcatgaaaaatcatggtttgttttccaatttaatgcatcgaatgttggagattggttttttcattgtcatattgaatggcatatggaagctggtttatctcttttatttcgggttggagattcacttaatatgaagattccaaatgaaactcctttgattgcaagttggggatattttgaattattaaagggcagtgggattgttattccagggcctaaggaatcagttagtggaatttattatttattaacgatgctatttggaggtatttctgttattctatctgtcgttgtgttaatcttatcgatcctttattggaaatccccaacaaaaagagggtacaatgctattccttagggaaagttgac

SEQ ID NO: 37642 - protein, 604 aa, Panicum virgatum
  misc_feature: Ceres CLONE 1990761
  misc_feature (31)..(157): Pfam Name: Cu-oxidase_3 Pfam Description: Multicopper oxidase
  misc_feature (397)..(528): Pfam Name: Cu-oxidase_2 Pfam Description: Multicopper oxidase
  misc_feature (163)..(335): Pfam Name: Cu-oxidase Pfam Description: Multicopper oxidase
  misc_feature: SWISSPROT Homolog: EC 1.10.3.3 L-ascorbate oxidase
MQLLFLVLIVIKASPCLINLQPDQIHNLEWTITTKWHNPDGVWRIVYCIEDRHHPELGCQFPGPTINVDGGKQLNVTIQNGLMLESVSIHWHGISQQNSVFMDGVAFVTQWPIPPGGTFTYCFTLSNEFGTAWYHSHMAIQYGDGLFGALIVKNPNDPKYPEDVIMISEWFHCSGNEIESRQHHGLFNEPFLAGFPPFQSALLNGIGRFNCASPCRRNCLAECPGDCAGATDWVGDFYTLTATQNETRRLRIIGATSGSPFIFSIDNHNLKVFEIDGEAVETFLTNQITVYVGQRYDVLLEPTQDIGNYWIRANTIKSNETYKEEAFGILHYSGAPTPNATNVNTLEWKKSVSDLIYTTQLSPPQKKQLPPPDRTIILYTDCSPLDAHECTFSGYQFMMPKQPTMFSKKEPMLYGKSMIPDDLIIEIPYGSIVRVILNNLDTRTHPMHLHGFFFDVLGIGKKGAGNFSEVRDLLQQNPVHRDTDEVHEKSWFVFQFNASNVGDWFFHCHIEWHMEAGLSLLFRVGDSLNMKIPNETPLIASWGYFELLKGSGIVIPGPKESVSGIYYLLTMLFGGISVILSVVVLILSILYWKSPTKRGYNAIP

SEQ ID NO: 37643 - DNA, 1438 bp, Panicum virgatum
  misc_feature: Ceres CLONE 1990767
  misc_feature: Encodes the peptide sequence at SEQ ID NO. 37644
atactgatctcccatagcccaccaccccccacttgcggcctccatgtataaagccgcctccgcccgcctcctcctccgcagatccctctcctccgcctcctccgtgcccggcaagtcgcgcctcgccccctccgcccgcgccgccctctcctcgcgcccctgcgccgcgtgggtcggccgcgccgggctcgcgcgcgccgccgggaccgggccgcgcctcgccgccgccagggcgcagatcggggccggcgcgccagccgtcgagcggttccagcgcaggatggccacccaagcaactgagcatgccttcaagaatattctgaccagcctccctaagcctggaggtggtgaatatggaaagttctacagccttcctgcactaaatgatccaaggattgataaactgccctattccatccgtattcttctcgagtcagctatccgcaactgtgataactttcaagttaccacaaatgatgttgagaaaatcattgattgggaaaacacatctccaaagttggctgagataccattcaagccagcacgtgttcttcttcaggacttcactggagttccagcagttgttgatcttgcagctatgcgtgatgcgatggccaagttgggaagtgatgccaacaagatcaacccattggtcccagtggatcttgttattgatcactcagtgcaggtggatgtagcaaggtctcctaatgctgtacaagcaaacatggaattggaatttagtcgcaacaaagaaagatttggtttccttaaatggggctctagcgctttccaaaatatgcttgttgttccccctggttctggtattgtgcaccaggtcaaccttgaataccttggccgagttgttttcaacacagatggcattctctatcctgacagtgtagttggtactgattcacacaccacaatgattgatggtttgggtgttgctggttggggtgttgggggtattgaagctgaggctacaatgcttggtcagccaatgagcatggttttgcctggtgtggttggcttcaagttgactggaaagttacggagtggtgtcacagctacggaccttgttcttacagtgacacaaattctaaggaaacatggtgttgttggcaagtttgttgaattctatggtgaaggtatgggtaagctgtctttagctgacagggccacaattgcaaacatgtcaccagaatatggagctaccatgggcttctttcctgtggaccatgtgacattggactaccttaaactgacaggccgtagcgatgaaactgtgtcgatgattgaagcatatctgcgagccaacaagatgtttgtggactacaatgagcctcaaacagaacgagtttactcctcttatcttgagctggaccttgatgaggtggagcctagcatgtctggcccaaagaggcctcatgaccgt

SEQ ID NO: 37644 - protein, 385 aa, Panicum virgatum
  misc_feature: Ceres CLONE 1990767
  misc_feature (61)..(384): Pfam Name: Aconitase Pfam Description: Aconitase family (aconitate hydratase)
  misc_feature: SWISSPROT Homolog: EC 4.2.1.3 Aconitate hydratase
MATQATEHAFKNILTSLPKPGGGEYGKFYSLPALNDPRIDKLPYSIRILLESAIRNCDNFQVTTNDVEKIIDWENTSPKLAEIPFKPARVLLQDFTGVPAVVDLAAMRDAMAKLGSDANKINPLVPVDLVIDHSVQVDVARSPNAVQANMELEFSRNKERFGFLKWGSSAFQNMLVVPPGSGIVHQVNLEYLGRVVFNTDGILYPDSVVGTDSHTTMIDGLGVAGWGVGGIEAEATMLGQPMSMVLPGVVGFKLTGKLRSGVTATDLVLTVTQILRKHGVVGKFVEFYGEGMGKLSLADRATIANMSPEYGATMGFFPVDHVTLDYLKLTGRSDETVSMIEAYLRANKMFVDYNEPQTERVYSSYLELDLDEVEPSMSGPKRPHD

SEQ ID NO: 37645 - DNA, 712 bp, Panicum virgatum
  misc_feature: Ceres CLONE 1990767-R
  misc_feature: Encodes the peptide sequence at SEQ ID NO. 37646
cataattctcgctggtgctgagtacggaagtggcagttctcgtgattgggctgccaagggaccgatgctcctgggagttaaagctgtgattgccaagagttttgagcgtatccacagaagcaatttagtggggatgggaatcattcctctctgcttcaaagctggtgaggatgctgattcgctcggccttactgggcatgagcggtacagcatcaaccttcctaccaacctcagcgagatccgtcctggccaggatgtgactgtcacgaccgacaatgggaaatctttcacctgcacccttcgctttgacactgaggtggagctggcgtacttcaaccatggaggtattctcccctatgtcatccgcaacttggcgcagaactaaggcagattacaccgattcacccgtgatggcagatggctggctcgtcaccccacagggtggacggcctggttggatgtagagttttcgctatggatgtcagggcctttgtcgattcaatcctatcattaaactctgaaataaaagcctgaggtagcaggacccaccagcgggtgtgtgctgattgagcagcttcacctgatgtttggttacaatgatgaaccgtgtcatggaacagactgtcctgaaattcctgtttcacagacatgtagggcgcggtgtaaatgatttcggcgctagtgccatggttgtgctacattgcttatgctc

SEQ ID NO: 37646 - protein, 127 aa, Panicum virgatum
  misc_feature: Ceres CLONE 1990767-R
  misc_feature (1)..(55): Pfam Name: Aconitase_C Pfam Description: Aconitase C-terminal domain
  misc_feature: SWISSPROT Homolog: EC 4.2.1.3 Aconitate hydratase
IILAGAEYGSGSSRDWAAKGPMLLGVKAVIAKSFERIHRSNLVGMGIIPLCFKAGEDADSLGLTGHERYSINLPTNLSEIRPGQDVTVTTDNGKSFTCTLRFDTEVELAYFNHGGILPYVIRNLAQN

SEQ ID NO: 37647 - DNA, 722 bp, Panicum virgatum
  misc_feature: Ceres CLONE 1990771
  misc_feature: Encodes the peptide sequence at SEQ ID NO. 37648
atcctcgcatcccacgccactccctcccaatcccctcgcatccccaacaaccgcgccgcagcagtacttttgcgattcgttaggagggcgggcgagcgagcgcaaggccagatgtcgacgtgcgcggcggacctcgcgccgctgctgggcgcggcggcggcgaacgccacggactacctctgcagccagttcgcggacacggcgtcggcggtggacgccacgtacctgctcttctcggcgtacctcgtcttcgccatgcagctgggcttcgccatgctctgcgccggctccgtccgcgccaagaacaccatgaacatcatgctcaccaacgtgctcgacgccgccgcgggggcgctcttctactacctcttcggtttcgccttcgccttcggcacgccctccaacggcttcatcgggaagcagttcttcggcctcaagcacctgcccaggaccggcttcgactacgactacttcctctaccagtgggccttcgccatcgccgccgcgggcatcacgtcggggtccatcgccgagaggacgcagttcgtcgcctacctcatctactccgccttcctcacggggttcgtgtacccggtcgtgtcgcactggttctggtccaccgacgggtgggccgccgcgagccgcacgtccggcccgctcctcttcggctccggcgtcatcgacttcgccggctccggggtcgtccacatggtcggcggcgt

SEQ ID NO: 37648 - protein, 203 aa, Panicum virgatum
  misc_feature: Ceres CLONE 1990771
  misc_feature (36)..(203): Pfam Name: Ammonium_transp Pfam Description: Ammonium Transporter Family
  misc_feature: Useful for making plants with modulated carbon-nitrogen partitioning
  misc_feature: Useful for making plants with altered carbon content
  misc_feature: Useful for making plants with altered nitrogen content
MSTCAADLAPLLGAAAANATDYLCSQFADTASAVDATYLLFSAYLVFAMQLGFAMLCAGSVRAKNTMNIMLTNVLDAAAGALFYYLFGFAFAFGTPSNGFIGKQFFGLKHLPRTGFDYDYFLYQWAFAIAAAGITSGSIAERTQFVAYLIYSAFLTGFVYPVVSHWFWSTDGWAAASRTSGPLLFGSGVIDFAGSGVVHMVGG

SEQ ID NO: 37649 - DNA, 1448 bp, Panicum virgatum
  misc_feature: Ceres CLONE 1990772
  misc_feature: Encodes the peptide sequence at SEQ ID NO. 37650
agcggccgccctaggagcagtcgcttccgtctcgtgcccttcctcctcttccgcttcgccgccgaaccaaccaccgcacaccactttgccgccgcgttcccgacccttctcgcgccctcctccgtgcgcggccggcggccggcgtccaagaggccgccgatccaaaaggtcagatccgaaccccatcctggtccaaacccgcgccgaatttttctaggctttggtacggatctagggtttgcagcggaacctcgtgtggggctcgttcggttcgcttatggccgctgggcgccacggagggtacagggactacgaggcgagggagcgggagctcgacgcggaggcctccagaaggagtaaggagcagcagcaccatcttggcggcagccatcgcgacgcggaccgccgccgcgacggcgggcgcagcaggggtggcagggatttcgccaacggccacgttcgccgacgctcgccgccacccaggagccgcctcgcgggtaggctcggtgaccgtgagcctggtgaggtgctgagcggcagtgcgtccgatgactccggtggcaggccgcatagaggaaaagagaatggcgttcccagttctagcagggagggccaggctgcggccacatcggctatggctggtgcagcggtctcgtctcctagcaagaagaggaaattctctcctataatttgggacagggatagctcaaagccgccacattctgatgcaacaattggcaagaaagcggtagaatctgagcctgctgagctccgtccacctccaccattgcctccaaaagaccacgtcccagtgatattagctgtggagaagtcacctatggatgtggagcctactgttggtacagagagtgctgagcagttgccggaacatgaggagaatagggtggctgaggaggaagaggaatatccaacaatgaggaacatatcaacttcaagatgggctggtgctaatgatgacgaggaagatgttgctgcaccaatgaagaagaaaagtgcatcacctgcagactctgtgccagggcagtggaaaagggcaagcccagaacttggtgaggttgtggtcagtgatatctctggtggaaggaccatgtctaggtcatctgactcagggagaatgggtaacgacgagaaagaagattttgaagtagataaagatgactatatggatgttgacagggggcaggccagtgacagtgatgcacaaaatagaatgtcagatactgattcagaggatgaagcacgcagacctgaaacccctgaaccagtgaaggcaccacacaggtgtatcaatatgcttcaaggttgcagaagtgttgatgagtttgagaggctcaacaaaattaatgagggcacatatggtgttgtatatagagcaagggataagaagacaaatgagattgttgcactgaagaaggtaaaaatggaga

SEQ ID NO: 37650 - protein, 390 aa, Panicum virgatum
  misc_feature: Ceres CLONE 1990772
  misc_feature: SWISSPROT Homolog: EC 2.7.11.22 Cyclin-dependent kinase
MAAGRHGGYRDYEARERELDAEASRRSKEQQHHLGGSHRDADRRRDGGRSRGGRDFANGHVRRRSPPPRSRLAGRLGDREPGEVLSGSASDDSGGRPHRGKENGVPSSSREGQAAATSAMAGAAVSSPSKKRKFSPIIWDRDSSKPPHSDATIGKKAVESEPAELRPPPPLPPKDHVPVILAVEKSPMDVEPTVGTESAEQLPEHEENRVAEEEEEYPTMRNISTSRWAGANDDEEDVAAPMKKKSASPADSVPGQWKRASPELGEVVVSDISGGRTMSRSSDSGRMGNDEKEDFEVDKDDYMDVDRGQASDSDAQNRMSDTDSEDEARRPETPEPVKAPHRCINMLQGCRSVDEFERLNKINEGTYGVVYRARDKKTNEIVALKKVKME

SEQ ID NO: 37651 - DNA, 684 bp, Panicum virgatum
  misc_feature: Ceres CLONE 1990772-R
  misc_feature: Encodes the peptide sequence at SEQ ID NO. 37652
ctgggcgcccaaattctgtctgaagctggttttgatctgttgaacagtctgctaacttatgaccctgataagcgtatatcggcagatgatgctctgaagcacaaatggttctctgaagttcctctgcctaaatccaaggacttcatgccaacattccctgcacttaatgaactggacaggcgtaccaaacggtacatgaagagtcctgaccctctagaagagcaacgcttgaaagaactgcaagggaacataggcaaccgtggactttttggctgaacaaaacctgattgggttcctatccgtactaactgtcatgcttcaccctgaatcagcaaggtcagatatcttctgaggtgagatgtgccatggacatgaagtatcaatcttctcggtgtctagcagcgactgatagtgttctttagcaggcttggtgccggtttaagtggataaggtttctccttgtggcccatcatagaaattttgttgcaggaattaacacaccatccagattgatcctaaaagcaaatataatctacctgcatcgtaaggtgtggcgtgttggcttttattggttacaccagtttcacctttggaacttctgtatgtaaaatattccagattggtacgttgtaaacaatgttccgtgcgttggattaaaataaaacatcatcattattgttattc

SEQ ID NO: 37652 - protein, 91 aa, Panicum virgatum
  misc_feature: Ceres CLONE 1990772-R
  misc_feature: SWISSPROT Homolog: EC 2.7.11.22 Cyclin-dependent kinase
LGAQILSEAGFDLLNSLLTYDPDKRISADDALKHKWFSEVPLPKSKDFMPTFPALNELDRRTKRYMKSPDPLEEQRLKELQGNIGNRGLFG

SEQ ID NO: 37653 - DNA, 693 bp, Panicum virgatum
  misc_feature: Ceres CLONE 1990775
  misc_feature: Encodes the peptide sequence at SEQ ID NO. 37654
aatcgatcgtccccccaattgaaggtgaatccctccccacctcactcactgcctcccatccgccgccgccgccgccgccgccgccggagatgtcgcggacactggtgcagccggtggggcagaagcgcctcaccaacgtggcggtggtgcggctgcgcaagcacggccagcgcttcgagatcgcctgcttccccaacaaggtgctctcctggcgcgcctgcgtcgagaaggacctcgacgaggtgctccagtcccacaccgtctactccaacgtctccaagggcgtcctcgccaagtccaaggacctcgtcaaggcattcggcaccgacgaccagaccaaaatctgcatcgagattctcgagaaaggggagctccaggtctccggcaaggagagggaggcgcagctctccagccagttccgcgacatcgccaccatcgtcatggagaagaccatcaacccggagacgcgccgaccctacaccatcactatgatcgagcgcctcatgcacgagatacactttgccgtcgaccccaacctcacttccaaggagcaggctctaaaagttatcaagaagctcatcgagcactttcccataaagcgagcaccactgagggtgcggttcactgcaccaaagtccaactttgcaggccttatggaagaggttgctgaatggaatgctactgtcatttcaa

SEQ ID NO: 37654 - protein, 201 aa, Panicum virgatum
  misc_feature: Ceres CLONE 1990775
  misc_feature (15)..(105): Pfam Name: SBDS Pfam Description: Shwachman-Bodian-Diamond syndrome (SBDS) proteins
MSRTLVQPVGQKRLTNVAVVRLRKHGQRFEIACFPNKVLSWRACVEKDLDEVLQSHTVYSNVSKGVLAKSKDLVKAFGTDDQTKICIEILEKGELQVSGKEREAQLSSQFRDIATIVMEKTINPETRRPYTITMIERLMHEIHFAVDPNLTSKEQALKVIKKLIEHFPIKRAPLRVRFTAPKSNFAGLMEEVAEWNATVIS

SEQ ID NO: 37655 - DNA, 1466 bp, Panicum virgatum
  misc_feature: Ceres CLONE 1990776
  misc_feature: Encodes the peptide sequence at SEQ ID NO. 37656
agccccgccgctcgcccagcggccgccgcggcagtttcggctcgctctcgccggccgctgtctccgccgcggtcgtcggacgccccgacgcctcctcctccgcgcttgagcgaagccatcttcggcaccagcctcctcgccatccaccggacccaccaattcccaaaaccctagcgccaaaatcccccatttcggtcgcgccaatcggaaccggatttcctcggttcccggctggcgccggcggcgagttgagcctcgctctcgcctcgcctcaccacatgttgcagcgagcgcgtgccgtatctcgccgtgcatgaactctgcgatggatgagatcaacctgatgcggcaggcgcagcggcagcaccagcaccacctcatggtgcgcggcatgggcgaggagattgacctcgagatcggcccgggcgacgacccctccttctccggcgcagacctcgtcgccgtcgcttccgggcaccgcgacaacgtcgtccccaccgacgaacacaagaccctccttatcccatgctccggcgccgtggacgggcatgcgcagcctccggcgccgcagccaccactgctgcacggggaggagcatgacgggatactccggctgccttcggcgcacaccaagaagaagaaggtggtgaagaaatggcgggaggagtgggcggatacctacaagtgggcttatgtcgccgtgcacgacaacacccccaggatcttctgctcggtgtgcaaggagtacggccggaagcaccggcggaacccgtatggcaatgagggaagcaggaacatgcagatgagtgcgcttgaggagcacaacaatagcttgctgcataaggaggcccttcggttgcagatggcctccaaggagaagttgcagccccccgagatcgagaggccggtctatgtcaaagctttgtcgaaaacagctgcatcaatacttgaatctgtcctaaggagggatccctatgaagctgaatttatacagtcaatccaggaggtggttcattccttggaaccagttttggtgaagaacactcaatatgttcaaattttggagcgtttgttggaacctgagagatgctttatcttcagagtaccatggattgatgacagaggtgaagcacatgtcaatagaggtttccgtgtgcaattcagtcaggcattaggtccatgcaggggtgatcttcggtttcacccatccatgagcttaagtgtggcaaagtttctggcctttgaacatactttgaagaatgctttgttgttatataaacttggaggtgctgctggaggaagtgattttgatccaaagggtaaaagtgataatgagataatgcgtttttgtcaaagtttcatggatgagctatatagatatttgggccctgatcaggattttcccgctgaagacattggtgttggtccaagggaaatgggttacctttttgggcagtatagatgcc

SEQ ID NO: 37656 - protein, 380 aa, Panicum virgatum
  misc_feature: Ceres CLONE 1990776
  misc_feature (252)..(379): Pfam Name: ELFV_dehydrog_N Pfam Description: Glu/Leu/Phe/Val dehydrogenase, dimerisation domain
  misc_feature: SWISSPROT Homolog: EC 1.4.1.4 Glutamate dehydrogenase (NADP(+))
MDEINLMRQAQRQHQHHLMVRGMGEEIDLEIGPGDDPSFSGADLVAVASGHRDNVVPTDEHKTLLIPCSGAVDGHAQPPAPQPPLLHGEEHDGILRLPSAHTKKKKVVKKWREEWADTYKWAYVAVHDNTPRIFCSVCKEYGRKHRRNPYGNEGSRNMQMSALEEHNNSLLHKEALRLQMASKEKLQPPEIERPVYVKALSKTAASILESVLRRDPYEAEFIQSIQEVVHSLEPVLVKNTQYVQILERLLEPERCFIFRVPWIDDRGEAHVNRGFRVQFSQALGPCRGDLRFHPSMSLSVAKFLAFEHTLKNALLLYKLGGAAGGSDFDPKGKSDNEIMRFCQSFMDELYRYLGPDQDFPAEDIGVGPREMGYLFGQYRC

SEQ ID NO: 37657 - DNA, 699 bp, Panicum virgatum
  misc_feature: Ceres CLONE 1990776-R
  misc_feature: Encodes the peptide sequence at SEQ ID NO. 37658
gcaaagcaaactgctgctggtggggtagcctttggagaacttgaattgaaccccgagtttaatttgatgcagttgtcggtggaggattttgagaataaaatccaggatgcaataaagcaaacatacgaaaggtcaatcaaagctgctcaagattatggaatcatgaaagagaaccctgagtcattggtgcatggtgccaacatttgtgctttccataatattgcccaagccatgaccgatcaaggatgtgtctagttagacctttgatttagtcaaggagctacaactagagtgtcctgcaactgtgcagggggaaaatataattttctgctaagtgcttcgacaccttcagcttgtgctactataaatcgtggagcactccaaaatgcaaagtacttggaattcacccttggcttatgctagaaaatgggtgactcacaagagcttcccttgatctggaaggaaagccagctcaggttgtagatccccgatgtattatccattgttataaacatcaatttcaatgggaagtaaatagaagcaattcttttgtatgcatagcccatacttgttagtccactgataggttgacaattgtgtaacagatgtaaatctacaggtagatctagcaatgactccgatgaacctgctatatgtaattgttgaatccccataaggcaagacaaatcgaactttgat

SEQ ID NO: 37658 - protein, 84 aa, Panicum virgatum
  misc_feature: Ceres CLONE 1990776-R
  misc_feature: SWISSPROT Homolog: EC 1.4.1.4 Glutamate dehydrogenase (NADP(+))
AKQTAAGGVAFGELELNPEFNLMQLSVEDFENKIQDAIKQTYERSIKAAQDYGIMKENPESLVHGANICAFHNIAQAMTDQGCV

SEQ ID NO: 37659 - DNA, 701 bp, Panicum virgatum
  misc_feature: Ceres CLONE 1990777
  misc_feature: Encodes the peptide sequence at SEQ ID NO. 37660
cgtcccgaaccgaaccaaaatcttagcagtgcacgccacacgcccacaccaccacagagttgctgcgcagccctagctagatcgagcaccctactcccgcaatgtctcccacgatggcatcgtcgctcagtgtattcgcggcgatgtccggcgtcgccgccgggcggcctgctggcagcagtggcgcggcggtgcccggtcgtctggcgaccagccagcaggggggcggcaagggcaagcgcgccgtggcgcagcctctcgcggctagcgccgcgacggagacgccggcgccggcgccggtcgcagccccggccctgccggcgggtaggcccgcggtcgtcgacgccccgcgccgccgtggaggccgcggcgccggcagcgggcacgcggcgtggaagagcgtccggcaggagaggtgggagggggccctggaggtggaaggggagctgccgctctggctggacggcacgtacctgaggaacgggccgggcctgtggaacctgggcgactacggcttccggcacctgttcgacgggtacgcgacgctggtgcgcgtctcgttccgcaacgggcgcgcggtgggcgcgcaccggcagatcgagtcggaggcgtacaaggcggcgcgcgcgcacggcaaggtgtgctaccgcgagttctccgaggtgcccaagcccgatagcttcctctccgccgtgggccag

SEQ ID NO: 37660 - protein, 195 aa, Panicum virgatum
  misc_feature: Ceres CLONE 1990777
  misc_feature: SWISSPROT Homolog: EC 1.14.99.36 Beta-carotene 15,15'-monooxygenase
MASSLSVFAAMSGVAAGRPAGSSGAAVPGRLATSQQGGGKGKRAVAQPLAASAATETPAPAPVAAPALPAGRPAVVDAPRRRGGRGAGSGHAAWKSVRQERWEGALEVEGELPLWLDGTYLRNGPGLWNLGDYGFRHLFDGYATLVRVSFRNGRAVGAHRQIESEAYKAARAHGKVCYREFSEVPKPDSFLSAVG

SEQ ID NO: 37661 - DNA, 681 bp, Panicum virgatum
  misc_feature: Ceres CLONE 1990779
  misc_feature: Encodes the peptide sequence at SEQ ID NO. 37662
accactctagagtctcccacatcactcgaaatggcacccaagaataaattcgagctcaagacccccaagggtacaaaggactgggaggggaaggatatggttatccgtgaccacatcttcaacaccatcacccaagtcttcaagcgccacggaggagtcacgatcgatacccccgtctttgagctccgagagatcctcgctggaaaatatggagaggacagcaagctcatctatgaccttgccgatcaaggtggtgagatctgctctctgcgatatgacttgactgtcccctttgcacgcttcctagccatgaacaagcagattcaaaacatcaagagatatcacatcgccaaggtctaccgccgagaccaacctgccatgaccaagggtcgcatgcgagaattctatcagtgcgatttcgacattgccggcacctacgaccccatgctgcccgacgccgaagtcatccgcattattacagaagtatttgagggacttggttggaacggtggatacacgatcaagctaaatcaccgaaagattcttgacggtattttccaagtctgtggagtccctgaggacaagatacgcaccatttcctcggccgttgacaagcttgacaagctgccttgggctgatgtgcgaaaggagatgaccgaggaaaagggacttgacggtgat

SEQ ID NO: 37662 - protein, 226 aa, Panicum virgatum
  misc_feature: Ceres CLONE 1990779
  misc_feature (35)..(199): Pfam Name: tRNA-synt_2b Pfam Description: tRNA synthetase class II core domain (G, H, P, S and T)
  misc_feature: SWISSPROT Homolog: EC 6.1.1.21 Histidine--tRNA ligase
TTLESPTSLEMAPKNKFELKTPKGTKDWEGKDMVIRDHIFNTITQVFKRHGGVTIDTPVFELREILAGKYGEDSKLIYDLADQGGEICSLRYDLTVPFARFLAMNKQIQNIKRYHIAKVYRRDQPAMTKGRMREFYQCDFDIAGTYDPMLPDAEVIRIITEVFEGLGWNGGYTIKLNHRKILDGIFQVCGVPEDKIRTISSAVDKLDKLPWADVRKEMTEEKGLDG

SEQ ID NO: 37663 - DNA, 734 bp, Panicum virgatum
  misc_feature: Ceres CLONE 1990791
  misc_feature: Encodes the peptide sequence at SEQ ID NO. 37664
actgcactcagcttcttgttgagcaccactctactgagttgagttgagacagagaaagcagagcgcgcggcagcaatgggtagcagggacctgtgctgccagctgacgaccctgctcctcctcctggggctggcgtccggccaggtcctgttccaggggttcaactgggagtcgtggaagcagagcggcgggtggtacaacctcctgatggggaaggtcgacgacatcgccgccgccggcgtcacgcacgtctggctcccgccgccgtcgcactccgtctccacccaaggttacatgcctggtcggctttacgacctggacgcgtccaagtacgggacggcggcggagctcaagtccctgatcgccgcgttccacggcaagggcgtgcaggcggtggcggacatcgtcatcaaccaccggtgcgccgactacaaggattcccgcggcatctactgcatctacgagggcgggacgcccgacagccgcctcgactgggggccccacatgatctgccgcgacgacacccagtactcggacggcacgggcaacctcgacaccggcgccgacttcgccgcggcgccggacatcgaccacctcgacgaccgcgtccagcgcgagctcaccgagtggctgctctggctcaagtccgacatcggcttcgacgcctggcgcctcgacttcgccaggggctactcggccgaggtcgccaaggtatacgtcgacggcacggcccc

SEQ ID NO: 37664 - protein, 219 aa, Panicum virgatum
  misc_feature: Ceres CLONE 1990791
  misc_feature (23)..(219): Pfam Name: Alpha-amylase Pfam Description: Alpha amylase, catalytic domain
  misc_feature: SWISSPROT Homolog: EC 3.2.1.1 Alpha-amylase
MGSRDLCCQLTTLLLLLGLASGQVLFQGFNWESWKQSGGWYNLLMGKVDDIAAAGVTHVWLPPPSHSVSTQGYMPGRLYDLDASKYGTAAELKSLIAAFHGKGVQAVADIVINHRCADYKDSRGIYCIYEGGTPDSRLDWGPHMICRDDTQYSDGTGNLDTGADFAAAPDIDHLDDRVQRELTEWLLWLKSDIGFDAWRLDFARGYSAEVAKVYVDGTA

SEQ ID NO: 37665 - DNA, 735 bp, Panicum virgatum
  misc_feature: Ceres CLONE 1990794
  misc_feature: Encodes the peptide sequence at SEQ ID NO. 37666
tcctctgcacacacccacaactcgtaggcagcgagcgtctccccctctgccccccgcaggaagagagagcgagatcgccgtctcgcttcgtcggtggtgcgggtgcccgccctccccgagcgagatccccctgcagttcctcgagatctggtcacagatctagctgtcaagatggtgaagatctgctgcatcggtgctggctatgtcggtggcccgaccatggccgtcattgccctcaagtgcccagacattgaggtcgtcgtcgtcgacatctccaagccccgcattgaggcctggaacagtgacaccctccccatctacgggcctggtctcgatgatgttgtgaagcagtgcaggggcaggaacctcttcttcagcactgatgttgagaagcacgtcgctgaggctgacatcatctttgtctcggtgaacacccccaccaagacccgtggtcttggagctggcaaggctgccgacctcacatactgggagagcgctgctcgcatgatcgctgatgtctccaagtctgacaagattgttgttgagaagtccactgtccctgtcaagactgctgaggctattgagaagatcttgacccacaacagcaagggcatcaactaccagatcctctccaacccagagttccttgcggagggcactgctattgaggacctgttcaagcctgacagagtgctcatcggtggccgggagacccctgagggcaggaaggccgtc

SEQ ID NO: 37666 - protein, 187 aa, Panicum virgatum
  misc_feature: Ceres CLONE 1990794
  misc_feature (2)..(187): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature: Useful for making plants with altered carbohydrate content
  misc_feature: Useful for making plants with altered cell wall content and/or composition
MVKICCIGAGYVGGPTMAVIALKCPDIEVVVVDISKPRIEAWNSDTLPIYGPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKA

SEQ ID NO: 37667 - DNA, 1858 bp, Panicum virgatum
  misc_feature: Ceres CLONE 1990813
  misc_feature: Encodes the peptide sequence at SEQ ID NO. 37668
gcccgctcccctggcccttcttcagatacaccgccagcgccgtgtggccggggccagtacactccactgcagcaaagcccctgctctgctcgctcgctagccatggcgcctctcgcggcgctgctcctcctcctcctgctcgccgcgtcctccaatgccgccgcgctcgccaagcccctggagtaccacagcttcgcggccaccccgctctcgccccactcgtacaccgccccggcagcctcgccgccgtcgcggcgggcgaggaggagcccgcggtgcgcttccgcgtggtccaccgcgacgcgttcgcggtgaacgccaccgcggccgagctgctcaggcaccgcctgcggcgggacaggcggcgggccgcgcggatctcgaaggcggccgccggcggcgcggcggccaacgggacgcgggccggcggcggcggaggggtcgcggcgcccgtggtgtccgggctcgcgcaggggagcggcgagtacttcaccaagatcggcgtgggcacgcccgccacgccggcgctcatggtgctggacaccggcagcgacgtggtgtggctgcagtgcgccccctgccgccggtgctacgaccagtcgggccccgtcttcgacccgcgtcgctccagctcgtacggcgccgtcggctgcgccgcgccgctgtgccgcaggctcgactcgggcggctgcgacctgcgccgccgggcctgcctgtaccaggtggcctacggcgacgggtccgtgacggcgggcgacttcgccaccgagacgctcaccttcgcgggcggcgcccgcgtggcgcgcgtggcgctcgggtgcggccacgacaacgagggcctgttcgtggccgccgcggggcttctgggcctgggccgcggcagcctgtcgttcccgacccagatctcccgccgctacggccggagcttctcctactgcctcgtcgaccgcacctcgtcgtcgtcgtcgtcgtcttcgggcacaggcagcagcccgggctcccgctcctccaccgtcaccttcgggccggccgccgtggcgccctccgcgtcggcgtccttcaccccgatggtccgcaacccgcgcatggagacgttctactacgtgcagctggtcggcatcagcgtgggcggcgcgcgcgtcccgggcgtcgccgagtcggaccttcgcctggacccctcctcgggccgcggcggcgtcatcgtggactcgggcacctccgtcacccgcctcgcccggcccgcctactccgcgctccgcgacgcgttccgcggcgccgcggcggggctccggctcgcccccggcggcttctccctcttcgacacgtgctacgacctgggcgggcgcaaggtggtgaaggtgcccacggtgtcgatgcacttcgcgggcggcgccgaggccgccctgccccccgagaactacctcatccccgtcgactcgaggggcaccttctgcttcgccttcgccggcaccgacggcggcgtgtccatcatcggcaacatccagcagcaggggttccgcgtggtgttcgacggcgacggccagcgcgtcgggttcgcgcccaagggctgctgagctgagcagcagcggtggcgcggttaattaattagcaggtgattagcgggtaaaagaagggagccgccttgttagtcataattaacggagggtgtcagtgagcgagctttggatgctgtgagaaaggtcaagagctgggccttgtctctcttggcagtgggaatgtaccagaagtagctttggtgcgcgagaggatatcaggataaggcggttggttgatgaaggctgtgaaaggccctgtgaaagtgtctgggctaaaaaaaaagagtgtgctttggccctct

SEQ ID NO: 37668 - protein, 523 aa, Panicum virgatum
  misc_feature: Ceres CLONE 1990813
  misc_feature (161)..(521): Pfam Name: Asp Pfam Description: Eukaryotic aspartyl protease
  misc_feature (151)..(313): SWISSPROT Homolog: EC 3.4.23.12 Nepenthesin
  misc_feature (359)..(519): SWISSPROT Homolog: EC 3.4.23.5 Cathepsin D
  misc_feature: Useful for making plants with modulated biomass
PLPWPFFRYTASAVWPGPVHSTAAKPLLCSLASHGASRGAAPPPPARRVLQCRRARQAPGVPQLRGHPALAPLVHRPGSLAAVAAGEEEPAVRFRVVHRDAFAVNATAAELLRHRLRRDRRRAARISKAAAGGAAANGTRAGGGGGVAAPVVSGLAQGSGEYFTKIGVGTPATPALMVLDTGSDVVWLQCAPCRRCYDQSGPVFDPRRSSSYGAVGCAAPLCRRLDSGGCDLRRRACLYQVAYGDGSVTAGDFATETLTFAGGARVARVALGCGHDNEGLFVAAAGLLGLGRGSLSFPTQISRRYGRSFSYCLVDRTSSSSSSSSGTGSSPGSRSSTVTFGPAAVAPSASASFTPMVRNPRMETFYYVQLVGISVGGARVPGVAESDLRLDPSSGRGGVIVDSGTSVTRLARPAYSALRDAFRGAAAGLRLAPGGFSLFDTCYDLGGRKVVKVPTVSMHFAGGAEAALPPENYLIPVDSRGTFCFAFAGTDGGVSIIGNIQQQGFRVVFDGDGQRVGFAPKGC

SEQ ID NO: 37669 - DNA, 728 bp, Panicum virgatum
  misc_feature: Ceres CLONE 1990819
  misc_feature: Encodes the peptide sequence at SEQ ID NO. 37670
aattttccgcgctgcgcttgtagacatctatccagcagagcgcagcaggatggtgtacgcgctcctgctggtcgccttggcggccgtcgccgccgcggcggtgctccgccactacctcccgctgctccgcggcggcctccccaagggcagcttcggctggcccctcatcggcgagaccatcggcttccttcacgcgcacccgtccaacaccgccggcggcttcctcaaggagcacgtcgccaggtacgggacggtgttcaagtcgcacctcttcggctcgccggcggtggtctcctgcgacgaggagctcaaccacttcgtgctgcacaacgaggagcgcctgttcgagtgcagctaccccggcgccatccgcaccatcctcggcgagtcctccgcgctggtggtcaccggcgagcgccaccgccagatccggagcatgttcctcgccctcgtcgcctccacggggctcaaggcctcctacgtcgccagcgtcgacgagtccgcccgctccctcatcgcgtcctggcgcggccgcgagaccatcagcttctgcgaggaggcgaggaagttcccctacaaggtgatcatggagcaggtgctgggcctgccgccggacggcccggtggccctccggatcctggaagagtaccagatcttcatgaaggggatcatctccctccctatcaccctcccccgggacagcattttccaaggccgtcaaggcaagg

SEQ ID NO: 37670 - protein, 226 aa, Panicum virgatum
  misc_feature: Ceres CLONE 1990819
  misc_feature: SWISSPROT Homolog: EC 1.14.13.77 Taxane 13-alpha-hydroxylase
  misc_feature: Useful for making plants with modulated oxidative stress sensitivity
MVYALLLVALAAVAAAAVLRHYLPLLRGGLPKGSFGWPLIGETIGFLHAHPSNTAGGFLKEHVARYGTVFKSHLFGSPAVVSCDEELNHFVLHNEERLFECSYPGAIRTILGESSALVVTGERHRQIRSMFLALVASTGLKASYVASVDESARSLIASWRGRETISFCEEARKFPYKVIMEQVLGLPPDGPVALRILEEYQIFMKGIISLPITLPRDSIFQGRQGK

SEQ ID NO: 37671 - DNA, 693 bp, Panicum virgatum
  misc_feature: Ceres CLONE 1990841
  misc_feature: Encodes the peptide sequence at SEQ ID NO. 37672
gagtagggagggagaggcgccggcagatcgatcggggaggcgcgcgcgggctcggcggccggttgctgctatggcggaggcggtgcgggagctgcgcgcgagcttcgcggcggggcggacgcggccggcggagtggcgggcggcgcagctccgggcgctggtgcggatgatcgacgagcgggaggccgacatcaccgccgcgctccacgacgacctcgccaagccgcacatggagtcgtacctccacgagatatcgctcgcgaagtcctcgtgcaagttcgcgctcaacgggctcaagaactggatgaagccagagaaggtacctgcggccataactacgttcccgtcctctgcgcaaatcgtgcctgagcccctcggtgtggtgctcgtcatctccgcctggaactacccattcctgctctctattgatccggtgattggagcaatagctgctggaaatgctgttgttctgaagccatcagaaatagcgccggcaacctcgtcaatgttcgcaaagctgctacctgagtatgttgacagtacatgtattaaagttgtagaggggggtgttgaggaaacgaccgcgctcttggaacaaagatgggataagatcttctacacaggtagcgggactgtagcacgcatagttttgggcagcgccgcaaagcatctgaccccggtggctctggagct

SEQ ID NO: 37672 - protein, 207 aa, Panicum virgatum
  misc_feature: Ceres CLONE 1990841
  misc_feature: SWISSPROT Homolog: EC 1.2.1.3 Aldehyde dehydrogenase (NAD(+))
MAEAVRELRASFAAGRTRPAEWRAAQLRALVRMIDEREADITAALHDDLAKPHMESYLHEISLAKSSCKFALNGLKNWMKPEKVPAAITTFPSSAQIVPEPLGVVLVISAWNYPFLLSIDPVIGAIAAGNAVVLKPSEIAPATSSMFAKLLPEYVDSTCIKVVEGGVEETTALLEQRWDKIFYTGSGTVARIVLGSAAKHLTPVALE

SEQ ID NO: 37673 - DNA, 729 bp, Panicum virgatum
  misc_feature: Ceres CLONE 1990848
  misc_feature: Encodes the peptide sequence at SEQ ID NO. 37674
ggaaaaccccactcaacccaggcatggcttcgtccggcgaccacgccgcggccgccaagcacctcagggtgctgctgccgttcacctgcgacagtctgcgcatccccgacgagctcgccgaggagatcggcgccgaggaggccctcgtcgttggcccgatgggcggcaatggcaaggtcttatggcgcgtcgaggtcgggcgcgacggcaacggcgcgttcctgggccgcggctggcccgagctcgccgacgcgtgcggcgtcggcgcagggtggctcctcgtcctccgccaccgcggccgcggcgtgctgacggtcaaggccttcgaccgcacccgctgcctcagggacctcggcgctcccgctccgtctccagctgaagcagccgtgagtggcaaagccaccgctcgtaagccacagttcatcattgtgctttcaaccgatttcatggaaaagatgccaatacctgctaagtttctgcaacagcacatccccaaagagcaccagaacaattgtatggccattgttctgggcccccatggcaaagtttataacattaaacttgagacatatcgatcggacatgttcttcacaggtggctggtcgcagtttatggtgtttcatgacattacggaatctaatgccctgctggtgaggtatgagggcaacatggttttcactgtcaaagtgtttggcactgatggaattccgagagattccaagcagaagg

SEQ ID NO: 37674 - protein, 235 aa, Panicum virgatum
  misc_feature: Ceres CLONE 1990848
  misc_feature (132)..(228): Pfam Name: B3 Pfam Description: B3 DNA binding domain
  misc_feature (15)..(106): Pfam Name: B3 Pfam Description: B3 DNA binding domain
MASSGDHAAAAKHLRVLLPFTCDSLRIPDELAEEIGAEEALVVGPMGGNGKVLWRVEVGRDGNGAFLGRGWPELADACGVGAGWLLVLRHRGRGVLTVKAFDRTRCLRDLGAPAPSPAEAAVSGKATARKPQFIIVLSTDFMEKMPIPAKFLQQHIPKEHQNNCMAIVLGPHGKVYNIKLETYRSDMFFTGGWSQFMVFHDITESNALLVRYEGNMVFTVKVFGTDGIPRDSKQK

SEQ ID NO: 37675 - DNA, 634 bp, Panicum virgatum
  misc_feature: Ceres CLONE 1990859
  misc_feature: Encodes the peptide sequence at SEQ ID NO. 37676
ccggcggtcaaggagttctcgctggaggagctgcgcgccgccacgggcggcttcgcgccggagaacatcgtctccgagagcggcgagaaggcgccgaatttcgtgtacaagggccgcctcgaggccacccgccgcgcgatcgccgtcaagaagttcaccaagatggcctggcccgatgtcaagcagttcgcggaggaggccaggggggtcggcaagctgcgacactgccgcatggccaacctgatcggctactgctgcgacggggacgagcgcctgctcgtcgccgagttcatgcccaacgacacgctcgccaagcacctcttccactgggaaaaccagacacttgaatgggctatgcgtctaagagttgcatactacatcgctgaagcactggagtattgcagcaatgagggaaggcctctgtatcacgacctaaattcatacagggttctctttgatgaggtaagaaactatttctttatgtttttttatcctaacagcctagatttttttttttggaaaattgccaatgtactataatatcatgaagatgtggaaacgaggataatattgttttttggtaaatatctctgctacaacagcaagtattgctgggttcctctgggaatggtcc

SEQ ID NO: 37676 - protein, 179 aa, Panicum virgatum
  misc_feature: Ceres CLONE 1990859
  misc_feature: SWISSPROT Homolog: EC 2.7.11.1 Non-specific serine/threonine protein kinase
PAVKEFSLEELRAATGGFAPENIVSESGEKAPNFVYKGRLEATRRAIAVKKFTKMAWPDVKQFAEEARGVGKLRHCRMANLIGYCCDGDERLLVAEFMPNDTLAKHLFHWENQTLEWAMRLRVAYYIAEALEYCSNEGRPLYHDLNSYRVLFDEVRNYFFMFFYPNSLDFFFWKIANVL

SEQ ID NO: 37677 - DNA, 706 bp, Panicum virgatum
  misc_feature: Ceres CLONE 1990873
  misc_feature: Encodes the peptide sequence at SEQ ID NO. 37678
ggcatcatcagcgcaaacgatcgatcacacggctggctgcagatcgcgagagagctcggcaaaaggcaatgcacgggatggtgaagaagaagacgttgccggcggcggcggcggtggtcctggccctggtcctgtcggcggcggcggcggtctccgggcagcagccggcgccggggaagcagacggcggcgaacaacccgcgactgcagcgggcgtacgtggctctgcaggcgctgaagcgcgccatcacggaggaccccaagaacctgacgcgcgggtggtgcggccccgacgtgtgcgcctacttcggcgtcttctgcgcggcggcgccggacgacccgcacgcgctcaccgtcgccgggctggacctcaaccacggcgacctggcggggaccttcccggaggagctcggcctgctctcggacctcgcgctgctgcacctcaactccaaccgcttcgccggcggcctgccggagtcgctgcccaagctccgcctcctccacgagctcgacgtcagcaacaaccgcctctccggcgggttcccgcagcacatcctctgcctgcccaacgtcaagtacgtcgacctccggttcaacaacctctgcgggcccgtgccgccggccatcttcgacaagccgctcgacgcgctcttcctcaacgacaaccacttcgacttcgagctgccggagaacctcgggcactcgcc

SEQ ID NO: 37678 - protein, 209 aa, Panicum virgatum
  misc_feature: Ceres CLONE 1990873
  misc_feature: SWISSPROT Homolog: EC 2.7.11.1 Non-specific serine/threonine protein kinase
  misc_feature: Useful for making plants with altered carbohydrate content
MVKKKTLPAAAAVVLALVLSAAAAVSGQQPAPGKQTAANNPRLQRAYVALQALKRAITEDPKNLTRGWCGPDVCAYFGVFCAAAPDDPHALTVAGLDLNHGDLAGTFPEELGLLSDLALLHLNSNRFAGGLPESLPKLRLLHELDVSNNRLSGGFPQHILCLPNVKYVDLRFNNLCGPVPPAIFDKPLDALFLNDNHFDFELPENLGHS

SEQ ID NO: 37679 - DNA, 717 bp, Panicum virgatum
  misc_feature: Ceres CLONE 1990887
  misc_feature: Encodes the peptide sequence at SEQ ID NO. 37680
atgcgctgcctccctccactacgcccgcgcgcgctccctccctccctcccctcccctccaccaccacaagcaccgcgtcgacaccacctgccatcgccgcgccgagctcagcctctagctagctgcgccaggagggcacccgcctcgctccctccctgccgacgccagtgcgatggagctgcacaagtactggggcgtggggggccggcggtgcggcggctgcgaggcggccccggcggcggtgcactgccgctcgtgccccgccaccgccgggggcgcgttcctctgcgctgcgtgcgacgcgcgcccggggcacgcgcggctgggccacgagcgcgtgtggatgtgcgaggtctgcgagctggcccccgccgccgtcacctgcaaggccgacgccgccgtgctctgcgccgcctgcgacgccgacatccacgacgccaacccgctggcgcgccgccatgcgcgcgtccccgtcgcgcccatcgggtccgaggccgccgccgccgtcgtcgaggccatgctgttcgggaccggcgacggcgacccggccgcgcccgaggccgaggagccgcaggacgcggcggccgggcacgggcacgggcagctccagcaccaccaccagcacgcgctgaacctcaacgtggaggccaaggacatgaagctggactaccttttctccgacctgggacccctacctcagcgtcgacatcccgcgct

SEQ ID NO: 37680 - protein, 181 aa, Panicum virgatum
  misc_feature: Ceres CLONE 1990887
  misc_feature (54)..(101): Pfam Name: zf-B_box Pfam Description: B-box zinc finger
MELHKYWGVGGRRCGGCEAAPAAVHCRSCPATAGGAFLCAACDARPGHARLGHERVWMCEVCELAPAAVTCKADAAVLCAACDADIHDANPLARRHARVPVAPIGSEAAAAVVEAMLFGTGDGDPAAPEAEEPQDAAAGHGHGQLQHHHQHALNLNVEAKDMKLDYLFSDLGPLPQRRHPA

SEQ ID NO: 37681 - DNA, 632 bp, Panicum virgatum
  misc_feature: Ceres CLONE 1990893
  misc_feature: Encodes the peptide sequence at SEQ ID NO. 37682
atccgaggcgagctgcgggaaaatccttgggcttgccgggagtctggtcgcggcggctgctctgggaatgaggttctgattgttctcgcggctgcaagttcgttgaattcaacaggagctggcggtcatccaaccgcccccgaccggatagaggagaaaggcgtccacgcattggagcgggggtcgaggaaacggcgcaactctccctcgcattgctcgcggcgaaattttgcaatttggatgggggcgggggcgtcgagcatggtggggccggaggggtacggccgcgggtgggggcagacgtcgctgggcgacatgccggagagctgcgtggcggcggtgctgctctacctcgacccgctggagatctgccaggtggcctgcctcaaccgggcgttccggggtgcggcctccgcggactgcatctgggcctccaagctgcccgccaaccaccggtacctcgccgcgctggccgccgcggccgacgacgactgcggctgcgacggcgcggccgagggcaatggcaggtgctgctcctcggccgcgatcaagaaggagatatacgcgcgcctgtgccggcccaccccattcgacggcggcaccaaggaattttggattgagaaggacaaggg

SEQ ID NO: 37682 - protein, 130 aa, Panicum virgatum
  misc_feature: Ceres CLONE 1990893
  misc_feature (21)..(68): Pfam Name: F-box Pfam Description: F-box domain
MGAGASSMVGPEGYGRGWGQTSLGDMPESCVAAVLLYLDPLEICQVACLNRAFRGAASADCIWASKLPANHRYLAALAAAADDDCGCDGAAEGNGRCCSSAAIKKEIYARLCRPTPFDGGTKEFWIEKDK

SEQ ID NO: 37683 - DNA, 570 bp, Panicum virgatum
  misc_feature: Ceres CLONE 1990895
  misc_feature: Encodes the peptide sequence at SEQ ID NO. 37684
aactggtggtgtcctttggagctgagctagagcacatccgtgaaggcccttgtgttcagtgatttgatgtcctccgttatcctttactgaagaaactgcaaccagatacgaggtgaggtgatcagtctaagtattactttaagagaggtcattttgagcatgttatgatggagctctaccctggataccttgaagatcatttcaaccttcacaagcttagcatcggcgccgccgcctccccgccggagtacatgacctctgcgcccgcggtgcagttgcggcggcgcccatcagaatgggggtgtacgagcggccggcgccggcgcccgtgatgggcatgtggaacagcgacccgttcaaggtcgacagcggccaggccaccagtgggtccaccgtcatggaggcggacaagttcgacactaggctagaagatgttccacaggtagcactggagccggcaagaagtacggatcaggaaacaagcacgccgccagagagggtcctgcgaagacttgcacagaacaaagaggctgctcggaagagccggctgataaaaaaggcgtacatcca

SEQ ID NO: 37684 - protein, 91 aa, Panicum virgatum
  misc_feature: Ceres CLONE 1990895
  misc_feature: The sequence is a functional homolog of SEQ ID NO 1493 in the 10/374,780 US patent application
  misc_feature: The sequence is a functional homolog of SEQ ID NO 1563 in the 10/412,699 US patent application
MGVYERPAPAPVMGMWNSDPFKVDSGQATSGSTVMEADKFDTRLEDVPQVALEPARSTDQETSTPPERVLRRLAQNKEAARKSRLIKKAYI

SEQ ID NO: 37685 - DNA, 1513 bp, Panicum virgatum
  misc_feature: Ceres CLONE 1990918
  misc_feature: Encodes the peptide sequence at SEQ ID NO. 37686
attcgaatcggaattggtgcagaggaagatggacgggccaagcaagagagccagctccttctcctcgctgctggagcaatcccgccagttggcgcggcagacgggcgagtacctcattcagaggaatgtagatcagatcgacgacacaacgcgctctctgcacgggaccctgtcccattcaacgaaagatgtcgccaagaacaagggtcgctacctcttggcgaccaagggcttcgatgcagacaagctatccagaaatctgaacgctgtcaatctcaaattaacctacgagccccttgagctcgcgctcgctgataccgatctcgaaggctcgctcaacttcgcacatgatcaaatcatcatggcagccatccaggacgcaaagaaagagacgcttgatcacttcaaaaggaactcggtcaagaagctggacagcgactgggagggagccaagtcggagctactcgaggcgctgggcttctcctcggccctgctcccacgcgggacgtctgcaccctctacgcccatgaagcccggcatggacttcaccgccgcggctctcgcctcgcccgcgactccactcggccgggccggcgcagcgcgatcggcacaggaggccgtcggcaagatgaccgcctacggcaaggtcgtggaagaactcaaccaccagaggcgagagaagcgcgccttctccaccatgcaggccttccagcaggctgcccggaccgtcgatgacaccgagctgcggcggaaggaggtggcggactgctgggacctgctgagcaggatcgtgggtgagcccgagcaggccacgagcaccgccgtggccctgcccgaggccgtctacgagcggacctaccgcgaggcgcccgaggccctctcgcgcaagttcctctccggtgccaaacagttcctcgagaaacagtaccaacgagtgatgcagctggtggtagatcggaatgccaagcgggccgagctgggcggcgagcccggtatgcacagcctcgcgcgggcctacgcgcgggccgtggccctctcccgccccggcgcacacagccagctcgaggaggccggcagcgcgtgggccgagatctactacgccctccgcgccggagacgtcggttctgcctgccagctcgcactctcggccaacccgcctcttcaggaattcgccggcctgctccaggccttttcacaaaacggacacctgtcggagctgcaacaggccgattgcaggcgcacgctgaatgccacgcgcgatcccttcaagcaaatcatctacatgctgctcacgcgccacacgccgagctctctgcccgctcccatctccaccacacaggactggatttggttccacctctcgctcatcgtccaggaggagaacggcgaagcgttcgccgcgtccctccgcaggctgcagcagcaggtgtgcaagttcggaccggaccactttcacgccaagaagcacccgctcctctacttccaggtggtgctcatcacgctccagttcgag

SEQ ID NO: 37686 - protein, 494 aa, Panicum virgatum
  misc_feature: Ceres CLONE 1990918
  misc_feature (264)..(494): Pfam Name: NIC Pfam Description: Nucleoporin interacting component
MDGPSKRASSFSSLLEQSRQLARQTGEYLIQRNVDQIDDTTRSLHGTLSHSTKDVAKNKGRYLLATKGFDADKLSRNLNAVNLKLTYEPLELALADTDLEGSLNFAHDQIIMAAIQDAKKETLDHFKRNSVKKLDSDWEGAKSELLEALGFSSALLPRGTSAPSTPMKPGMDFTAAALASPATPLGRAGAARSAQEAVGKMTAYGKVVEELNHQRREKRAFSTMQAFQQAARTVDDTELRRKEVADCWDLLSRIVGEPEQATSTAVALPEAVYERTYREAPEALSRKFLSGAKQFLEKQYQRVMQLVVDRNAKRAELGGEPGMHSLARAYARAVALSRPGAHSQLEEAGSAWAEIYYALRAGDVGSACQLALSANPPLQEFAGLLQAFSQNGHLSELQQADCRRTLNATRDPFKQIIYMLLTRHTPSSLPAPISTTQDWIWFHLSLIVQEENGEAFAASLRRLQQQVCKFGPDHFHAKKHPLLYFQVVLITLQF

SEQ ID NO: 37687 - DNA, 736 bp, Panicum virgatum
  misc_feature: Ceres CLONE 1990918-R
cgggaggggctggtgctgcgcgtgtggggcgatgccgcacgcgtgcgaaggctccgcgaggtggtcgccgccgcctgcgaggagcgcgccgagctgccggctgccgtcaagctctaccacgaggcgggcgactacgagaaggtgctgtcgctgctcaacgccgcgctgggtccgctggtgtcggcggccgggccggacaggcaggccctcatcgcgctcgcgctcgacgtcaacacgcgctactcgaccatccgcgaggcgcccaccaggtcgctcgagaccctgcgcaccctcatccagaccgcccacttcttcgacctcagcaacgccaaccgactgcccgaagcactgcagcggttggaggtgattggcgttctgccgttcgaccaggcgacggtgccggagaaggtggagctgttcgcgaagctcgacgagacggtgaagcgatgcgtgggcgacctcatcctggccgccatgtcagtgctctacaagctctacggcgccatcgcgcccggcgccgggagccagtcggcctcgttcctcttcccctccgacccggcgcggcttcacgagatggaggccatcaagagccgcgcacgcgccctggccgccttcaccggccgcatccagtaccgactgccctccgacgtcacctcccgcctcctccgcttcgaggtcctcatgagctagacgctctacatgatagttgaacatgaacgttttggacaagaagacg

SEQ ID NO: 37688 - DNA, 423 bp, Panicum virgatum
  misc_feature: Ceres CLONE 1990922
  misc_feature: Encodes the peptide sequence at SEQ ID NO. 37689
acactctgtcccagctatcctccgactcatctctctccctctttctagtccccaatacctctctaacatcctctctattgcttcttgggtaataatggagaggagtcgcccggtcgtcctcttgtccctcgccgttgtggggttggcggacactgcgctggctcctgcgccggaagatgcaaccttgtacaacatctccaagcttctggggccgtacaagcagtactctaggttcaactagatgctgaccaggacgcggctggtgtacgacatcaaccggctgcagaccatcaaggggctcgacatctacgacgcagccatatctgcgctggaccactactcgctgtagaccatccggcacatcctctcgctgcacgccctcgtacactactacggcgacaagaagctcaagaagctcgggca

SEQ ID NO: 37689 - protein, 48 aa, Panicum virgatum
  misc_feature: Ceres CLONE 1990922
  misc_feature: Useful for making plants with altered carbohydrate content
MERSRPVVLLSLAVVGLADTALAPAPEDATLYNISKLLGPYKQYSRFN

SEQ ID NO: 37690 - DNA, 1719 bp, Panicum virgatum
  misc_feature: Ceres CLONE 1990929
  misc_feature: Encodes the peptide sequence at SEQ ID NO. 37691
agccacagcacagcacggcacggccggtctctccttcttcttcttcttcttcttctcccccggcgccagcggacctgcgggacctcgtcgtcgtcggccgatccttcactggcagggcagcagcgagctgcaattaacggcggcggcggaggatcggggaggaggacgacgaagatggtggtggagtccgcggggggcggcggaggggactgcctcatcaagctgttcgggaagaccatccccgtgccggaggccgccgccgacaaggagagcggcagcagcatcagctcctgcaccgaatccgacaccccggagaacgcctcggagccgtccccgcagccggaggtcgtggacgccgaggaccccaagagctcgccggagacgcagccgccgcccggcgccggcgacttggccgggcagagggagaagctcaagaggcccgacaaggtgctgccgtgcccgcgctgcaacagcatggacaccaagttctgctacttcaacaactacaacgtcaaccagccgcgccacttctgcaagaactgccagcgctactggaccgccggcggcgccatgcgcaacgtgcccgtcggcgccggccgccgcaagaacaagcacgccgtcgccgcctcccacttcctgcacagggtccgggccgcgctgcccgccgccgccggcgacccgctcagggccaacgccacggtgctcagcttcggcggccacggccacggcgcgcctcccgcggcgctgcaggacctcgccgagcaggtgacccacctgaaggagaagctgctcgtcccggcaaggaacgccggcgacccatcgccggtgggtccgtgcagcgaaggaccaagcagcacggacgacaaggcccatggcggcggcatcaaggagaagcccgccgtagacaggcctgcaaacggagcgccgcagcttccggcaagcatgaacggagcaaccgtgtggccgtacggcggctgcgcgccatctccggcggcgtatttctcgtcgggcatcgcgattccgatatacccggccgcaccgggttactggggctgcatggttcccgcccccggaccttggagcctgccatggtcggtgcagggcctctcgttgcccaccagtgctccttcactctcgtcatcggggcctgaccccgacctcacgctgggcaagcaccccagggagggggacgaggggagaagcgcccatggtggtggcaaggtgtgggcgcccaagacgatccggatcgacgacgccgacgaggtggccaggagctcgatctggtccctcatcgggatcaaaggcgacaggaagcaggacgccgcggatcatcacggcgctgccgggcacaagcacgggacggtgttcgagcagaagcgggaggccaagaagcaaccggcgatgatcgcaagctcgccgctcctgcacaccaaccccgtcgcgctgacacgctcggtgaccttccaggagggatcttgaagcccatcgatcggcactactgaaatttttgtaaatcagagagaggattgtaatataggtattggggggaagaaggaaacagagtgagtgtatgtgtaacatagctacttgtggacttgtaataggtatagccgcatgtacatagaattagctatttgggttggagaaagaccaggagatcaatatggcccctggttgtagataatatataatatgaaggaggaatatattgcttgaagt

SEQ ID NO: 37691 - protein, 434 aa, Panicum virgatum
  misc_feature: Ceres CLONE 1990929
  misc_feature (88)..(150): Pfam Name: zf-Dof Pfam Description: Dof domain, zinc finger
  misc_feature: The sequence is a functional homolog of SEQ ID NO 1132 in the 10/374,780 US patent application
  misc_feature: The sequence is a functional homolog of SEQ ID NO 1331 in the 10/412,699 US patent application
  misc_feature: The sequence is a functional homolog of SEQ ID NO 1130 in the 10/374,780 US patent application
  misc_feature: The sequence is a functional homolog of SEQ ID NO 1329 in the 10/412,699 US patent application
  misc_feature: Useful for biocontainment applications
  misc_feature: Useful for making plants with modulated biomass
  misc_feature: Useful for making plants with modulated flowering time
  misc_feature: Useful for making plants with modulated light quality response
MVVESAGGGGGDCLIKLFGKTIPVPEAAADKESGSSISSCTESDTPENASEPSPQPEVVDAEDPKSSPETQPPPGAGDLAGQREKLKRPDKVLPCPRCNSMDTKFCYFNNYNVNQPRHFCKNCQRYWTAGGAMRNVPVGAGRRKNKHAVAASHFLHRVRAALPAAAGDPLRANATVLSFGGHGHGAPPAALQDLAEQVTHLKEKLLVPARNAGDPSPVGPCSEGPSSTDDKAHGGGIKEKPAVDRPANGAPQLPASMNGATVWPYGGCAPSPAAYFSSGIAIPIYPAAPGYWGCMVPAPGPWSLPWSVQGLSLPTSAPSLSSSGPDPDLTLGKHPREGDEGRSAHGGGKVWAPKTIRIDDADEVARSSIWSLIGIKGDRKQDAADHHGAAGHKHGTVFEQKREAKKQPAMIASSPLLHTNPVALTRSVTFQEGS

SEQ ID NO: 37692 - DNA, 750 bp, Panicum virgatum
  misc_feature: Ceres CLONE 1990931
  misc_feature: Encodes the peptide sequence at SEQ ID NO. 37693
gcaacatcgatcgcatggctcatcgtgcagcggaggagctaggggtgatccaaccgcctccggctagcgccgccgccgtcgatcccgtccgtctccggcggccgcttgccgcgctgccctcttctcctaccggcggcctcgacggcgccatggagaacagcctccccgacgaccccctcgtggaggtcctttcgcgcctccctgccaagtccatctgccgtttcaagtgcgtctccaaaccctggcgcgacctcatcgccgaccgcctccgctgcaggaagttcccccaaaccctacagggattcatctacggcgacggcgaggcccacgccggcgagaactatgggcacttcatcaacccgctgggggaacctgtgcctctcatcgacccttcgttcaccttcctgacgaagcttcctggggttgagaagatcatcctcttgggctcctgcaaggggctcctatttgggcacagacgggtttcagacacatatgactcactgggctacattgtgtgcaaccccgccaccgagcaatgggtggctgtgcccagctccggctggtccccatggccagacagcgaggttgaagaggatgaagattactatacggaagaagatgtgctcacacatttgattttcgatccagctgtctccccgcactttcagttggtccagctgtggcaggaaagctatatgaacttggcaggggtgcacacctactcgtctaaaactgggggtatggagttca

SEQ ID NO: 37693 - protein, 200 aa, Panicum virgatum
  misc_feature: Ceres CLONE 1990931
  misc_feature (3)..(47): Pfam Name: F-box Pfam Description: F-box domain
MENSLPDDPLVEVLSRLPAKSICRFKCVSKPWRDLIADRLRCRKFPQTLQGFIYGDGEAHAGENYGHFINPLGEPVPLIDPSFTFLTKLPGVEKIILLGSCKGLLFGHRRVSDTYDSLGYIVCNPATEQWVAVPSSGWSPWPDSEVEEDEDYYTEEDVLTHLIFDPAVSPHFQLVQLWQESYMNLAGVHTYSSKTGGMEF

SEQ ID NO: 37694 - DNA, 666 bp, Panicum virgatum
  misc_feature: Ceres CLONE 1990932
  misc_feature: Encodes the peptide sequence at SEQ ID NO. 37695
aaaaaacccaataaaaaacgcacctccccccccaccccctccttcgcctcgctttccccccaacctccctccctcgatcccctcgccgggaagatccgatcccatcccatccacctctcccggctcaatcagagccccccactcggcggaggagaagaccagggcggaggcggaaggaatgttgcgtctcgagagcacaggccaggttgttgctataaagcagcttaatagggatgggcttcaaggaaacagagaatttctagtagaagtcctcatgctcagtttattgcatcatcaaaacctggttaatttgattggctattgcgctgatggagatcagcgccttctagtttatgagtatatgcccttcggatcattggaagatcatttacacgatctacctcttgataaggaggccttggactggaacaccaggatgaaaattgcagcaggtgctgccaaaggactggagtaccttcatgacaaagctaatcctccagttatttatagggattttaagtcatcaaacattctgttggatgaaggtttccacccaaagctctctgactttggccttgctaagttgggtcctgttggtgacaaatctcatgtctcaacacgtgtgatgggtacatatggttattgtgcaccggagtatgctatgac

SEQ ID NO: 37695 - protein, 162 aa, Panicum virgatum
  misc_feature: Ceres CLONE 1990932
  misc_feature (3)..(159): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Useful for making plants with modulated drought sensitivity
  misc_feature: Useful for making plants with modulated heat sensitivity
  misc_feature: Useful for making plants with altered carbohydrate content
  misc_feature: The sequence is a functional homolog of SEQ ID NO 2 in US patent 7135625
MLRLESTGQVVAIKQLNRDGLQGNREFLVEVLMLSLLHHQNLVNLIGYCADGDQRLLVYEYMPFGSLEDHLHDLPLDKEALDWNTRMKIAAGAAKGLEYLHDKANPPVIYRDFKSSNILLDEGFHPKLSDFGLAKLGPVGDKSHVSTRVMGTYGYCAPEYAM

SEQ ID NO: 37696 - DNA, 1475 bp, Panicum virgatum
  misc_feature: Ceres CLONE 1990948
  misc_feature: Encodes the peptide sequence at SEQ ID NO. 37697
gtcgcctccgcccccctccgccgtcggaggaggaaagtggggctccacctgcacccatcgtatcacaaacctcgatagggtctcggacatcgtagccatggccgacgcagcgcagtccatcccggccgcgatagcctccctccagacctactccacggccctctccgccttcaccgccgcgtggcgcgccgtcgagtcccacgccgccggcctcgactccaccctcgccgcccgcctcgacggcttctcggagctcgaactaatatgctccgcgatggacggccccgggcttcgcgcgcacctcaccgagcacagggacgagctcaaggagcccgcgcgcgccctcgacgccgcgctcctggtggcgcccgatccgggccttctggtcctctccgcggccgcgggtttctgccgcgccccgccggagggggccaagagcgatggggacatcaaggtgtcctgccgcctgctcatcggcctgctcgaccggctgcgcgcgattggagtgaagccgtcgtcagaggcgcgcgacgaggccagagctgtcgcggcggactggaaacgaggcaagcgtatcgggtcggaggcgatttttaagcaggagacgttcgcattcctgcttctcgtgggggtgtttggcctggttgaagatgtgggcggcgccggcgaggtgctagatctgatcgtgttgaccgcgagccgggagcgcgccgtcgatgcgttcgttggccttgggctcgacctcgaccagcatatgcctgttctcattgagaaaatgaaacaaaaaagtaaacagcttgaggcggtcaaattcattcaagctcttaatgtagtgcacaagtatcctttgaatcctgttctgaagtcgtacattagtgctgctgcattagctgggaagatgatccgcatcaggggagatgatcctgcctctcagaatgcagctgatgaaaaagagcgcacgctgctcggaatattgcagaagttcattaaagaaaataagctagaagaactgcctattttcgaagaagccaacaagcgggtggcacatttggagcagcaaagtgcagagagaaagagagctgctgccgcagcggtggcagctgctcaacaagttagcaagagcattgagcagcagcagaagatacagcagctgatgcattctgctaagagatcaaaggtagacaatgtggtgctagtttcttcaggccagaatgtccattcagctggaactcctagtcaacaatttaccccgaggcagagcatccatactgctgtagcaccaaatcagtatcaaactgctttaaaaccgaacatactacctgcgatcaatcagatttcgcaagtagttacttggaatcatcatccagttggcatccaaagtcaggtccctgttgcgcctggtgttccaactcaatatggtggcttggcagattatgaagcaacgtcctccaggccatataggtccagcactctag

SEQ ID NO: 37697 - protein, 459 aa, Panicum virgatum
  misc_feature: Ceres CLONE 1990948
  misc_feature (40)..(333): Pfam Name: Frigida Pfam Description: Frigida-like protein
MADAAQSIPAAIASLQTYSTALSAFTAAWRAVESHAAGLDSTLAARLDGFSELELICSAMDGPGLRAHLTEHRDELKEPARALDAALLVAPDPGLLVLSAAAGFCRAPPEGAKSDGDIKVSCRLLIGLLDRLRAIGVKPSSEARDEARAVAADWKRGKRIGSEAIFKQETFAFLLLVGVFGLVEDVGGAGEVLDLIVLTASRERAVDAFVGLGLDLDQHMPVLIEKMKQKSKQLEAVKFIQALNVVHKYPLNPVLKSYISAAALAGKMIRIRGDDPASQNAADEKERTLLGILQKFIKENKLEELPIFEEANKRVAHLEQQSAERKRAAAAAVAAAQQVSKSIEQQQKIQQLMHSAKRSKVDNVVLVSSGQNVHSAGTPSQQFTPRQSIHTAVAPNQYQTALKPNILPAINQISQVVTWNHHPVGIQSQVPVAPGVPTQYGGLADYEATSSRPYRSSTL

SEQ ID NO: 37698 - DNA, 473 bp, Panicum virgatum
  misc_feature: Ceres CLONE 1990954
  misc_feature: Encodes the peptide sequence at SEQ ID NO. 37699
ctacgtcaaagctaggcacgtattgtgtgagaagcaggggaagatcaatgaggcttataagaagttacaggatggatggctggacaatggggataaggttcctccagctgagttcgctaagctagggatggcacccgcgggtgcgggtttggcaaaaacccacccgcggagcaggggaaaacccgcccgcggcaagacccgcgggtggatttctggacccgcacccgcacctgccgggtttcgggcgggtctcgggcacccgcgggtttcgtcgacttcgccaccgcgccgcgcctgttggccaccgccttcgtcgtgctcgaggccgcagccgccgcgacatgcccgcagatcgctgcctccgccgtgttggaggccaccaccaccgcgccgtgcccgcaggccccacctccgccaccgcgccgtgtacacggtcggttgtgctggtgaggggactggggagatccggccgg

SEQ ID NO: 37699 - protein, 157 aa, Panicum virgatum
  misc_feature: Ceres CLONE 1990954
  misc_feature: SWISSPROT Homolog: EC 5.2.1.8 Peptidylprolyl isomerase
YVKARHVLCEKQGKINEAYKKLQDGWLDNGDKVPPAEFAKLGMAPAGAGLAKTHPRSRGKPARGKTRGWISGPAPAPAGFRAGLGHPRVSSTSPPRRACWPPPSSCSRPQPPRHARRSLPPPCWRPPPPRRARRPHLRHRAVYTVGCAGEGTGEIRP

SEQ ID NO: 37700 - DNA, 633 bp, Panicum virgatum
  misc_feature: Ceres CLONE 1990960-R
  misc_feature: Encodes the peptide sequence at SEQ ID NO. 37701
gcatcccagtcttcagacgtctacagcttcggcgtcttcatactggagctcctcaccgggaagtcacctgtccagataaccggcggaggcaacgaggtcatccacctggtgaggtgggtgcagtccgtcgtccgggaggagtggaccgccgaagtgtttgacggcgagctgctgcggtaccccaacatcgaggaggagatggtggagatgctccagatcgccatggcatgcgtgtcgaggaccccggagcggcggcccaagatggcagacgtggtcagaacgatcgaggaggtgcggagggccgacaccgggacacggccgtcgacggaggcgtccaccccggccgtggaggcagcccagagcggggcggagagctcgtcggcagcacaatgagtgagcgagttcattggatgcttgctgctggtattcgttgttcttgtgtttctgcacggttgggcgcacggatggtcgattctgtgctccggcgggtgttgtaccattcttttgtgttaaggttccatgttacggaattgtaacagaatgtcatgtggacgtggttcgattacgcagcaattgctcgctgctgattatctctaagctaaggaaggaaaaactaatgtctgatctgctgac

SEQ ID NO: 37701 - protein, 130 aa, Panicum virgatum
  misc_feature: Ceres CLONE 1990960-R
  misc_feature: SWISSPROT Homolog: EC 2.7.11.1 Non-specific serine/threonine protein kinase
ASQSSDVYSFGVFILELLTGKSPVQITGGGNEVIHLVRWVQSVVREEWTAEVFDGELLRYPNIEEEMVEMLQIAMACVSRTPERRPKMADVVRTIEEVRRADTGTRPSTEASTPAVEAAQSGAESSSAAQ

SEQ ID NO: 37702 - DNA, 681 bp, Panicum virgatum
  misc_feature: Ceres CLONE 1990960
aagaaatccagcaaaaccaccgcgcccgccccagccgggagggagcgcaccctgcgccggcaacccacgccgcccgagccgcggaaccctcctccccgctccccgtctccctccagctgctgccctgccttgccacgtcctcctcttctcccattcttctcccttcacggctccgcccgcccaggcccttcacgcgcctcgcctccctccctccctcccgcaccgtgctgtaactccactccactcagatccaaccaacccaccgccaacaccagcaccatgccgctccgcgtggcggcggcggcggcgctcgccctcctgctctcctgctgctgcctcacgtcggccgagcccgacgccgacaaggcggcgctgctcgccttcctcgcgggggtgggccgcggcgccgccgcccgcgcgcgcatcaactggcccgccaccccgcgcgcctgcgccgcccgcgggagcggctggaccggggtcacctgcagcgccgacggcgcccgcgtcgtcgcgctgcacctcccgggcctcggcctctcgggccccgtcccgcccggcacgctcgcccgcctcgacgcgctgcagctgctcagcctccgcgccaacagcctctccggccccttccccgccgacctcctcgccctccccgcgctcgccggcctccacctccagcgcaac

SEQ ID NO: 37703 - DNA, 574 bp, Panicum virgatum
  misc_feature: Ceres CLONE 1990964
  misc_feature: Encodes the peptide sequence at SEQ ID NO. 37704
aaaccagatcagtgagacgcactctgctttccgatccgggacacatggcggcggcggcggcggcggtgacgcccaacggcggcgcggcggcggcagcgaacggtccgtcgcccgggcggctggcctccgtgtacagcgaggtgcagacgagccgccttctgcacgcgctgcccctcccctccgtcctccgctccgacttctccgtcgtcgacgggcccgccagctccgccgcggggaaccccgatgagatcgccaagctcttccccaacctcttcggccagccttcggcgttgctggtgccgtcggccgagcccgcggcgacaaggccgctcaaggtcagcgtcgtgctctccggtggacaggcccctggcgggcacaatgtgatctgcggcatcttcgattacctgcaggagcgtgctaaaggcagcactatgtatggattcaagggaggtccatctgggatcatgaagtgcaagtacgtggagctcaattctgactttgtatacccatacagaaaccagggaggatttgatatgatctgcagtggaagggacaaaattgaaacgccagagca

SEQ ID NO: 37704 - protein, 176 aa, Panicum virgatum
  misc_feature: Ceres CLONE 1990964
  misc_feature: SWISSPROT Homolog: EC 2.7.1.90 Diphosphate--fructose-6-phosphate 1-phosphotransferase
MAAAAAAVTPNGGAAAAANGPSPGRLASVYSEVQTSRLLHALPLPSVLRSDFSVVDGPASSAAGNPDEIAKLFPNLFGQPSALLVPSAEPAATRPLKVSVVLSGGQAPGGHNVICGIFDYLQERAKGSTMYGFKGGPSGIMKCKYVELNSDFVYPYRNQGGFDMICSGRDKIETPE

SEQ ID NO: 37705 - DNA, 1755 bp, Panicum virgatum
  misc_feature: Ceres CLONE 1990969
  misc_feature: Encodes the peptide sequence at SEQ ID NO. 37706
ctcccgtccctggctcgcttcccaatacccaaccccgccggccgcgagcgatgcccgcgatccccaccgcccctgcgcccgccaccggcagctccctccacgcgcgccgcctccgccttcagttctcctccccgtcgccgcgctctaaccagcagcggctcctccccacccgcctcccccgcctgcccgctcgcgcccgggccgctcccatttccgccgaggcgcgggcgcccgcgccgccggcgcaccccacctacgacctcagggccgtcatcgcgctcgccctctccgaggacgccggcgaccgaggggatgtgtcttgtttggccacaattccttcggacgtggaagctgaagccacgtttattgctaaagcagatggtgttattgctggaataagcctagcagacatgatatttaaccaagttgatccatcgttgaaggttgaatggtttgaaagtgatggaaattatgtccataaagggttgcaatttggcaaagtatatggtaacaatgttcaataagatagtctgttttaggtagcagtagttagcatcttgaacttataaattcttttagtacctaactaatttttcccaatgctatctttgtgtcaagggtgcgctaggagcatcatcattgctgaaagggttgtgctcaatttcatgcagaggatgagtggtattgcgaccttaacaaaggctatgtctgatgctgcacgtccagcatgcatattggaaacaaggaaaactgccccaggtttacgtctggttgacaagtgggcagtactgataggtggtggaaagaaccacaggcttggtttatttgatatggttatgataaaggataatcatatttctgttgctggcgggattgcaaatgcagtgagatccgttgaccaattcctggagaaggaaaaacttacaattcctgtagaggttgagacaaggacaattgaagaagtgaaagatgtgctgaagtatgctgctgagaacagaacttcattaacccgtataatgttggacaacatggtcgttcctcttccaaatggggatgtggatgtatcaatgcttaaggatgcagttcaattgataaatggtagatttgagactgaggcatctggaaatgtgacaatcgatacagtgaagaaaataggagaaacaggagttacctatatttcaagcggagcattaacgcattctgtgaaggctcttgacatctctctcaagatagacaccgagctcgctcttcaagtcggaagacgtacaaatcgtgcctgactccactgcattatgttgtacccgccttgccacatctacaagatggtagattaacccagcgtggcaaatcaagttaaataacttatcaaatctgcgccggccgcgtggtgctgagaactgtgactgctacaaaatgggattcattcttcagttttaggttttcagccgaaatacacaaacaccacaatatggaacggaataattggcagggtggtaggttgcttctcgcatatgttctggcaccagatttggaagctggaaaaggagcggctgctgcgttctgcggcaggtagctcatagccggtgaggtggatctccctgcaacctgcccggaaggtaggttactgtgaacgggatgccgcaccgaagttgcaataatagtagtgtttgtttgtcttgtcagctaatcagtcagcaacactattttatcatactaaatcagcaccagctatgagccatcaactattagtcagtc

SEQ ID NO: 37706 - protein, 157 aa, Panicum virgatum
  misc_feature: Ceres CLONE 1990969
  misc_feature (84)..(154): Pfam Name: QRPTase_N Pfam Description: Quinolinate phosphoribosyl transferase, N-terminal domain
  misc_feature: SWISSPROT Homolog: EC 2.4.2.19 Nicotinate-nucleotide diphosphorylase (carboxylating)
  misc_feature: The sequence is a functional homolog of SEQ ID NO 2 in US patent 7304220
MPAIPTAPAPATGSSLHARRLRLQFSSPSPRSNQQRLLPTRLPRLPARARAAPISAEARAPAPPAHPTYDLRAVIALALSEDAGDRGDVSCLATIPSDVEAEATFIAKADGVIAGISLADMIFNQVDPSLKVEWFESDGNYVHKGLQFGKVYGNNVQ

SEQ ID NO: 37707 - DNA, 669 bp, Panicum virgatum
  misc_feature: Ceres CLONE 1990970
  misc_feature: Encodes the peptide sequence at SEQ ID NO. 37708
atcactcagttcacagtcactcgatcgctcagcaaaatctagctgacaggacagcggcaccactacaagctgcacgcacacagctgaccgagcgagcggagtagatcgaaccagccacaaccatggccgacggatcagagcagagcgtccacgtcctcctgctcccgtacccgagccagggccacatcaacccgatcctccagttcggcaagcgcctcgccgcgcgccgcggcgtccggtgcacgctcgccgcgacgcggttcgcgctcagccagagccagcctgccaccggcgacgccgtccgcgtcgccgccatctcggacggctgcgaccgcggcggcttcggcgaggccggcggcgtcggcgcgtacctgcgccggctggaggcggccgggtccgagaccctggacgcgctcctccggtccgaggcggagcggggccgccccgtgcgcgtgctcgtgtacgacgcgttcctgccgtgggcgccgcgcgtcgcgcggcggcgcggcgcggcggccgcggcgttcttcacgcagccgtgcgcggtggacgtggcgtacgcgcacgcgttcgccgggcggatccggccgccgctcgccgacgacggggaggtggcgctggcggagctgcccgggctgccggccgggctcaggccggccgatctgccgt

SEQ ID NO: 37708 - protein, 182 aa, Panicum virgatum
  misc_feature: Ceres CLONE 1990970
  misc_feature: SWISSPROT Homolog: EC 2.4.1.121 Indole-3-acetate beta-glucosyltransferase
MADGSEQSVHVLLLPYPSQGHINPILQFGKRLAARRGVRCTLAATRFALSQSQPATGDAVRVAAISDGCDRGGFGEAGGVGAYLRRLEAAGSETLDALLRSEAERGRPVRVLVYDAFLPWAPRVARRRGAAAAAFFTQPCAVDVAYAHAFAGRIRPPLADDGEVALAELPGLPAGLRPADLP

SEQ ID NO: 37709 - DNA, 749 bp, Panicum virgatum
  misc_feature: Ceres CLONE 1990979
  misc_feature: Encodes the peptide sequence at SEQ ID NO. 37710
accgtgccttcctcctgcccccgcccccgccccgactcaccaccgcactgcacagaggttctccggcggtcgagcgcgcctcgatccagatccagttacgagatggctctcacgagaattggtctcgccggcctcgcggtcatggggcagaaccttgccctcaacattgcggagaaagggttccccatctctgtctacaacaggacgacctccaaggttgacgagacagtgcagcgtgccaagctggaaggagacctccccgtgtatggtttccatgaccccgcatcctttgtgagctccattcagaagcctcgtgtcgtcatcatgcttgtcaaggctggggcgccggtcgaccagaccattgccacccttgcggcacacctggagcagggagattgtatcattgatggaggaaatgagtggtatgagaacacggagaggagggagaaggcaatggaggagcgtggactcctatatcttggcatgggtgtctctggaggagaggagggtgcccgcaatggcccgtcattgatgcctggaggctcttttgaggcgtacaagtacatcgaggatattcttctgaaggtggctgcccaggtcccggacagtggcccgtgtgtcacatatattggcaaaggtggatcaggcaactttgtcaagatggttcacaatggaattgaatatggtgacatgcaactgattgctgaggcatatgatgttctcaagtcagtcgggtagctcacaaacag

SEQ ID NO: 37710 - protein, 211 aa, Panicum virgatum
  misc_feature: Ceres CLONE 1990979
  misc_feature (3)..(178): Pfam Name: NAD_binding_2 Pfam Description: NAD binding domain of 6-phosphogluconate dehydrogenase
  misc_feature: SWISSPROT Homolog: EC 1.1.1.44 Phosphogluconate dehydrogenase (decarboxylating)
MALTRIGLAGLAVMGQNLALNIAEKGFPISVYNRTTSKVDETVQRAKLEGDLPVYGFHDPASFVSSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLIAEAYDVLKSVG

SEQ ID NO: 37711 - DNA, 712 bp, Panicum virgatum
  misc_feature: Ceres CLONE 1990991
  misc_feature: Encodes the peptide sequence at SEQ ID NO. 37712
aacgagcggcggctcctctcctctcctgtcctctgctctgctgttcggagcagcctgttccaacccgactcctccatcttccttcgcgcgaggcctggtggccgatcggctggccggttccgatccggcggggcttggtgctcgaggcgatcgcatcgtcgtcatcggccgctcgcgccgttcgattgggggccatatggacaaccccgcgccgccaccgaatgccgcggccggcgcgccgtcgccgtcgcggcggctgccggacttccagcagtcggtgcgtctcaagtacgtgaagctggggtaccactacctcatctcccacggcatgtacctgctgctcaccccgctgatggcgctcgtggccgtgcacctctccacgctctccccgcgcgacgtcgccgacctgtgggcgcacctccgcctcaacctcgtctccgtgctcgcctgctccgcgctcctcgtcttcctcgccaccgcctacttcctcacccggccgcgccccgtgtacctggtcgacttcgcctgctacaagccggggcccgagcgccggtgctcgcgcgacaccttcatgcgctgctcccgcctcacgggctccttctctgacgccagcctcgagttccagcgcaagatcctcgagcgctcagggctcggcgaggacacgtacctgccccccgccgtcacgagcgtgccgcccagcccgtccatggac

SEQ ID NO: 37712 - protein, 171 aa, Panicum virgatum
  misc_feature: Ceres CLONE 1990991
  misc_feature (96)..(171): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MDNPAPPPNAAAGAPSPSRRLPDFQQSVRLKYVKLGYHYLISHGMYLLLTPLMALVAVHLSTLSPRDVADLWAHLRLNLVSVLACSALLVFLATAYFLTRPRPVYLVDFACYKPGPERRCSRDTFMRCSRLTGSFSDASLEFQRKILERSGLGEDTYLPPAVTSVPPSPSM

SEQ ID NO: 37713 - DNA, 1647 bp, Panicum virgatum
  misc_feature: Ceres CLONE 1991002
  misc_feature: Encodes the peptide sequence at SEQ ID NO. 37714
atgcaattcccaagcacaacttcaaagtaaaaaaaaaaatcgacaagctaagccacctccatcatatcatggagatggagctaagtgcagcaacgctcctcttcgtcttcctcatctccttgccaattcttgtgaccttgctgagccacaaatcaactccaacctctaagaagaggcggcctccaggcccatggaacctccccttgattggaagccaactccacttcttcaagtcgcattcaccgggtgttttccgggacctggccaacaagtatggccctgtgatgttcctccggatgggccagatcgacactctcgtgatatcctcgccggcggcagcagaggaggttctcctcgtgaaggatatcatcttcgcgtcgaggccaagcatcgtggcttcagagttcttctgctaccaaaacctcgacatcgtcttctcgccctatggtgcttattggcggacgctgcgcaagctctgcacgatggagctcctcaacgcaaagatggtgcgtcagttcgcccccatcagggataacgagacgttgtccctcatcagaaatatccaagctgctggccgaggtggtgagccagtccatctcggtagggagctcttatcctgctcaaacatgatcacagcaaaggcggctttcggccaagtttacagcagcgagctccgggaccagtttctatcgtcgatggctgtgatgacaagcttcaccgggggcttcaccttcggggatgtctttccatcactgcgcttcactgacgtcgtcactgggctcaggcgaaggatgtggcgagcacgcttgcagctggacgacgtctttgacaagatcattgctcgatctgaggcgcagcgaggtgatgacctggtgagtgtcctccttcggatcagggacgagggggagctggaattccccatgggcatcataaacatcaaggcaattatattggatatgttcactggagggacggatacgacggctaaagctgcagagtggacaatgtcagagctcatgaagaacccagatgtaatggccaaggcacaggctgaggtgcgacaagtattcgataacgtgagcccacaagaccatgagggcaagatagatgagctgcactacactaaaatggtgatcaaggagagcatgaggctgaacccagcggtgccattgctaatgcatctctgtcgggagacttgcgacgtaggtgggttccaagtcacggagggaactagggtcgtaatcaacgtatgggccatggcaaggagccccaagtactggcttgacgcagagaagttcagaccggagaggtttgaggatggaatgcttgacttcaaaggctcccggttcaagtacttgccatttggggcagggaggagaaggtgccctggtgataccttcgggctggctgcgctagagctcattattgcacgccttctctactatatcgactggagcctcccggccgggatgcagccggacgacattgatatggaaatgatcgttggcgcaacagccaggagaaagaaccagctggaactagtggcatcaccatataaggttgttcccgtgtaatgctgatcgacgtgatagtcaagtatatgcttgctggccaacatctacagttgtgcctgcataatgttgtact

SEQ ID NO: 37714 - protein, 501 aa, Panicum virgatum
  misc_feature: Ceres CLONE 1991002
  misc_feature (38)..(491): Pfam Name: p450 Pfam Description: Cytochrome P450
  misc_feature: SWISSPROT Homolog: EC 1.14.13.68 4-hydroxyphenylacetaldehyde oxime monooxygenase
MEMELSAATLLFVFLISLPILVTLLSHKSTPTSKKRRPPGPWNLPLIGSQLHFFKSHSPGVFRDLANKYGPVMFLRMGQIDTLVISSPAAAEEVLLVKDIIFASRPSIVASEFFCYQNLDIVFSPYGAYWRTLRKLCTMELLNAKMVRQFAPIRDNETLSLIRNIQAAGRGGEPVHLGRELLSCSNMITAKAAFGQVYSSELRDQFLSSMAVMTSFTGGFTFGDVFPSLRFTDVVTGLRRRMWRARLQLDDVFDKIIARSEAQRGDDLVSVLLRIRDEGELEFPMGIINIKAIILDMFTGGTDTTAKAAEWTMSELMKNPDVMAKAQAEVRQVFDNVSPQDHEGKIDELHYTKMVIKESMRLNPAVPLLMHLCRETCDVGGFQVTEGTRVVINVWAMARSPKYWLDAEKFRPERFEDGMLDFKGSRFKYLPFGAGRRRCPGDTFGLAALELIIARLLYYIDWSLPAGMQPDDIDMEMIVGATARRKNQLELVASPYKVVPV

SEQ ID NO: 37715 - DNA, 679 bp, Panicum virgatum
  misc_feature: Ceres CLONE 1991004
  misc_feature: Encodes the peptide sequence at SEQ ID NO. 37716
attaattttccgcgctgcgcttgtagacatctatccagcagagcgcagcaggatggtgtacgcgctcgtgctggtcgccttggcggcctccccaagggcagcttcggctggcccctcatcggcgagaccatcggcttcctccacgcgcacccgtccaacaccgccggcggcttcctcaaggagcacgtcgccaggtacgggacggtgttcaagtcgcacctcttcggctcgccagcggtggtctcctgcgacgaggagctcaaccacttcgtgctgcacaacgaggagcgcctgttcgagtgcagctaccccggcgccatccgcaccatcctcggcgagtcctccgcgctggtggtcaccggcgagcgccaccgccagatccggagcatgttcctcgccctcgtcgcctccacggggctcaaggcctcctacgtcgccagcgtcgacgagtccgcgcgctccctcatcgcgtcctggcgcggccgcgagaccatcagcttctgcgaggaggcgaggaagttcccctacaaggtgatcatggagcaggtgctgggcctgccgccggacggcccggtggccctccggatcctggaagagtaccagatcttcatgaaggggatcatctccctccctatcaccctccccgggacagcattttccagggccgtcaaaggcagga

SEQ ID NO: 37716 - protein, 226 aa, Panicum virgatum
  misc_feature: Ceres CLONE 1991004
  misc_feature: SWISSPROT Homolog: EC 1.14.13.77 Taxane 13-alpha-hydroxylase
  misc_feature: Useful for making plants with modulated oxidative stress sensitivity
INFPRCACRHLSSRAQQDGVRARAGRLGGLPKGSFGWPLIGETIGFLHAHPSNTAGGFLKEHVARYGTVFKSHLFGSPAVVSCDEELNHFVLHNEERLFECSYPGAIRTILGESSALVVTGERHRQIRSMFLALVASTGLKASYVASVDESARSLIASWRGRETISFCEEARKFPYKVIMEQVLGLPPDGPVALRILEEYQIFMKGIISLPITLPGTAFSRAVKGR

SEQ ID NO: 37717 - DNA, 677 bp, Panicum virgatum
  misc_feature: Ceres CLONE 1991011
  misc_feature: Encodes the peptide sequence at SEQ ID NO. 37718
actcagttcacagcctcgatcgcctgctcaacaaaatctagctgacattactgtggagcagcactactagctgcacgcacagagctgagcgagcgaccaaccatggccgacggatcagaacagagcgtccacgtcctcctgctcccgtacccgagccagggccacatcaacccgatcctccagttcggcaagcgcctcgccgcgcgccgcggcgtccggtgcacgctcgccgcgacgcggttcgcgctcagccagagccagcctgccaccggcgacgccgtccgcgtcgccgccatctcggacggctgcgaccgcggcggcttcggcgaggccggcggcgtcggcgcgtacctgcgccggctggaggcggccgggtccgagaccctggacgcgctcctccggtccgaggcggagcggggccgccccgtgcgcgtgctcgtgtacgacgcgttcctgccgtgggcgccgcgcgtcgcgcggcggcgcggcgcggcggccgcggcgttcttcacgcagccgtgcgcggtgaacgtggcgtacgcgcacgcgttcgccgggcggatccggccgccgctcgccgacgacggggaggtggcgctggcggagctgcccgggctgccggccgggctcaggccggccgatctgccgtcgtttctggcccagcccggcgactgccc

SEQ ID NO: 37718 - protein, 191 aa, Panicum virgatum
  misc_feature: Ceres CLONE 1991011
  misc_feature: SWISSPROT Homolog: EC 2.4.1.121 Indole-3-acetate beta-glucosyltransferase
MADGSEQSVHVLLLPYPSQGHINPILQFGKRLAARRGVRCTLAATRFALSQSQPATGDAVRVAAISDGCDRGGFGEAGGVGAYLRRLEAAGSETLDALLRSEAERGRPVRVLVYDAFLPWAPRVARRRGAAAAAFFTQPCAVNVAYAHAFAGRIRPPLADDGEVALAELPGLPAGLRPADLPSFLAQPGDC

SEQ ID NO: 37719 - DNA, 710 bp, Panicum virgatum
  misc_feature: Ceres CLONE 1991021
  misc_feature: Encodes the peptide sequence at SEQ ID NO. 37720
atcccccgcattaagtttcagaccggcgcccctcgcgttcatgtccctgacgcccggcatggccatgggcggtggtggaggcggcgtcgggctggtcgccgccgccctcgccgcggtggcggccacgtggctgtgggcggcgctggtgcgcctggtgtggcggccgtacgccaccgcgagggcgttcgcgcggcagggcgtccgcgggctgccgcaccggcccttccgcggccacgacaaggaggtcaaggcgatgctggcggcggggagcggcgagacgctggaccgcggctcccacgacttcatcccccgggtcatgccgcactaccgcgcgtggatgtcgcgctacggcaaggtgttcctgttggggtccggctcgcctccgtcgctgtgcgtgggcaaattcgacatggtgaaccggatcctctccgacaggacggggctgtacgccaaggtgaaccccggcccggtcatactggcgctgctgggcatggggcttgtcttgaccgagggcgaggactgggcgcgccaccgccgcgtggtgcacccggcgttcgccatggacaagctcaagatgatgacgggggcgatgacggcgtgcgcggcggaggtgatccgggcgtgggaggcgcgcgccgccgcggcgggcggcgaggtgacggtcgaggtaggggagcagttcgcggagctcaccgccgacgtgatctcgc

SEQ ID NO: 37720 - protein, 217 aa, Panicum virgatum
  misc_feature: Ceres CLONE 1991021
  misc_feature: SWISSPROT Homolog: EC 1.3.3.9 Secologanin synthase
MAMGGGGGGVGLVAAALAAVAATWLWAALVRLVWRPYATARAFARQGVRGLPHRPFRGHDKEVKAMLAAGSGETLDRGSHDFIPRVMPHYRAWMSRYGKVFLLGSGSPPSLCVGKFDMVNRILSDRTGLYAKVNPGPVILALLGMGLVLTEGEDWARHRRVVHPAFAMDKLKMMTGAMTACAAEVIRAWEARAAAAGGEVTVEVGEQFAELTADVIS

SEQ ID NO: 37721 - DNA, 682 bp, Panicum virgatum
  misc_feature: Ceres CLONE 1991023
  misc_feature: Encodes the peptide sequence at SEQ ID NO. 37722
agacccacacacccgtatgctcggatggagctatctgtgatcgatctctgtttctttatgcgctcgccatgtactactagccgcgctgcatcgacgacccagcttcgtatcgttgttgcttgtttaagttttttggttcttgattattcaagtgctttgctctagctagctaggtccacaatttattttttgcctgattttttcccttgcactatcaccaataattttcgtcaagtcgttgtttacgctgacgagtaccgcggcttagcttgtgtgtttatgcaatctcatcaggctgtgatcgagcaaagggtttagacggcgatccttggctcgctggccaggcaggagatggagcacgacgtgcaccatcaccaccgccaccaccaccagcagcagcggcaggaggccatggagctgcctccggggttccggttccaccccaccgacgaggagctcatcacgcactacctcgcctggaaggccgccgacccgcgcttcgccccgcgcgccgtcggcgaggccgacctcaacaagtgcgagccatgggacctgcccgctcgggcgaccatgggggagaaagagtggtacttcttctgcgtcaaggaccgcaagtacccgacggggctgaggacgaaccgggccaccgagtccggctactggaaggcgacgggcaaggacc

SEQ ID NO: 37722 - protein, 110 aa, Panicum virgatum
  misc_feature: Ceres CLONE 1991023
  misc_feature (23)..(110): Pfam Name: NAM Pfam Description: No apical meristem (NAM) protein
  misc_feature: Useful for making plants with modulated light quality sensitivity
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered terpenoid content
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Useful for making plants with altered lignin content
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 476 in the 10/666,642 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 854 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: Useful for making plants with modulated oxidative stress sensitivity
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: Useful for making plants with altered alkaloid content
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: Useful for making plants with altered cell wall content and/or composition
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 891 in the 10/374,780 US patent application
  misc_feature: The sequence is a functional homolog of SEQ ID NO 851 in the 10/374,780 US patent application
  misc_feature: The sequence is a functional homolog of SEQ ID NO 853 in the 10/374,780 US patent application
  misc_feature: The sequence is a functional homolog of SEQ ID NO 612 in the 11/435,388 US patent application
  misc_feature: The sequence is a functional homolog of SEQ ID NO 890 in the 10/374,780 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated light quality response
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 1012 in the 11/435,388 US patent application
  misc_feature: Useful for making plants with altered carbohydrate content
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: Useful for biocontainment applications
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 1729 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: The sequence is a functional homolog of SEQ ID NO 854 in the 11/435,388 US patent application
  misc_feature: The sequence is a functional homolog of SEQ ID NO 344 in the 10/666,642 US patent application
  misc_feature: Useful for making plants with modulated nitrogen use efficiency
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 886 in the 10/412,699 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
MEHDVHHHHRHHHQQQRQEAMELPPGFRFHPTDEELITHYLAWKAADPRFAPRAVGEADLNKCEPWDLPARATMGEKEWYFFCVKDRKYPTGLRTNRATESGYWKATGKD

SEQ ID NO: 37723 - DNA, 642 bp, Panicum virgatum
  misc_feature: Ceres CLONE 1991023-R
cccgcatgcacggaggtggcggacgtcgtggggccgtccgtgtccatggcggacgacctcgccgcgtgcgcgctgcctccgctgatggacgtgtccggtggcagcggcgccgccatgtcgctttcagctgctgctgcggcggcggcgggcatcgagctgccgccgccgtcgcaacacgtgacctgcttctccaacgcgctggagggccagttcctgaacccacccttcggcctgctccccgctgcgggccccgcggccgcggaccacctcgccatggcggccgcctccgcctcgccgttcctggcgagcatgatgcaggcgcagtacgacggcgccgcgggcgtgggcggcatggtgcatgagctcctgcaggagggcggcgggtggtacagcaagctgggagagagggagcgcctgagcggcggcgcgtcgcaggacaccggcctcacctcggaggcgaacgcgaaccccgccgagatctcgtcgcggcagcacatggatcaccatgatgcctccctttggggttactgatgagcttcatctcttgcgcgatcattaaaaattgaattagtattagtcaccggattggaaaaggggattactgttgtactgtactactagtgcaattgaatattatcatgc

SEQ ID NO: 37724 - DNA, 1450 bp, Panicum virgatum
  misc_feature: Ceres CLONE 1991054
  misc_feature: Encodes the peptide sequence at SEQ ID NO. 37725
acaccacaccaggtcaccagccttccgcacgatctctccgtgtcgcatcaccaccgcgtccttctccgaccgccttcccaccggattcggaggcgactcccgaggcagtgcgggccggcggcgcggaggctgctggcgtcggcgtccgcggcggccggcggccatggaggatctgggcatcgaggcgaaggaggccgcggtgcgcgaggtggcgaagctgctcccgctcccggagctcctctcctccatcgcatccatcaaatctgactacctcgcgcggcagcagacaaatgatgcacaactcagtacaatggtggcagaacaggtcgagcaagcccatgctggcatcaatgctctagcgttatctcaggaaacaataaacaaactacgtgagaacttcatagatatagacaagttgtgtcaggagtgtcaaactttaattgagaaccatgacaagatcaagctccttagcaatgcaagaaacaatctgaacacaactttaaaggatatgggaggtatgatgtccatttctgtggaggcggctgcagcacgtgactcattgagcaacgacaaagagttaattcacacttatgagagattaacagctcttgatggaaagaggcgttttgctctagctgctgctgcatctcataaggaagaagtcggcaggctaagagaatacttcgaggatgttgatcgaacatgggaaacgtttgagaagacattatggggccatatcactaactttttcaaacttgcaaaagagagccctcagacattggttagagctttgagggttgttgaaatgcaagaaatcatagatcaacaagttgcagaagaagcagctgaggccgagggtgcaggcgctatagcgacaataaccaaccaacgtagaactgcaaaaaaaggtgcaggggcagcagctaccccaagaaagggtactcaagaaaaatcaaaggttcagggaaagggctacaaggacaaatgctatgagagtattaggatggctgttgaatcccgcttcaacaagctgcttacggagcttgttttttcggaggatttgatggaagctttggaggaagccaaagcaattggagatgagcttggcgatatatatgactacgttgcaccatgctttcctcctagatatgaaattttccagctcatggtaaacctgtataccgaaaggttcattcagatgctaagacttctcagcgatagggcaaatgatattcaaaatataaatatcctgaaggtaactggctgggttgtacaatatcaagaaaatctgattggtcttggtgtggatgaatcacttgcccaagtttgttctgaaagtggtgcattggatcccctcatgaatatgtatgtcgagcgtatgcaggcaacaactaagaaatggtacagcaacattttagaggcagacaaaacacaaccaccaaaaagtacg

SEQ ID NO: 37725 - protein, 428 aa, Panicum virgatum
  misc_feature: Ceres CLONE 1991054
  misc_feature (13)..(428): Pfam Name: Sec6 Pfam Description: Exocyst complex component Sec6
MEDLGIEAKEAAVREVAKLLPLPELLSSIASIKSDYLARQQTNDAQLSTMVAEQVEQAHAGINALALSQETINKLRENFIDIDKLCQECQTLIENHDKIKLLSNARNNLNTTLKDMGGMMSISVEAAAARDSLSNDKELIHTYERLTALDGKRRFALAAAASHKEEVGRLREYFEDVDRTWETFEKTLWGHITNFFKLAKESPQTLVRALRVVEMQEIIDQQVAEEAAEAEGAGAIATITNQRRTAKKGAGAAATPRKGTQEKSKVQGKGYKDKCYESIRMAVESRFNKLLTELVFSEDLMEALEEAKAIGDELGDIYDYVAPCFPPRYEIFQLMVNLYTERFIQMLRLLSDRANDIQNINILKVTGWVVQYQENLIGLGVDESLAQVCSESGALDPLMNMYVERMQATTKKWYSNILEADKTQPPKS

SEQ ID NO: 37726 - DNA, 671 bp, Panicum virgatum
  misc_feature: Ceres CLONE 1991054-R
  misc_feature: Encodes the peptide sequence at SEQ ID NO. 37727
caactgtcggcagagtggccatcttgcccgcaactgcaccaatgatcctgtttgcaacctgtgcaatgttgctgttcatttggcccgtcagtgccccaagtctgatacattgggtgagcggggtgtgccacctcccttccgtggagctggcgctcccttccgtggcagcttcagtgacgtcatatgtcgggcctgcaaccaggttggccatatgagccgtgactgcatggctggtgccttcatgatctgccacaactgtggtggccgtggccacatggcttatgagtgcccctctgtgaatctcatggaccgcttcccccagcgccgtttctgaaggacgtccaagggcaattcagatgcctttacttgtggccctctgcgtcaagaagcattttattttaaatttgctttctaaactgtaacgaattctagctacgtcagatgcaatctttagttgtaattctgggatatgctatttaactgtgatgttctgttgaggataatccgcctgttcgattgctgatcagccgctggggccgtctttttcccactgttgctacagtgctatgtgaggagggttactccagcagcacatggttggggctgggaaacagccaaccgaacgggctgaatattagcagatgggaatacttatgaattccgaattcatc

SEQ ID NO: 37727 - protein, 110 aa, Panicum virgatum
  misc_feature: Ceres CLONE 1991054-R
  misc_feature (81)..(98): Pfam Name: zf-CCHC Pfam Description: Zinc knuckle
  misc_feature (60)..(77): Pfam Name: zf-CCHC Pfam Description: Zinc knuckle
NCRQSGHLARNCTNDPVCNLCNVAVHLARQCPKSDTLGERGVPPPFRGAGAPFRGSFSDVICRACNQVGHMSRDCMAGAFMICHNCGGRGHMAYECPSVNLMDRFPQRRF

SEQ ID NO: 37728 - DNA, 723 bp, Panicum virgatum
  misc_feature: Ceres CLONE 1991061
  misc_feature: Encodes the peptide sequence at SEQ ID NO. 37729
acacaaggtaggaactttgctctctctctctctctctcaccgcacatgcgcgtcgggccgcgtcgccaccaccccagccgcccgccgacacccgagatggccgccgccgccgcccacgcgccgccggggcgccggggcgcgctccttgtcctgctcgccgccgcgctcgtcgcggcgatgccggccacctgcgccgcggccaggagcaggaagtcgtaccgggccatcttcagcttcggcgactcgctctccgacgccggcaacctcatcgtcaacggcacgcccaaggcgctcaccaccgcgcgcccgccctacgggatgaccttcttccgcaagcccaccggccgctgctccaacggccgcctcgtcgtcgacttcctcgccgagcacttcgggctgccgctgccgccgccgtcgcaggcgcaggggaaggacttcaggaagggcgccaacttcgccatcaccggcgcgacggctctggagtactccttcttcaaggcgcacggcatcgaccagcgcatctggaacactggttccatcaacactcagatcgggtggctccagaacatgaagccgtcactctgcaaatcggagaaagactgcaaggactacctcagcaagtccctgtttgtggtgggggagtttgggggcaatgactacaacgcgccgctcttctccggtgtcccattttctgatgtcaagacttatgtgccccttgtggcc

SEQ ID NO: 37729 - protein, 208 aa, Panicum virgatum
  misc_feature: Ceres CLONE 1991061
  misc_feature: SWISSPROT Homolog: EC 3.2.1.51 Alpha-L-fucosidase
MAAAAAHAPPGRRGALLVLLAAALVAAMPATCAAARSRKSYRAIFSFGDSLSDAGNLIVNGTPKALTTARPPYGMTFFRKPTGRCSNGRLVVDFLAEHFGLPLPPPSQAQGKDFRKGANFAITGATALEYSFFKAHGIDQRIWNTGSINTQIGWLQNMKPSLCKSEKDCKDYLSKSLFVVGEFGGNDYNAPLFSGVPFSDVKTYVPLV

SEQ ID NO: 37730 - DNA, 1481 bp, Panicum virgatum
  misc_feature: Ceres CLONE 1991063
  misc_feature: Encodes the peptide sequence at SEQ ID NO. 37731
aggaagagcctgggtttccacagccccaagctcttcttctacaacattgtcacgcgattgattagctagactagtagtaatccgctcgctgtacccttcttgttggcttgcgatcccccagctagtctctctactactactttttttgtccgagcgagcgagcgagctagctcacctacgacgacgacaatggagtgcgagaccgggctcgtccgctccctgcacggcgacggcctgtgcgcgccaacgccggcgccggcgccgcgcgccgccgacccgctcaactggggcaaggccgcggaggacctgtccgggagccacctgggcgaggtgcagcggatggtggcggagttccgcgagccgctggtgcggatccagggcgcgagcctgagcatcgcgcaggtggccgccgtggcggccggcgccggcgaggcccgcgtcgagctcgacgagtccgcgcgcggccgcgtcaaggccagcagcgactgggtcatgagcagcatgatgaacggcaccgacagctacggcgtcaccaccggcttcggcgccacctcccaccgccgcaccaaggagggcggcgcgctccagcgggagctcatcagattcctcaatgccggcgccttcggcaccggcgccgacggccacgtgctgccggcggaggccacccgcgcggcgatgctcgtgcgcatcaacaccctcctccagggctactccggcatccgcttcgagatcctcgaggccatcgccaagctgctcaacgccaatgtcaccccatgcctgccgctccggggcaccatcaccgcgtcgggcgacctcgtcccgctctcctacatcgccggcctcatcacgggccgccagaactccgtcgcggtcgcccccgacggcaggaaggtggacgccgccgaggcgttcaagatcgccggcatcgagcacggcttctttgagctgcagcccaaggaagggctcgccatggtcaacggcacagccgtgggctccggcctcgcgtcgaccgtcctcttcgaggccaacgtgctcgccgtcatggccgaggtcatctccgcggtgttctgcgaggtcatgaccggcaagccggagttcaccgaccacctgacccacaagctgaagcaccaccccggacagattgaggctgccgccatcatggagcacatcttggaaggcagctcctacatgaagctggccaagaagctcggcgagctcgacccgctgatgaagccgaagcaggacagatacgcgctccgcacctcgccgcagtggctcggcccgcagatcgaggtcatccgcttcgccaccaagtccatcgagcgcgagatcaactccgtcaacgacaacccgctcatcgacgtctcccgtggcaaggcgctccacggcggcaacttccagggcacccccatcggcgtgtccatggacaacacccgcctcgcgctcgccgccatcggcaagctcatgtttgctcagttctc

SEQ ID NO: 37731 - protein, 430 aa, Panicum virgatum
  misc_feature: Ceres CLONE 1991063
  misc_feature (59)..(430): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
MECETGLVRSLHGDGLCAPTPAPAPRAADPLNWGKAAEDLSGSHLGEVQRMVAEFREPLVRIQGASLSIAQVAAVAAGAGEARVELDESARGRVKASSDWVMSSMMNGTDSYGVTTGFGATSHRRTKEGGALQRELIRFLNAGAFGTGADGHVLPAEATRAAMLVRINTLLQGYSGIRFEILEAIAKLLNANVTPCLPLRGTITASGDLVPLSYIAGLITGRQNSVAVAPDGRKVDAAEAFKIAGIEHGFFELQPKEGLAMVNGTAVGSGLASTVLFEANVLAVMAEVISAVFCEVMTGKPEFTDHLTHKLKHHPGQIEAAAIMEHILEGSSYMKLAKKLGELDPLMKPKQDRYALRTSPQWLGPQIEVIRFATKSIEREINSVNDNPLIDVSRGKALHGGNFQGTPIGVSMDNTRLALAAIGKLMFAQF

SEQ ID NO: 37732 - DNA, 686 bp, Panicum virgatum
  misc_feature: Ceres CLONE 1991063-R
  misc_feature: Encodes the peptide sequence at SEQ ID NO. 37733
tgcagcccccaactacccgctgatgcagaagctccgcgcggtgctgatcgagcacgcgctgcccaacggcgacgccgagcgcgtcgcggagacgtccatcttcgccaaggtggccgagttcgagcagcaggtgcgcgccgcgctgcccaaggaggtggaggccgcgcgcgccgccgtggagagcggcaaccccatggtccccaaccggatcagggagtgccgctcgtacccgctgtaccggttcgtccgcgaggagctcggcaccgagtacctgaccggcgagaagacccggtcgcccggcgaggagctcaacaaggtgctggtggccatcaaccagcgcaagcacatcgacccgctgctccagtgcctcaaggagtggaacggtgagcccctgccgctctgctgaactgcctgcccccacaggcaggaggagaggaaaccaacacacagaagaaaaacacaaacaaaagtatagcgtctcgagacagagcatttcaagatcattgtgaagttctacgatcagtctagctgatgatactctctatatttttaccgttcccttgtagctaaagttcattgtgaatgttgttgtgttcttgatgctgagacgccatggcctctgcaatgtgcgtggcctgggcatctgcatctgctgaaacttttactacctactttttaacttgtgt

SEQ ID NO: 37733 - protein, 134 aa, Panicum virgatum
  misc_feature: Ceres CLONE 1991063-R
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
AAPNYPLMQKLRAVLIEHALPNGDAERVAETSIFAKVAEFEQQVRAALPKEVEAARAAVESGNPMVPNRIRECRSYPLYRFVREELGTEYLTGEKTRSPGEELNKVLVAINQRKHIDPLLQCLKEWNGEPLPLC

SEQ ID NO: 37734 - DNA, 678 bp, Panicum virgatum
  misc_feature: Ceres CLONE 1991072
  misc_feature: Encodes the peptide sequence at SEQ ID NO. 37735
gctaccagcctactgccaccgctccgctttcccctcctctcgctcagctccgttctcggatcacctcggatcgcaagcgaggaggaggaggagaccgaggccacgatgatgcagcagatgcagcaggagccgtggaacgccgccgccgcggggctcctccggccgaccaagtcggcgccgtgctcgcccatcaagccggcggcggcggccatggcccggacccactccgactccttccacgtcgcgcacaaggtgcccgtcggcgacacgccctacgtgcgcgccaagcgcgtccagctagtggacaaggacccggagaaggctatcgcgctgttctggtcggcgatcaacgccggcgaccgcgtggacagcgcgctcaaggacatggccatcgtgatgaagcagcagaaccgcgccgaggaggccatcgaggccatcaagtcgctccgcagccggtgctccgaccaggcgcaggagtcgcttgacaacatcctcctcgacctctacaagagatgcgggcggctggacgaccagatctcgctgctcaagcacaagctgcagctgattcatcagggccacgcattcaacggcaagcgcaccaagacatcgcggtcgcaagggacgcagttccaggtcaccctcgagcaagaagccaccaggctccttggtaacctaggg

SEQ ID NO: 37735 - protein, 190 aa, Panicum virgatum
  misc_feature: Ceres CLONE 1991072
  misc_feature: Useful for making plants with altered terpenoid content
  misc_feature: Useful for biocontainment applications
MMQQMQQEPWNAAAAGLLRPTKSAPCSPIKPAAAAMARTHSDSFHVAHKVPVGDTPYVRAKRVQLVDKDPEKAIALFWSAINAGDRVDSALKDMAIVMKQQNRAEEAIEAIKSLRSRCSDQAQESLDNILLDLYKRCGRLDDQISLLKHKLQLIHQGHAFNGKRTKTSRSQGTQFQVTLEQEATRLLGNL

SEQ ID NO: 37736 - DNA, 1471 bp, Panicum virgatum
  misc_feature: Ceres CLONE 1991081
  misc_feature: Encodes the peptide sequence at SEQ ID NO. 37737
ggggcttccatttcttcctcctcgcctcctctcctgccggcagcctgctagggttcagggttttgcggccaccatgcaccaccacctgtcgcgcctcctcaggcgccgcctcctccaccccgccgcctccgcaccctccgccgctgccttctccacgtcctccaagaaaacctacgcgcgccgggccaagccgccgccaccggagcccgcaagcgccggggacgatgtgccggccgcctctcccgtagcggaagcggcggccgcggaggcggaggcgaaggccgcgtggcagagggagaagctcccgggcgagctcccgcggccgcccaccatcccgttccagcccaaagtggccaacaccgtgcgcctcgtcggcaccgtcggcgccccggtgcacttgcagcgcacggccgacggccgcttctccgcggtctccgtgctcgtgcaggaccgccgcctcgacttccccagattctgggttcccatagttttcaaagacgacttggcacaaatagctgcttcccacttgaaagaaaatgatcttgtctatgtgtctgggcaattaacttgtgatgttccacctctcaagcttgatgatggccaagcaaacattcaggttttagcacacttactgtcatttgttgatagtaaagttgttgaaacggatgtcgtaatcgatgaggaagaaggatttacggaagtcgtcgaggctgaaaaggaagttgaagaaaaaagagtcagctctaaatatccaccgggcaaagtttcaggttacaaaagcaagtgggataagttcaataagctgtggaatgatgttataactagaccacaagattggactgataaccggccacaaaagaagaatggatctataagtgcaaaatatcctgattttaagaacgaggtttcaaaagaggcactctggctcgacagtgcaccaaccgcagtgcttcaaaagctggatgatttggtcttcagtagtggttatgctgcaagcaaagaagataaaccttacagtaccggtacaaattggtcgaaatttaggaagagcccagatgcttctgctgtgtcaaaactaaaacctggagaggaggagttgtggcgagacctcctggacaatccagcgaattgggacaacagagcagacaagcccacaccaaaatatcctgatttcaagcacaaggactcgggcaaagctctgtggataggaaccaagtcacctcaatgggctatcgatgcccttccacccttgaaatttaagggaggcagcatgggtgcaagaaagcaagagaccttgctgtcatgaatcatgatggatataagagcttggcctaagtgtaagcccttatctgtgctatatgcacatctccattactaaatattggggctgtctttgcgtaaaggcgtgtggaaattatcttataattatacatactaacacctgattcgggtagagtactaaacaaaattc

SEQ ID NO: 37737 - protein, 410 aa, Panicum virgatum
  misc_feature: Ceres CLONE 1991081
  misc_feature (94)..(190): Pfam Name: SSB Pfam Description: Single-strand binding protein family
MHHHLSRLLRRRLLHPAASAPSAAAFSTSSKKTYARRAKPPPPEPASAGDDVPAASPVAEAAAAEAEAKAAWQREKLPGELPRPPTIPFQPKVANTVRLVGTVGAPVHLQRTADGRFSAVSVLVQDRRLDFPRFWVPIVFKDDLAQIAASHLKENDLVYVSGQLTCDVPPLKLDDGQANIQVLAHLLSFVDSKVVETDVVIDEEEGFTEVVEAEKEVEEKRVSSKYPPGKVSGYKSKWDKFNKLWNDVITRPQDWTDNRPQKKNGSISAKYPDFKNEVSKEALWLDSAPTAVLQKLDDLVFSSGYAASKEDKPYSTGTNWSKFRKSPDASAVSKLKPGEEELWRDLLDNPANWDNRADKPTPKYPDFKHKDSGKALWIGTKSPQWAIDALPPLKFKGGSMGARKQETLLS

SEQ ID NO: 37738 - DNA, 696 bp, Panicum virgatum
  misc_feature: Ceres CLONE 1991085
  misc_feature: Encodes the peptide sequence at SEQ ID NO. 37739
atggctttgtctccagcagaggctagggagttctagaacctaggctggcctcgcactagctactttgtcttggtccagtctctggtctctggtctctggtggcatcctgtcctacctggccatgcacttccatttcccggttcttggcttgtatccctgatcaactcagattccctggacgctcgagtttctggctctgccatctcatatctgtaaaacagtgctaagagtgcaatgtcaacctcagattttaatatatatttctggttatttctcttgctatgcaatttgggaatatcaaaatccctacctctggatagagacacacttttggacataaaaggttatctgaaagatccacagaattacttacgcaactgggataaatttcattcaccgtgccaattttacggtgttacatgtgaccaggattctggtgatgtcattgggatatcactctcaaatatatcactatcagggactatatcatcttcattttctcttcttcaacaattacgcactctggagcttggggcaaactccatctcaggaactgttcctgctgcaatggccaactgcacaaatcttcagtttctaaatctgtcaatgaacagtttaacaggccagttgcccgatctttcagcattgctcaacctacaagttcttgacttgtccacaaatagttttaatggggca

SEQ ID NO: 37739 - protein, 153 aa, Panicum virgatum
  misc_feature: Ceres CLONE 1991085
  misc_feature (25)..(64): Pfam Name: LRRNT_2 Pfam Description: Leucine rich repeat N-terminal domain
  misc_feature: SWISSPROT Homolog: EC 2.7.11.1 Non-specific serine/threonine protein kinase
MSTSDFNIYFWLFLLLCNLGISKSLPLDRDTLLDIKGYLKDPQNYLRNWDKFHSPCQFYGVTCDQDSGDVIGISLSNISLSGTISSSFSLLQQLRTLELGANSISGTVPAAMANCTNLQFLNLSMNSLTGQLPDLSALLNLQVLDLSTNSFNG

SEQ ID NO: 37740 - DNA, 738 bp, Panicum virgatum
  misc_feature: Ceres CLONE 1991103
  misc_feature: Encodes the peptide sequence at SEQ ID NO. 37741
  misc_feature (656)..(656): n is a, c, t, g, unknown, or other
acattccacaatccacacacaagcaaacacgcgcagtctctctgaagagtcccctacgaaccggacagatccagcagccagccacagagaagatcgacttcctcctcgccggccgtgcaaagtgatcgagtgagtgacctcccgcgcggcgcgccatgggcggtctggcatggatggtggccgcggccgccgccgcggtggcggcgtcgtgggcgttcaacgcgctgctgctgcacctcgtctggcgcccctacgccgtcacccggaggatggccgcgcagggcgtgcgcgggccggcctacaggttcttcttcgggaacctcggcgagatgaggcgcctccgcgccgaggccgcgggcgccacgctcgccgtcggcgaccacgacttggtccccctggtgaagccctaccaccgcaagtggatgtcgctctacggccggttgttcttgtactggaacggggcgacgccgaacgtgtgcgtggcggacgtgaacgtcgtcaggcaggtgctctccgaccgcaccgggctctaccccaagaacctcacgaacccgcacattagccgcctgctcggcaaggggctcgtcttcgccgacggcgacgactggaagcgccaccgcaaggtcgtgtacccggccttcaacatggacaagctncagatgatgacggcgaccatgtcccactgcgctcggtctatgatgtccgagtgggaggcgcagctggcccaggcgcccggcg

SEQ ID NO: 37741 - protein, 194 aa, Panicum virgatum
  misc_feature: Ceres CLONE 1991103
  misc_feature: SWISSPROT Homolog: EC 1.3.3.9 Secologanin synthase
MGGLAWMVAAAAAAVAASWAFNALLLHLVWRPYAVTRRMAAQGVRGPAYRFFFGNLGEMRRLRAEAAGATLAVGDHDLVPLVKPYHRKWMSLYGRLFLYWNGATPNVCVADVNVVRQVLSDRTGLYPKNLTNPHISRLLGKGLVFADGDDWKRHRKVVYPAFNMDKLQMMTATMSHCARSMMSEWEAQLAQAPG

SEQ ID NO: 37742 - DNA, 705 bp, Panicum virgatum
  misc_feature: Ceres CLONE 1991120
  misc_feature: Encodes the peptide sequence at SEQ ID NO. 37743
gcgcaaccccaagccgacgcttccgaactcacccacctcccccgcgctccgccgagatcgctcgcgcctttcggttcaagcaactccaccgcctggagcaatggggagcacggggcgcgaggcggaggtggcccgcgccgacttccccgacggcttcgtcttcggcgtcgctacctccgcgtaccagattgagggagcaagaagggagggaggcaaaggagacaacatatgggatgtattcacagaagacaaagaacgtgtcttagatagaagcaatggagatattgcagtagatcattatcatcgatacagggaagacatcgagctcatggcaagtttaggttttcgcgcttacagattttctatatcttgggctcgtatatttcctgatggcatgggggggaaggtcaatgagcaaggagttgccttctataacaaccttatcaactttatgattgcaaaaggagttgagccttatgcaactctgtatcactgggatcttccaaacaatcttcaaaagactctggggggctggatttctgaaaagattgtggattactttgcattgtatgcagaagcttgctttgcaaatttcggagacagagtaaagcgttggttgacaatcaatgagcctctccaaactgcatttaatggttatgggattggagtttttgcacccggaggatgcgagggtgaaactgctag

SEQ ID NO: 37743 - protein, 201 aa, Panicum virgatum
  misc_feature: Ceres CLONE 1991120
  misc_feature (11)..(200): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
  misc_feature: Useful for making plants with altered carbohydrate content
  misc_feature: Useful for making plants with modulated biomass
MGSTGREAEVARADFPDGFVFGVATSAYQIEGARREGGKGDNIWDVFTEDKERVLDRSNGDIAVDHYHRYREDIELMASLGFRAYRFSISWARIFPDGMGGKVNEQGVAFYNNLINFMIAKGVEPYATLYHWDLPNNLQKTLGGWISEKIVDYFALYAEACFANFGDRVKRWLTINEPLQTAFNGYGIGVFAPGGCEGETA

SEQ ID NO: 37744 - DNA, 1436 bp, Panicum virgatum
  misc_feature: Ceres CLONE 1991127
  misc_feature: Encodes the peptide sequence at SEQ ID NO. 37745
aactcccgcacgcatccaccaccgccaccaccacccgacgacctctcaccctcacgagccgcctgctctctccccccctcctcgcgagatagataaccctagctcccttccccttccttcccctcctctccaaccccgctcccgatctctataaaagaccccgaatttcgaaatcccgctcgaacccgcgacccgcgcgctccttcccgccccatttcggccccggatcggcgcggattcgcggcgcggagccgccgggtgctgcgtgcgcggtcccgatggcggagcccgggctcgagggcagccagccggtggatctgtccaagcacccctccggcatcgtccccacgctccagaatattgtatcaacagttaatttggattgtaaacttgaactcaaagccatagctttgcaagcacgcaatgcagagtacaacccaaagcgttttgctgcagtcatcatgagaataagagaacccaaaaccacggctctgatatttgcatcgggcaaaatggtctgtactggggcaaagagcgaacaacaatctaagcttgcagcaagaaagtatgctcgtattattcagaaacttggctttccagctaaatttaaggacttcaagattcagaatattgttggctcttgtgatgtcaagtttccaattaggcttgaaggccttgcatattcgcatggtgccttctcaagttatgaaccagaactgtttcctggtctgatctatcgcatgaaacaaccaaagattgttcttttgatttttgtttcaggcaagattgttttgactggtgcaaaggtgagagaggagacgtacactgcttttgaaaacatctatcctgtactgacagagttccgaaaagttcagcaatgatggctcgaagattacgccctcctaattacaagcttccttgagatttttctattgtgaccataacattaactgtacattaaaattctggaggagcttatagcatcttgtaatttatgtatgctttggtatgtgtagtggttgggtgggtttgttatggaagctgatggaacagtgggagatttgtttggattggtctgtttgggtaggccttagtgatcgggtacaccttatcatgtgtcatttgagtagtttgtgtgaactgcaaggtacatgcatgtcccatgtggttgcagcgttaactcagtactaacaagagtagagaaattttcccctagtttgttcgagacatgagtcccttaaagtcttttctgagtatctttcagtgtgctgtgcaatgatgaagaggctgcagtgtatgttggggcaaccactatgtaatgttggaactgtgactgataataagttatctgttatatttgagacttagggcagtgggaactgtcactgataataagttatctgttatatatgagacttagggcagtgggttcatcc

SEQ ID NO: 37745 - protein, 200 aa, Panicum virgatum
  misc_feature: Ceres CLONE 1991127
  misc_feature (110)..(196): Pfam Name: TBP Pfam Description: Transcription factor TFIID (or TATA-binding protein, TBP)
  misc_feature (20)..(105): Pfam Name: TBP Pfam Description: Transcription factor TFIID (or TATA-binding protein, TBP)
MAEPGLEGSQPVDLSKHPSGIVPTLQNIVSTVNLDCKLELKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLTEFRKVQQ

SEQ ID NO: 37746 - DNA, 633 bp, Panicum virgatum
  misc_feature: Ceres CLONE 1991130
  misc_feature: Encodes the peptide sequence at SEQ ID NO. 37747
gcacccacccaacccaaccaaccgcgcttgtttgtgtacactccactagtcccacccagctagcgccccctcccgcccaagccaggcatcagccagccaagaagcagagcagcgtccatggcggcggcgctgcggcgggccctgtccgcggcggtggcggcggcgctgcggcgggccctgtccgcggcggtggcggtggcgctgctggcggcgccgtcggcgtcggcggactcgtggctgtacgagaagttcaccacggacggccacgtgcgcgccgactacaacgcgcaggggcagcaggtgacgtcgctcatcctcgatcgccagtccggcggcgccttctactcccgccagaagtacctctacggcgtcttcagcatccagatgaagctcatccgcggcaactccgccggcaccgtcacctccttctacctgacctccggcgacggccccgggcacgacgagatcgacatggagttcatgggcaactccaccggcgagccggtggtgctcaacaccaacgtctgggccgccggcgacggcaagaaggaggagcagttctacctgtggtttgacccggccgccgacttccacacctacaccatcatctggaacgacaagaacgtcatcttc

SEQ ID NO: 37747 - protein, 171 aa, Panicum virgatum
  misc_feature: Ceres CLONE 1991130
  misc_feature (41)..(171): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MAAALRRALSAAVAAALRRALSAAVAVALLAAPSASADSWLYEKFTTDGHVRADYNAQGQQVTSLILDRQSGGAFYSRQKYLYGVFSIQMKLIRGNSAGTVTSFYLTSGDGPGHDEIDMEFMGNSTGEPVVLNTNVWAAGDGKKEEQFYLWFDPAADFHTYTIIWNDKNVI

SEQ ID NO: 37748 - DNA, 173 bp, Panicum virgatum
  misc_feature: Ceres CLONE 1991131
  misc_feature: Encodes the peptide sequence at SEQ ID NO. 37749
caccgtcaccgtcctgctcctcacgaacggggccttgtcctcgctcgtcctcaacctctccctcgacgacgtccacaactccctccggatgctcaccctcctcaactacttcgacaagaagaagctgcactccctccactccggctccgagctcgccaactatctctaccaca

SEQ ID NO: 37749 - protein, 57 aa, Panicum virgatum
  misc_feature: Ceres CLONE 1991131
  misc_feature: Useful for making plants with altered carbohydrate content
  misc_feature: Useful for making plants with altered cell wall content and/or composition
TVTVLLLTNGALSSLVLNLSLDDVHNSLRMLTLLNYFDKKKLHSLHSGSELANYLYH

SEQ ID NO: 37750 - DNA, 1907 bp, Panicum virgatum
  misc_feature: Ceres CLONE 1991138
  misc_feature: Encodes the peptide sequence at SEQ ID NO. 37751
gcgtctgagatattgaagcagctggaggacaggacggacaaaacagagagaagatggagataggcgcggttctgggtgcaatggaggagtacatgttcaccttggcggccatggcagtggggttcctggtggttgtttacctgtacgagccttactggaaggtccggcatgtgcccgggcccgtgccgctgccgctcatcggccacctccacctgctggcaaagcacggccccgacgtcttccccgtgctcgccaaaaagcacggtcctatcttcaggtttcacgtgggaaggcagcctttgatcatcgtggccaacgcagagctttgcaaggaggtaggcatcaagaagttcaagagcctccccaaccggagcttgccgtcgcccatcgccaattctccgatccatctgaaaggcctcttctccacaagggattcgaggtggtcggcgatgcgaaacgttatcgtctccatctaccagccgtcgcacctcgcggggctgatcccgaacatggagtcgtacatcgcgcgcgcggcggtgaacctcgaagacggaagcgaggtcgccttctccgatcttgcgctcagcctcgccactgacatcatcggagaggcggcgttcggcgcggatttcggcctatcccgaaagccggctgtgcctagcgacgacggtgcggagagcggagcctgcactgacgacgacggcagatctgttgcggcgaacaagtcatcagagttcataaaaatgcacatctactcgaccacgtcgctcaagatggacctgtcgggttctctatccaccatagtcggcacgctcgtgcccttgctgcagaagccgttgcagcaggtgctcttgagggtccccggctctgccgacagggagatcgcccgcgttaacggcgaactctgcaggatgatggacgccatcgtcgcagaccgggaggaggcgagggagcgggcgccggcatcgcagcagcacaaggatttcctgtccgtggttctcgcggcgagagacagcaacgcgtcctcacgagaactgctcacgccggactacttgagcgcgctgacctacgaacacctcctcgctgggtcggcgacgacagctttcacgctgtcctccgtcgtctacctcgtcgccaaacaccgggaggtggaggagaaactgctcagggaggtcgacgcattcgggcctagcagccgcgttcccacggcggacgatcttcagaccaagttcccttacctcgatcaggtggtgaaggagtccatgagatttttcatggtctcgccattggtggcacgagagacctccgagcgggtggagattggtggctatctccttcccaagggtatatgggtgtggatggcaccgggtgttctcgccaaggaccccatcaacttcccagaccctgagctattccggccggagcggtttgaccctgccagtgatgagcaaaagaagcggcacccatacgcacttatcccatttggaatcggccccagggtttgcatcggccagaagttctccattcaggagatcaagctcgcgctaatccacctctaccggcagtacgtgttccggcactctcccagcatggagtcccctctggagttccagtttggaattttgctccacttcaagcatggagtgaagcttcaggtcatcaagaggcacaagcattagattggtgatgttgtgaattatggtccttgatttctattggtgcaaatgtgcaacatgccaacatgtatcatatgcaccgttttgcaaaggaaaaacatagacgtcacgctaggttgtttagttagtgagtagccacttttgtattgtgttccgaggcccgaggcttttatcttgtaatctaataaaaagtgggccagcacacaaagtcgtgacgcggtgtttaactcg

SEQ ID NO: 37751 - protein, 541 aa, Panicum virgatum
  misc_feature: Ceres CLONE 1991138
  misc_feature (40)..(535): Pfam Name: p450 Pfam Description: Cytochrome P450
  misc_feature: SWISSPROT Homolog: EC 5.3.99.5 Thromboxane-A synthase
  misc_feature: Useful for biocontainment applications
  misc_feature: Useful for making plants with modulated biomass
MEIGAVLGAMEEYMFTLAAMAVGFLVVVYLYEPYWKVRHVPGPVPLPLIGHLHLLAKHGPDVFPVLAKKHGPIFRFHVGRQPLIIVANAELCKEVGIKKFKSLPNRSLPSPIANSPIHLKGLFSTRDSRWSAMRNVIVSIYQPSHLAGLIPNMESYIARAAVNLEDGSEVAFSDLALSLATDIIGEAAFGADFGLSRKPAVPSDDGAESGACTDDDGRSVAANKSSEFIKMHIYSTTSLKMDLSGSLSTIVGTLVPLLQKPLQQVLLRVPGSADREIARVNGELCRMMDAIVADREEARERAPASQQHKDFLSVVLAARDSNASSRELLTPDYLSALTYEHLLAGSATTAFTLSSVVYLVAKHREVEEKLLREVDAFGPSSRVPTADDLQTKFPYLDQVVKESMRFFMVSPLVARETSERVEIGGYLLPKGIWVWMAPGVLAKDPINFPDPELFRPERFDPASDEQKKRHPYALIPFGIGPRVCIGQKFSIQEIKLALIHLYRQYVFRHSPSMESPLEFQFGILLHFKHGVKLQVIKRHKH

SEQ ID NO: 37752 - DNA, 690 bp, Panicum virgatum
  misc_feature: Ceres CLONE 1991145
  misc_feature: Encodes the peptide sequence at SEQ ID NO. 37753
agtatgagttttactaccccaaagagaaaccaaagaagcttaagaaaaagaaatcatctccatctaatgaagaaaagaagcagtcaaggataaagtttgatgtcttattgacatcttatgagatgatcaacatggactcggcttttctaaaaaacatagaatgggaatgcttggttgtggatgaggggcatcggttgaaaaacaaagattccaagctgtttggtcaacttaaagaatataacaccagacatcgtgtgctattaacagggaccccggttcagaataaccttgatgagcttttcatgcttatgcacttccttgagggcgaaagttttgggagtatagctgagctccaagaagaattcaaggatataaaccaagacaagcaaattgagaagcttcacggaatgttgaagccacatcttcttcgaagattcaagaaagatgttatgaaagagcttcctccaaaaaaggaattgattttacgagttgaactgacgagcaaacaaaaggagtactataaggcgattctcaccaagaattatgaagtgttagcccgtcgtaacggtggacaaatctccttaataaacgttgtaatggagctgcgtaaactctgttgccatggattcatgattgatgaacctgattctgaacctgccaatccagaagaaggtctaaggaggcttttag

SEQ ID NO: 37753 - protein, 229 aa, Panicum virgatum
  misc_feature: Ceres CLONE 1991145
  misc_feature (1)..(211): Pfam Name: SNF2_N Pfam Description: SNF2 family N-terminal domain
YEFYYPKEKPKKLKKKKSSPSNEEKKQSRIKFDVLLTSYEMINMDSAFLKNIEWECLVVDEGHRLKNKDSKLFGQLKEYNTRHRVLLTGTPVQNNLDELFMLMHFLEGESFGSIAELQEEFKDINQDKQIEKLHGMLKPHLLRRFKKDVMKELPPKKELILRVELTSKQKEYYKAILTKNYEVLARRNGGQISLINVVMELRKLCCHGFMIDEPDSEPANPEEGLRRLL

SEQ ID NO: 37754 - DNA, 1454 bp, Panicum virgatum
  misc_feature: Ceres CLONE 1991160
  misc_feature: Encodes the peptide sequence at SEQ ID NO. 37755
gcacagctagcggcctgtcgagcttagcagccgtagtgcctgtcaactgtcatacccatccctctcgccccgggctctctccagctctcggccagccatggcggcggagaggctggaggcggcgccggccgccggcgacgagtacacgcaggacggcacgaccgacctccacggcaaccccgtgctccggtccaagcggggagggtggaaagcctgcggcttcgttgtagtgtacgaggtgttcgagcggatggcgttctacggcatctcgtcgaacctggtgctgtacctgacgacgaagctgcaccagggcgtggtgccgtcggcgaacaacgtcaccaactgggcgggcaccatctggatgacgcccgtcatcggcgcctacgtcgctgacgcgcacctcggccgctaccgcaccttcatggccgcctccgtcatctacctctgcggcatgatcctgctgacgctggcggtgtcgctgccggcgctgcggccgcccaagtgcggcgacggcacggcggaccccaagtgcacgcacgaggcgacgagcgtgcagctgggcgtcttcttcctgggcctgtacatcctggccgtgggcacgggcggcaccaagcccaacatctccaccatcggcgccgaccagttcgacgacagccacccgcgggagcgccgccacaagctctccttcttcaacttgtggatgttcagcatcttcttcggcacgctcttcgccaacacggtgctcgtctacatccaggacaacgtcggctggtccgtcgggtacgcgctccccacgctgggcctcgccgtctccatcgccatattcaccgccggcacgcccttctaccgccacaagcccacctccgagagccccttcgccaagatggccagggtcatcatcgcggccgccaggaagtgcgccgtcgcggcgcccgtggacccgcgcgacctgcacgagctcgacgacgcgcactacgccaagcgcaaggccgcccggctcccgcacacgcccaacctggccgtgctgagcaaggcggcggtgaagacgacgacgacgggcggcgcgtcgccgtggtcgctgagcacggtgacgcaggtggaggagacgaagcagatgctcaagatgctcccggtgctggccaccacgttcgtgcccagcgcgatgctcgcgcagatcaacacgctgttcgtgaagcagggcacgacgctggaccggcgcgtcggccaccacttcgagatcccgccggcgagcctccatgggttcgtgaccatctccatgctggtgtccgtggtgctgtacgaccgcgccttcatgcccctggcgcggcgcgcgacggggaacccgcgcggcatctcgctgctccagcgcatgggcgtcgggctggccatccacatcgccatcatgggcatcgcgtcggcgacggagcggcaccggctggcggtggcgcgggagc

SEQ ID NO: 37755 - protein, 452 aa, Panicum virgatum
  misc_feature: Ceres CLONE 1991160
  misc_feature (105)..(452): Pfam Name: PTR2 Pfam Description: POT family
MAAERLEAAPAAGDEYTQDGTTDLHGNPVLRSKRGGWKACGFVVVYEVFERMAFYGISSNLVLYLTTKLHQGVVPSANNVTNWAGTIWMTPVIGAYVADAHLGRYRTFMAASVIYLCGMILLTLAVSLPALRPPKCGDGTADPKCTHEATSVQLGVFFLGLYILAVGTGGTKPNISTIGADQFDDSHPRERRHKLSFFNLWMFSIFFGTLFANTVLVYIQDNVGWSVGYALPTLGLAVSIAIFTAGTPFYRHKPTSESPFAKMARVIIAAARKCAVAAPVDPRDLHELDDAHYAKRKAARLPHTPNLAVLSKAAVKTTTTGGASPWSLSTVTQVEETKQMLKMLPVLATTFVPSAMLAQINTLFVKQGTTLDRRVGHHFEIPPASLHGFVTISMLVSVVLYDRAFMPLARRATGNPRGISLLQRMGVGLAIHIAIMGIASATERHRLAVARE

SEQ ID NO: 37756 - DNA, 609 bp, Panicum virgatum
  misc_feature: Ceres CLONE 1991160-R
acagcaggggccccggcgccaccatcccgctcaccatcttcgtgctgctcccgcagttcgtgctcatgggcgtggccgacgcgttcctggaggtggccaagatcgagttcttctacgaccaggcgcccgagggcatgaagagcctgggcacgtcctacgccatgaccagcctcggcgtcggcaacttcctcagcagcgcgctgctgtccaccgtgtcgcgcgtcacgcagcgccacggccgggccggctgggtgctcaacaacctcaacgcgtcgcggctcgacaagtactacgccttcttcgccgtcctcaactgcgccaacctcctcgtcttcttcgtcgtgtgccggctctacgtctacaacgccgaggtctcccgcgtcgtcgacgccggcggcaacgccgccggggaggcggagaagaattcgaaccgggaggtcgggttgcagccggcaaacgtcggcgccgtggagtccaccatgtagggagggactgttagttggttagttccatatatcactacacaaatgtacttcccaacttccccgtgcacatcatgtcgcgtaatctcagtcagtacgggacagcagaaaaacgccaatccggttc

SEQ ID NO: 37757 - DNA, 1380 bp, Panicum virgatum
  misc_feature: Ceres CLONE 1991172
  misc_feature: Encodes the peptide sequence at SEQ ID NO. 37758
tctcccaaccccattggtgctccggacaaaagggaccaggcctcacccccgtctctccaatctcctcaggacttgttgcgcttcgagcagctagcagcctacagcgctagcagtcctttggatttcggtttggaagcaggggcgtcccaatcccaagcaagcagtctgcagatggcgactcagtggttctccaacatggtggtggacgagccgagcttcttccaccagtggcagtcggatgggctgctggagcagtacacggagcagcagatcgccgtggcgttcggccagggggaggtggaggtggaccgggccttggcggcggcgctgatgccgctgcagcagcccacggcggcggcggcggagcgccgcccgcgcaaggcggccaaggtcaacaccagctgggactcgtgcatcacggagcagggatcccccgcggactcctcatccccgaccatcctctccttcggcggccacgccttcgccaaggccgccgagacgcaccaggtgcccagcgccctctacggtggcgcgcctgcaaaggcgcccaagcaggaggtggtggacgccggcgcgacggcgttgttccaccaggagcgctcggccaagcggagctacgacgccatggtcgccgaggtcgccaaggtgccagccccggccaccacccgcccggcctcccagaaccaggaccacatcctggccgagcggaagcgccgcgagaatctcagccagcgcttcatcgccctctccaagatcgtccctggcctcaagaagatggacaaggcgtcagtgctcggcgacgcgatcaagtatgtgaagcagctgcaggaccaggtgaagggcctggaggatgaggctcgccggcggccggtggaggcggcggtgctggtcaagaagtcccagctgtctgccgacgacgacgacggctcgtcctgcgacgagaacttcgtgggcaccgaggctgcgggcacactgccggagatcgaggcccgggtgtcggaccgcacggtgctgatcaggatccactgcgagaaccgcaagggcgtgctcatcgccgcgctgtccgaggtcgagtgcctaggcctcaccatcatgaacaccaatgtgctccccttcaccacctccaccctcgacatcaccgtcatggccatggctggtgacgacttctgcatgtctgtcaaggatattgtcaagaagctaaatcaagcgttcaaatcatctttctgaagggtttagctcctgaacagacaaagcttaatctaggccaactttttcccatcagccacgaggattcgtggctaatggttaggttctcaggttcttccttgccatgcttccgaagagagttgctcgcagtcccccacagtgcccccccccccc

SEQ ID NO: 37758 - protein, 351 aa, Panicum virgatum
  misc_feature: Ceres CLONE 1991172
  misc_feature (170)..(219): Pfam Name: HLH Pfam Description: Helix-loop-helix DNA-binding domain
MATQWFSNMVVDEPSFFHQWQSDGLLEQYTEQQIAVAFGQGEVEVDRALAAALMPLQQPTAAAAERRPRKAAKVNTSWDSCITEQGSPADSSSPTILSFGGHAFAKAAETHQVPSALYGGAPAKAPKQEVVDAGATALFHQERSAKRSYDAMVAEVAKVPAPATTRPASQNQDHILAERKRRENLSQRFIALSKIVPGLKKMDKASVLGDAIKYVKQLQDQVKGLEDEARRRPVEAAVLVKKSQLSADDDDGSSCDENFVGTEAAGTLPEIEARVSDRTVLIRIHCENRKGVLIAALSEVECLGLTIMNTNVLPFTTSTLDITVMAMAGDDFCMSVKDIVKKLNQAFKSSF

SEQ ID NO: 37759 - DNA, 438 bp, Panicum virgatum
  misc_feature: Ceres CLONE 1991172-R
taggccggggagtttgacttttacaaaacctatttttccacagttttctttgtcccctttgccaatatgttaccctttcaccatgtttcttcgatgagaggacagtgtttttcaaacacaaataaatacctttgccgtcctctcaatcgtagtcacactgctccccaaaaaggttcgattgtggagaaaatggtgccatcttttttcagctctgagggggactatgcaagccttgattcggaagtacagtaggggtgcctcttcctttgtttttttgagggtcctacaagttgggttagccgcaacttgatggaccctttgcttgtagttttcacatgtgggttttgttgtcagttgtcacacgatcaagaggtagttgtgctctcttgtttactcgcatccaagcataaaaaaaaataaatgtgctcggttgttacc

SEQ ID NO: 37760 - DNA, 725 bp, Panicum virgatum
  misc_feature: Ceres CLONE 1991174
  misc_feature: Encodes the peptide sequence at SEQ ID NO. 37761
gattgggttgtttcctgaatcctgatttgatcggtggtgcgcttggagctgcttggtttgggattcttctcggagatttctggggaacgaggcaatggcgaccgccgggaaggtgatcaagtgcaaagccgcggtggcatgggaggccgggaagccgctgtcgatcgaggaggtggaggtggctccgccgcaggccatggaggtgcgcgtcaagatcctctacacctcgctctgccacaccgacgtctacttctgggaggccaaggggcagacgcccgtgttccctcggatctttgggcatgaggcaggaggtatcatagagagtgttggagagggtgtgactgacgtggcccctggtgaccatgtccttcctgtgttcactggggagtgcaaggagtgcccccactgcaagtcagccgagagcaatatgtgtgatctgctcaggatcaacactgaccggggtgtgatgattggtgatggcaagtcgcggttttcaatcaatgggaagcctatctaccattttgttgggacatccaccttcagcgagtacactgtcatgcatgttggttgtgttgcaaagatcaaccctgaggctccccttgataaagtttgtgttcttagctgtggtatttctactggtcttggtgcaacaattaatgttgcaaaacctccaaaagggttctacagtggctattttcggtctaggagctgttggtcttgctgct

SEQ ID NO: 37761 - protein, 210 aa, Panicum virgatum
  misc_feature: Ceres CLONE 1991174
  misc_feature (34)..(163): Pfam Name: ADH_N Pfam Description: Alcohol dehydrogenase GroES-like domain
  misc_feature: SWISSPROT Homolog: EC 1.1.1.1 Alcohol dehydrogenase
  misc_feature: Useful for making plants with modulated heat sensitivity
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGATINVAKPPKGFYSGYFRSRSCWSCC

SEQ ID NO: 37762 - DNA, 654 bp, Panicum virgatum
  misc_feature: Ceres CLONE 1991177
  misc_feature: Encodes the peptide sequence at SEQ ID NO. 37763
acctctcccccttccctgcctcaccaggtagcgcaagcacagcgagccgctctgtcctgccctgcccggcgtagcccagagcgagcgggacagagggaaacagacagagccagccaggtaaaaggcaaaagcacagcacattaaaagagaggccgcgagcagcggcagagagagagcagagagagaggagcatatatggcgatgccctttgcctccctgtctccggcagccgaccaccgcccctcgtcgctcctccccttctgccgcgccgcgccgctctccgcggtgggggaggccgacgcgcagcagcagcaccaccaccagcagcagcagcaagcgatgagcggcaggaggtgggcagcgaggccggcgcccttcacggcggcgcagtacgaggagctggagcaccaggcgctcatatacaagtacctcgtcgccggcgtgcccgtcccgccggacctcctcctccccatccgccgcggcttcgtctaccaccagcctgcccttggctacgggccctacttcggcaagaaggtggatccggagcccgggcggtgccggcgtacggacggcaagaagtggcggtgcgccaaggaggccgccccggactccaagtactgcgagcgccacatgcaccgcggccgcaaccgttca

SEQ ID NO: 37763 - protein, 152 aa, Panicum virgatum
  misc_feature: Ceres CLONE 1991177
  misc_feature (59)..(95): Pfam Name: QLQ Pfam Description: QLQ
  misc_feature (115)..(152): Pfam Name: WRC Pfam Description: WRC
MAMPFASLSPAADHRPSSLLPFCRAAPLSAVGEADAQQQHHHQQQQQAMSGRRWAARPAPFTAAQYEELEHQALIYKYLVAGVPVPPDLLLPIRRGFVYHQPALGYGPYFGKKVDPEPGRCRRTDGKKWRCAKEAAPDSKYCERHMHRGRNR

SEQ ID NO: 37764 - DNA, 716 bp, Panicum virgatum
  misc_feature: Ceres CLONE 1991179
  misc_feature: Encodes the peptide sequence at SEQ ID NO. 37765
gctgcggctctgctccgccggcgagtgacttcatggcgtcgccgcacctccccttcctctccttccccaaaacccagccacccctcgccctccaccgcgcccgcgcgctcccctcccgtccgcccgacgccgcgggggccgggcccgccgcgcccactcgcggggaccgcttcctcgaccgccacctcgccaccgacgccgccgcgcgcgtcctcgcgcccgacgacgcccagaggcgccagcgccgcaaagacaaacgccgggccctggcaaggaagccgtccggcctcccttcctgctacggctgcggcgcgccgctgcacacggcggaggaggccgcgccgggatacgtcgaccccgccacctaccacctgaaaaagaggcaccatcagctaagaaccgttctctgcgcaagatgcaagctgctgtctcatggccatatggtcactgctgtcggtggccacggcggttatccagggggcaagcaatttgtctcagcggaagagcttagggacaagctttcctacctccgccacgagaaagccttgatagtcaaactggtcgacatcgttgacttcaatgggagtttcctgacacgagtacgtgatttcgctggtgctaatcctattattcttgtcataaccaaggttgatctcctccctagagacactgatttgaactgcgtaggtgattgggttgtagagtcagctgtcaag

SEQ ID NO: 37765 - protein, 227 aa, Panicum virgatum
  misc_feature: Ceres CLONE 1991179
  misc_feature: SWISSPROT Homolog: EC 1.14.13.39 Nitric-oxide synthase
  misc_feature: Useful for making plants with modulated flowering time
MASPHLPFLSFPKTQPPLALHRARALPSRPPDAAGAGPAAPTRGDRFLDRHLATDAAARVLAPDDAQRRQRRKDKRRALARKPSGLPSCYGCGAPLHTAEEAAPGYVDPATYHLKKRHHQLRTVLCARCKLLSHGHMVTAVGGHGGYPGGKQFVSAEELRDKLSYLRHEKALIVKLVDIVDFNGSFLTRVRDFAGANPIILVITKVDLLPRDTDLNCVGDWVVESAV

SEQ ID NO: 37766 - DNA, 716 bp, Panicum virgatum
  misc_feature: Ceres CLONE 1991183
  misc_feature: Encodes the peptide sequence at SEQ ID NO. 37767
ctgcttgccgggcgcctgaccttatctcctccccccttcccctccatccccgagatatttccgcgcctccaccccgccaccatggagtccggcctcgtcgcaagccaccgcctccgcctcccgctcccctccgccgccgcgggcgccgcgcgcagccacctcctccgccaccgccaccccctcgcgcccgcgcccctccgcctcagcctcccgcgccacctcccgcggcccaccccgctgcgcctccccgccgcgctccctctccgccctcccctcccgcccctccgcgcctccgccgccgcggcagcggccgcgtccccggcgccgggggacgacgcgtcctcgcccaagttcctcggcgtcgagacgaagacgctgaagaagatcgtgcccctggggctcatgttcttctgcatcctcttcaactacaccatcctgcgggacaccaaggacgtgctcgtcgtcaccgccaagggcagcagcgccgagatcatccccttcctcaagacgtgggtcaacctgcccatggccgtcggcttcatgctcctctacaccaagctcgccgacgtcctctccaaggaggcgctcttctacgccgtcatcttccccttcatcgccttcttcggggccttcgcctacgtgctctaccccatgcgcgacgctatccaccccaccgcgctcgccgaacgcctcctcgccgcgctcgggaccagctt

SEQ ID NO: 37767 - protein, 211 aa, Panicum virgatum
  misc_feature: Ceres CLONE 1991183
  misc_feature (68)..(211): Pfam Name: TLC Pfam Description: TLC ATP/ADP transporter
MESGLVASHRLRLPLPSAAAGAARSHLLRHRHPLAPAPLRLSLPRHLPRPTPLRLPAALPLRPPLPPLRASAAAAAAASPAPGDDASSPKFLGVETKTLKKIVPLGLMFFCILFNYTILRDTKDVLVVTAKGSSAEIIPFLKTWVNLPMAVGFMLLYTKLADVLSKEALFYAVIFPFIAFFGAFAYVLYPMRDAIHPTALAERLLAALGTS

SEQ ID NO: 37768 - DNA, 711 bp, Panicum virgatum
  misc_feature: Ceres CLONE 1991200
  misc_feature: Encodes the peptide sequence at SEQ ID NO. 37769
gggagcgacctctccccctcgtccttgcccgccccggcgaggcgagctgcaggcacaccggcgaggcgatggagcagccgaacgcccgccacgtggtcgacggaatgtctgtggggagcgaggccgcgaggaacaagaggcaggctgcggccggcggtgccgaccacctcagcgcgctcccggacccgctcctgcaggacatcctgtccttcctgccatcgccggatgccgtccgaacgtgcgtgctcgctcaccgctggcgcgacctgtggaagggtgttcctgcgctccgcatcacccgcgacgtcgccgacaagtactggggcccgaccgcgctgaatgggttcgtcaaccacttgctgttcctccgcgaccggtcgcctctccgagtggccgagttcgactccaaagattggggggattttgatgagactgtgaggtacctagcgctttgggtgcggtacagcctgtcgtgccaggtcgccgaactctatgttgcctgcgaggacgacctggatcgttggctgcttcccaaggggcttataacctccgagcacttgacaaagcttgagcttgtcctggtcatgtcggagcacgatctggatttctcgagctgtgtgtctctgcaggatcttaagatggaatattctagcatttactggcacaagatcacttccccatccctaaagtgtctcagaatctcaggatgcc

SEQ ID NO: 37769 - protein, 214 aa, Panicum virgatum
  misc_feature: Ceres CLONE 1991200
  misc_feature (32)..(79): Pfam Name: F-box Pfam Description: F-box domain
MEQPNARHVVDGMSVGSEAARNKRQAAAGGADHLSALPDPLLQDILSFLPSPDAVRTCVLAHRWRDLWKGVPALRITRDVADKYWGPTALNGFVNHLLFLRDRSPLRVAEFDSKDWGDFDETVRYLALWVRYSLSCQVAELYVACEDDLDRWLLPKGLITSEHLTKLELVLVMSEHDLDFSSCVSLQDLKMEYSSIYWHKITSPSLKCLRISGC

SEQ ID NO: 37770 - DNA, 635 bp, Panicum virgatum
  misc_feature: Ceres CLONE 1991208
  misc_feature: Encodes the peptide sequence at SEQ ID NO. 37771
tcatgctctcgacgaacaacttcaccggccagataccggagggactctcgcggtgccaggcgctgacgcagctcgacctggcgaacaacagcctctccggcgccatccccgccgcgctcggtgagctcggcaacctgacggacctgatgctcaacaacaacagcctctccggcgagctgccgccggagctcttcaacctcaccgagctccggactctggcattgtatcacaaccagctcaccggccggcttccggacgccatcggccgcctcgggaacctcgaggtactgtacctgtacgagaaccagttcaccggcgagataccggagtccatcggggactgcgcgagcttgcagatgatcgacatcttcgggaaccggttcaacgggagcataccggcgtccatggggaacctgtcgcagctgatgttcatcgacttcaggcagaacgagctgtccggcatgatcccgccggagctcggcgagtgccagcagctccaagttcttgatttggccgacaatgctctgtccgggccgatccccgagacgttcgggaagctccgttcgctgcagcagttcatgctctacaacaactcgctctccggcaccatcccggacggcatgttcgagtgcccg

SEQ ID NO: 37771 - protein, 210 aa, Panicum virgatum
  misc_feature: Ceres CLONE 1991208
  misc_feature: SWISSPROT Homolog: EC 2.7.11.1 Non-specific serine/threonine protein kinase
MLSTNNFTGQIPEGLSRCQALTQLDLANNSLSGAIPAALGELGNLTDLMLNNNSLSGELPPELFNLTELRTLALYHNQLTGRLPDAIGRLGNLEVLYLYENQFTGEIPESIGDCASLQMIDIFGNRFNGSIPASMGNLSQLMFIDFRQNELSGMIPPELGECQQLQVLDLADNALSGPIPETFGKLRSLQQFMLYNNSLSGTIPDGMFEC

SEQ ID NO: 37772 - DNA, 715 bp, Panicum virgatum
  misc_feature: Ceres CLONE 1991213
  misc_feature: Encodes the peptide sequence at SEQ ID NO. 37773
cggagctgtcgctcccctcccgtcgcacctccacacgacggcgccgcccctccactccgcctcgcgccgtgccagatatgcggggacgacgtcggggtgggcttcgacggggagcccttcgtggcctgcaacgagtgcgccttccccgtctgccgcgcctgctacgagtacgagcgccgggagggctcgcaggcgtgcccgcagtgccggacgcggtacaggcgcctcaagggctgcccccgcgtcaccggcgacgaggacgaggacggcgtcgacgacctcgagggcgagttcggcctgcgccacggcgggggagagggggacggcgatgacccccgggacgtcgccgcgtccatgctgcgggcgcacatgagctacggccgcggcgacgcgcaccacccggcggccggcttcggcgccgcccccggcgtcccgctcctcaccaacggccaaatggtcgacgacatcccgccggagcagcacgcgctcgtgccgtcctacatgggcggcggcggcggcgggggcaagaggatccacccgctccccttcgcagatccgagccttccagtgcaaccgagatccatggacccgtccaaggatctggccgcctacggctacggcagcgtggcctggagcgaccggatggagcgctggaagaagaaccaggagcgcctgcagcacgccaggagcgagggcggcgatgattgggacggcg

SEQ ID NO: 37773 - protein, 238 aa, Panicum virgatum
  misc_feature: Ceres CLONE 1991213
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Useful for making plants with modulated biomass
  misc_feature: Useful for making plants with altered cell wall content and/or composition
RSCRSPPVAPPHDGAAPPLRLAPCQICGDDVGVGFDGEPFVACNECAFPVCRACYEYERREGSQACPQCRTRYRRLKGCPRVTGDEDEDGVDDLEGEFGLRHGGGEGDGDDPRDVAASMLRAHMSYGRGDAHHPAAGFGAAPGVPLLTNGQMVDDIPPEQHALVPSYMGGGGGGGKRIHPLPFADPSLPVQPRSMDPSKDLAAYGYGSVAWSDRMERWKKNQERLQHARSEGGDDWDG

SEQ ID NO: 37774 - DNA, 614 bp, Panicum virgatum
  misc_feature: Ceres CLONE 1991215
  misc_feature: Encodes the peptide sequence at SEQ ID NO. 37775
cgccacccaaaggcggccgctgctttgctgctccaaagctccggcgccggcgacgcggccaacagatgggtgccgagcgcgcgcggcgctggaagctgctgcccttccggtccctgtccctgccgccggcgtccaaggcgaggaacaggccgccggacgtcgtccctgtccctccgtccccggcgcggaaggaggcggaagacgaggaggtgccggcggagttcctgtgcccgatcctcggcgcgcccatggcggaccccgtcatcctgccgtccggccggacgtacgagcgcgcgtgcgtccgggcctgcaacgagctggggctctccctcgccccggacggagtggtggcgggggagcggatcacgacgggcggtgctgctgccgttgccgtcgccatacccaacgacgcgctccgggcggccgtgcggacgtggtgcgcgcgctccggtcgcgccgcgcccgtgtcgccttctgtcgaggaggcgagggaggctgtgctccgcgcggtgccggcgccggacagggcggcgtcgaacctgtcgtgctcatcggaggcggcggcgcttgcgccggcgaggtcggggtccaacgtctcgtgctcgtcatccact

SEQ ID NO: 37775 - protein, 182 aa, Panicum virgatum
  misc_feature: Ceres CLONE 1991215
  misc_feature (48)..(131): Pfam Name: U-box Pfam Description: U-box domain
MGAERARRWKLLPFRSLSLPPASKARNRPPDVVPVPPSPARKEAEDEEVPAEFLCPILGAPMADPVILPSGRTYERACVRACNELGLSLAPDGVVAGERITTGGAAAVAVAIPNDALRAAVRTWCARSGRAAPVSPSVEEAREAVLRAVPAPDRAASNLSCSSEAAALAPARSGSNVSCSSS

SEQ ID NO: 37776 - DNA, 441 bp, Panicum virgatum
  misc_feature: Ceres CLONE 1991230
  misc_feature: Encodes the peptide sequence at SEQ ID NO. 37777
atcccaaaaccccccgccattaccaccaccttcctgcgttactcccgaacccgaatcccctgtctctctctctgcctgtcacgatagacgcgcggccattaccaggagcaagcgaacgctctctccgtctccagctctgccctgtttcgtcccaagaaacaggggagcgagcgagcgggcaggaggagcggaggccggcggcggcggcggcaatgggggaggggatggacgcgcccggcgcgggctggccgacgtggcgcgcggcggcggcgctcgccgtggcggcgtggctggcgctgcacgtggcggcgcgcgtcgcggacgcgctgtggtggcggccccggcgcctggaggcgcacttcgcggcgcagggcgtgcgcggcccgccgtaccggttcctgctggggtccgtgagggagatggtggcgctcatggcggagg

SEQ ID NO: 37777 - protein, 76 aa, Panicum virgatum
  misc_feature: Ceres CLONE 1991230
  misc_feature: SWISSPROT Homolog: EC 1.3.3.9 Secologanin synthase
MGEGMDAPGAGWPTWRAAAALAVAAWLALHVAARVADALWWRPRRLEAHFAAQGVRGPPYRFLLGSVREMVALMAE

SEQ ID NO: 37778 - DNA, 397 bp, Panicum virgatum
  misc_feature: Ceres CLONE 1991230-R
aaattgacaaaaaaaggtttccatgaggccggggatgaggggctgtgggccactccggtgccagaaaaaaaacatactaggacatgtgtagaatgaccgaaatgcccatccccagccaccccctgtgtatatgccaagtgatactaaaagccaagaagcaccaaccttttgtcctagcctgcgcctcgggccccacccaggttgcccgaaaatgccctccttaacaaaccggatcaggcccagcctttttttaagatttgatgacacacaacggggagggccccaccacccctccctgtttttgttccttgcttgccatggcacccggtgttatgtattttgtacagtggtttgtttactccagtctcctacgttggtatagacgaaaatgcaatgg

SEQ ID NO: 37779 - DNA, 1861 bp, Panicum virgatum
  misc_feature: Ceres CLONE 1991243
  misc_feature: Encodes the peptide sequence at SEQ ID NO. 37780
attccttctccgactccgccgcgcgccgcgcggagctcctccttgccacagctcgagctgagctccagctctagagggatatactatacagagcggaaaggcagagtgagaggctgcaagcctgctaggtgtggttgtgctctgctctgctctgctccaccagtcaagcgggatccgaagctcaggagacgaacacggaagctacttgctagtgtgcgctctgattgcgcagaaagtgattggtcggtcatcgatgtttgtggcgatctgagcaatgaaccagttcgtgcctgattggaacagcatgggagacacctccaggccgctcggcgacgacgatgaccttgtcgagctgctctggtgcaacggccatgtcgtcatgcagagccagaacaaccggaagctaccgccgaggcccgagaagccggcgggggcagcagctccagcccccgcgtcggcggcgcaagacgacgaggccggcctctggttcccgttcgcgctggccgactcgctcgacaaggacatcttctcggagttcttctgtgaagcaccagcggcggcggctccggtgcccgcaaccccaggcgtcgaggacggcaagcctgcctgcagggacgtcccgatggaggacgacagcaggcgcggcggggcgtgcgcggtgtccgaggccccgagcgacctgatgccgccgcccaagtcggcgcccgtgtcctggtccaggcagcagacgatgagcctggcgacggacggcggtgacaacgccggcgacctctcggacctcgtccgggcgggcagcgcggggaaggcgtcggcggaggccggcgcgtcgtcgatgctgagcacgatcgggtccagcatctgcgggagcaaccaggagctggtgcagcgcgcggtgagcgcggcgggccgcgtcgcttgcggcggcggctgctccggcagcgcgctgccgtctgcgatgggaagcgcgaacgcgaacgccagaggcaggggcaacgaggccacgtcggggcggtccaactactgcttcggcaccgccgccaccaccaccaccaccgagccgacgagcaccagcaaccggagcagcaagcggaagcggctcgacaccgaggactccgagagccccagcgaggacgcggagtcggagtccgccgcgatgttggcgcgcaagccgccgcagaagctgacgatggcgcggaggagccgcgccgccgaagtgcacaacctctccgagaggaggaggcgggacaggatcaacgagaagatgagagccctgcaagagctgatacctcactgcaacaagaccgacaaggcgtcgatgctggacgaggccatcgagtacctcaagtcgctgcagctgcagctgcagatgatgtggatgggcagcggcatcgcggcgccgccggtgatgttccccggcgtgcaccagtacctgccgcggatgggcgtcgggatgggcgccgcggcgatgccgtccatgccgcggatgccgttcatggcgccgcagccggtggtgcccaacgcgcccgtccacaaccccgtgccgctctcgccggcggcctaccgggggcacatgccggcggtgggcatcaccgagccctacgcgcactacctcggcgtcaaccacctgcagccgacgctgtcccagcatttcgcgcagggcgtgggatactacccgctgggggcgaaggccgccgtgcagcagagtccggcgctccaccacgtgcccggtggcggcatgcccgccgtcgccgccgcgccgggggggctgccgcatgaaaccgctccgagcagaggaccaggatgactatagcaggacaggacaaataatcccctggctgagctgatgttttgacaagtgtgg

SEQ ID NO: 37780 - protein, 509 aa, Panicum virgatum
  misc_feature: Ceres CLONE 1991243
  misc_feature (311)..(360): Pfam Name: HLH Pfam Description: Helix-loop-helix DNA-binding domain
MNQFVPDWNSMGDTSRPLGDDDDLVELLWCNGHVVMQSQNNRKLPPRPEKPAGAAAPAPASAAQDDEAGLWFPFALADSLDKDIFSEFFCEAPAAAAPVPATPGVEDGKPACRDVPMEDDSRRGGACAVSEAPSDLMPPPKSAPVSWSRQQTMSLATDGGDNAGDLSDLVRAGSAGKASAEAGASSMLSTIGSSICGSNQELVQRAVSAAGRVACGGGCSGSALPSAMGSANANARGRGNEATSGRSNYCFGTAATTTTTEPTSTSNRSSKRKRLDTEDSESPSEDAESESAAMLARKPPQKLTMARRSRAAEVHNLSERRRRDRINEKMRALQELIPHCNKTDKASMLDEAIEYLKSLQLQLQMMWMGSGIAAPPVMFPGVHQYLPRMGVGMGAAAMPSMPRMPFMAPQPVVPNAPVHNPVPLSPAAYRGHMPAVGITEPYAHYLGVNHLQPTLSQHFAQGVGYYPLGAKAAVQQSPALHHVPGGGMPAVAAAPGGLPHETAPSRGPG

SEQ ID NO: 37781 - DNA, 732 bp, Panicum virgatum
  misc_feature: Ceres CLONE 1991259
  misc_feature: Encodes the peptide sequence at SEQ ID NO. 37782
gcgccgcgtcgcccgtctgcgtcgatggcgatggagattccggcggaggtgcgccgctactggctgccgatcctcctcttcaccgctggtttcctcttccagcttctcgtcctgccccgccacttcccgcgcacccactacgacgtgctgggaattgaaaggtttgcgccggtggagcgggtcgtcgaggcctacgagcagctatccaaggagtggctatctgaaacgaatcaccaaccaactgttgatattataaagatccgttatgcatacgagctgttgacaaatccaattttaaagagggattatgatctttttggactggatgagcatatggtgacctctctcccttcttctatgtttatgtgcacatctatcattgagagtttcttcacttttatcaatcctgttcagtgttttaaaggcattgccaaggcgtccaggcgtgcccagctcgccttggattgccttgttgcctttaaaacactgctcctgtttcccttttatctggtaggatgtccttgagagagtcaaagagcaatatcaaaaagagcactttctgaaaatagatctcccattattaaaagactgcagttagtttgaatgatgatgccttcaatgtactcacacatgagtcattcatgtctgctattgctgaagaatacccactaataatactggtatattcaaagggcagtcctcggtgttctcaatttattgagtactggaagc

SEQ ID NO: 37782 - protein, 166 aa, Panicum virgatum
  misc_feature: Ceres CLONE 1991259
  misc_feature (37)..(96): Pfam Name: DnaJ Pfam Description: DnaJ domain
MAMEIPAEVRRYWLPILLFTAGFLFQLLVLPRHFPRTHYDVLGIERFAPVERVVEAYEQLSKEWLSETNHQPTVDIIKIRYAYELLTNPILKRDYDLFGLDEHMVTSLPSSMFMCTSIIESFFTFINPVQCFKGIAKASRRAQLALDCLVAFKTLLLFPFYLVGCP

SEQ ID NO: 37783 - DNA, 1473 bp, Panicum virgatum
  misc_feature: Ceres CLONE 1991264
  misc_feature: Encodes the peptide sequence at SEQ ID NO. 37784
cccagcagcggcagcggcagcggcttcgccacgcggggaacggctgcgccagacgaggaagaggggagggacggcgcgaccttggccgggtcggaggaagaggcggaggcaaccaatgattcattcgcctactcgctaagggagtgccagaagcagcggcggcggcttaagtcagaggggtctgggctggcgcggccgccggcctcgcatgagctcaacggtggtggaggtattgagcttctagtgctctcgcccaggtgtttgattgggggtaatgtcggaggaatgagcaagagctcgacggcatcatcccggagcagatcaggcacaggcacaggcacattcccgagccctgggactccgaactacaatcggcattgtgcgggcagcatgcagtactctaagggttggagttcagaacgtgtgccactgggtacaggcagcaataggaggtatgggggcagtggggttgtgcttccttttaacaatggtaggaagctgccatcaaaatgggaggatgcagagaagtggatcctgagtccggtttcctgcgatggggttggaaggatgtctgcaccagctccgcatcatagacgtcccaagtcgaaaagtggtccacttggccacccagctggtgttccaggagcttatgcagctgtttcgccgcttgttccctgctttgatggtgttcttgcggcagctaattatgcagtacattcacctttctctgctggggttctcatacctgagcacggtcgcattggtgacttcagcagtggaagaggcaggtctggtgatgatggcagcagcagatcctactctgccgagaaggagccatacatattgaggtcggcgagcatacatgcatggacagaaacgcttatggaggcgtctgcttttgctaattcaatctcagaagaaaccacacgagatgataaactgcaaggccagcaggaagcaacttcagctatttccagtccaatcataaaaaaagatgttgctacacagatgagccctgaggataaaatatcatccccttcaaaagcgaggcattcctgctctagcctgccttcaggacatctgctaagagaagcaaatagtcatacacataaacctgaaatcagggacgtgcaggtagatgatcaagtaactgtgacccggtggtccaagcgacatgtaacacgaggctctgataagcggtcagcaaatattattgaatggaggaagaagaccacggagactcgggctccatcttttgatgaaaaagagagagaaagttgcatgtcaaagtgcaaaagggaggaagtaaaaatcactgcttgggaaaatctacagaaagcaaaagctgaggctgctatacggaaattggagatgaagattgaaaagaaaagatcatcatcaatggacaaaattttaggcaaactccgctctgctcagaagaaagcagaagacatgcgaagtgcgatttcttct

SEQ ID NO: 37784 - protein, 490 aa, Panicum virgatum
  misc_feature: Ceres CLONE 1991264
  misc_feature (407)..(490): Pfam Name: Remorin_C Pfam Description: Remorin, C-terminal region
PSSGSGSGFATRGTAAPDEEEGRDGATLAGSEEEAEATNDSFAYSLRECQKQRRRLKSEGSGLARPPASHELNGGGGIELLVLSPRCLIGGNVGGMSKSSTASSRSRSGTGTGTFPSPGTPNYNRHCAGSMQYSKGWSSERVPLGTGSNRRYGGSGVVLPFNNGRKLPSKWEDAEKWILSPVSCDGVGRMSAPAPHHRRPKSKSGPLGHPAGVPGAYAAVSPLVPCFDGVLAAANYAVHSPFSAGVLIPEHGRIGDFSSGRGRSGDDGSSRSYSAEKEPYILRSASIHAWTETLMEASAFANSISEETTRDDKLQGQQEATSAISSPIIKKDVATQMSPEDKISSPSKARHSCSSLPSGHLLREANSHTHKPEIRDVQVDDQVTVTRWSKRHVTRGSDKRSANIIEWRKKTTETRAPSFDEKERESCMSKCKREEVKITAWENLQKAKAEAAIRKLEMKIEKKRSSSMDKILGKLRSAQKKAEDMRSAIS

SEQ ID NO: 37785 - DNA, 661 bp, Panicum virgatum
  misc_feature: Ceres CLONE 1991281
  misc_feature: Encodes the peptide sequence at SEQ ID NO. 37786
acggctccgtcctccgatccggacagggttgcttcggccatcgcccctgccctgtccctgtcccctcgctccgatccggcacatactagaaataaatacggcagtggcggcagacggcggcggttgcggaggatggtgaagttctcgcgggagtacgaggccagcatcatccctgagtggaaggccgccttcgtcgactacaactgcctcaagaagctcatcaagaggatcaagatcgcccgccgcgaagccgcgccgccaacgctgctcgccaactccggcgaccactatggcttctccgttcttgaccccgtccgcgccctcaccgctcgcctcgccgctgccagggcgccgccaccttcttcaccagaggagggcgaggaggaggagacctcggagtcggattcaggggagctcgtgccatccacgggcaagcatgaaaaagagtttttggagaaggcggacgaggagctggacaaggtgaacaagttctacgcgacgcaggagtcggagctgctggcgcgcggcgaggcgctcatcgagcagctccgcatcctcgccgacgtgaagcgcatcctcgccgaccacgcggcggcgtcccggcgcggcggccgcgggagtagggcggcgctcgcccgggcgcagtccatgccgccctccg

SEQ ID NO: 37786 - protein, 176 aa, Panicum virgatum
  misc_feature: Ceres CLONE 1991281
  misc_feature (2)..(174): Pfam Name: SPX Pfam Description: SPX domain
MVKFSREYEASIIPEWKAAFVDYNCLKKLIKRIKIARREAAPPTLLANSGDHYGFSVLDPVRALTARLAAARAPPPSSPEEGEEEETSESDSGELVPSTGKHEKEFLEKADEELDKVNKFYATQESELLARGEALIEQLRILADVKRILADHAAASRRGGRGSRAALARAQSMPPS

SEQ ID NO: 37787 - DNA, 1464 bp, Panicum virgatum
  misc_feature: Ceres CLONE 1991282
  misc_feature: Encodes the peptide sequence at SEQ ID NO. 37788
aagcccaggaatcccgggcccaccgcgcaccccgtcgccccccgcttccccgcgccacccccgattcttctccccggcgttctctcctctagactctagaacctcttcctccgcccccagcccttgaccagaccgcgcccgccgcccggcgttgaggacggcgatggagctgggcctgagcctcgcctcggcctcgccgccggcgggcgggctggcgccgccgccgcccctagcgccgccggggaaggagcagcaggtggccggcgtggggatcctgctgcagatctccatgctcgtgctctccttcgtgctcggccacgtcctgcgccgccaccgcttctactacctacccgaggccagcgcctcgctcctcatcggtctagttgttggtggccttgctaacgtttcaaatacagagaccaacactaggacgtggttcaacttccatgaagaattcttcttcttgttcttattacccccgataatatttcaatcaggattcagcttatctccgaaaccattctttgcaaactttggggctattgtaactttcgccattcttgggacgttcattgcttcagttgtaacaggggttcttgtctatcttggcggactgacatttctaatgtataaacttccacttgttgagtgccttatgtttggtgcccttatatctgcaactgatcctgtcacagtgctatcgatattccaggaactgggctctgacgttaacttgtatgctttggtgtttggagaatcagttttgaatgatgcgatggcaatttctctttacaggacaatgtcatctgttagaagtcatgcagcagcaggcgagaacttttttatgatgattctccagttccttgagacctttgttggttcaatgtcatcaggtgtgggagttggatttatctctgctcttctgttcaaatatgctggattggatgttgacaatctgcaaaacttggagtgctgcctttttgttctctttccatatttctcgtatatgttagcggaaggacttggattgtcagggattgtttctatattattcacgggaatggttatgaagcattacacatactccaatctttcagacaattcacagtgctttgtttctgcctttttccacttactatcatctttggctgaaacatttgtgttcatttatatgggcttcgatattgccatggaagagcatagctggtcacatgttggcttcattttcttctcaattatattcatagttgttgcaagggctgtaaatgtcttttcttgtgcatacttggttaacatgtctaggccagaacatcgccgaatacctctaaagcatcagaaagcactttggtttagcgggcttagaggggccatggcttttgcacttgctctccaatctgtgcatgaacttcctgaaggacatgggaaaacgatattcaccaccactacagccattgttgtgttgac

SEQ ID NO: 37788 - protein, 433 aa, Panicum virgatum
  misc_feature: Ceres CLONE 1991282
  misc_feature (41)..(433): Pfam Name: Na_H_Exchanger Pfam Description: Sodium/hydrogen exchanger family
MELGLSLASASPPAGGLAPPPPLAPPGKEQQVAGVGILLQISMLVLSFVLGHVLRRHRFYYLPEASASLLIGLVVGGLANVSNTETNTRTWFNFHEEFFFLFLLPPIIFQSGFSLSPKPFFANFGAIVTFAILGTFIASVVTGVLVYLGGLTFLMYKLPLVECLMFGALISATDPVTVLSIFQELGSDVNLYALVFGESVLNDAMAISLYRTMSSVRSHAAAGENFFMMILQFLETFVGSMSSGVGVGFISALLFKYAGLDVDNLQNLECCLFVLFPYFSYMLAEGLGLSGIVSILFTGMVMKHYTYSNLSDNSQCFVSAFFHLLSSLAETFVFIYMGFDIAMEEHSWSHVGFIFFSIIFIVVARAVNVFSCAYLVNMSRPEHRRIPLKHQKALWFSGLRGAMAFALALQSVHELPEGHGKTIFTTTTAIVVL

SEQ ID NO: 37789 - DNA, 674 bp, Panicum virgatum
  misc_feature: Ceres CLONE 1991282-R
gacgggacctatgcttgaagctttggatgtcgttggagatgaaaacccatcattagagcattctcagaattatgaggacaacaacggttacatgcctccaacttatgaagaaggtacatcatctgggggaggattaagaatgaaacttaaacagtttcacaaaagcacaacgtcattcactgcccttgacaaaaactacctgactccatttttcaccagccagactgacgacgacgacgacgaagacttcagtgggcaaccccaaaaccgaagagtaagattctatgatcaatagcagtatttggggttccacttatcaagctaaatacacggagcagaactgacagcatgattgtgtgtacgattggattgaacctagtatagggcataattagttgagtagcatatggcagaggatatctgctgtataccgtaggacagaaatcataaggctcaaatcaactattatggggatgaggatagccgggctgcatgtatatgtgtttgtaggcctccttgagaacttggtggagctccagatgaaaagcaggttattgctgaaattgtctggttgttagcctttaccgttatgctaattttaataccccagacattatgattgtttactatgctcgttgggaagcgtttgttgtaaagtggcagattgcagcagc

SEQ ID NO: 37790 - DNA, 1735 bp, Panicum virgatum
  misc_feature: Ceres CLONE 1991284
  misc_feature: Encodes the peptide sequence at SEQ ID NO. 37791
acccgcactggcccatctcctcctggtcccgacctcgcctccaggctccagttccgctcctgctcctcggcgccgccgccgccgccgccgccgtcgctccaccacccccacaccatgtacggcgtcggcggcgggggcggcttcaacgcgccctccaccacctccggcggccggcgccgcaacccgggcgacgaagaggatgacgaggaggaggagggcggcgagggccgcgtcctcgaggcgtgggagcgcgcgtacgcggacgaccgctcgtgggagacgctgcaggaagacgagtcggggcttctccaccccatcgataccaagaccctcgtccacgctcagtaccggcgccgcctcctgctccgctctgccgccgccgccgcggcccgcatccagaaggggctcatccgctacctctacatcgtcatcgacctctcccgggcagcttcggagatggattatcgtcccagtcgaatggctgttgttgcaaaacatgctgaggcttttataagagaattcttcgaccagaatcccttgagccatgttggcctagtgacaattaaagacggtatttctcatcgactgacagacattggagggagtccagaatcacagattaaggctctgatggggaaacttgagtgttctggtgattcatctctgcagaatgctttagaacttgtccacggttatttagatcaagtaccatcatatggtcacaaggaagtcttaattttgtactctgccctaaatacgtgtgatcctggtgatatcatggagaccatagaaaaatgtaagaaatccaaaattagatgctcagttattggtcttgctgcggagatcttcatttgtaaacatctctgtgaagagactggcggatcctacacggttgcactagacgagtctcatttcaaagaattgttgctggaacatgctcccccaccccctgcaatagcagaatatgccgcagctaatttgattaagatgggctttccacagaggggtgctgaggatcttatctctatctgctcttgtcacaagaaaataaagtctggggctgaaggttacatatgtcctcgatgcaaagttaatgtgtgtgagcttccaacagaatgtcgaacttgtggcctaacactagttagttctccacacttggcaaggtcatatcatcatctcttcccggtagcaccgtttgatgaggtttcatctgtcccaaatagaatccgaaggggagtacaaaactgtttcggctgtcagcagaacctttttaaccctgatggccaaactagtctccatgttcgctgcccaaaatgcaaccagcacttctgcctggattgtgatatttacatccatgagagcttgcacaattgccctggttgtgagagtcaacgtggtttctcatcatagtgatatgccatcacattcattattcaggtgtaccttattctgagtcatcatgtcatactaaatctttctcagtgcattgaatcggtggcagagttgtttgatgataagactgtgtacagatataatgcccggcatccttttgttatgttagatggagtagctaattgagctatatcgatactgagcagaggttgaagagttgatagtttagcattatgcctagctagcagagatgctaaaattgtattacgtgactggaacatacgactcttgctgtttttctgaagcaagactattgttattcagtaccatgactcgggttttt

SEQ ID NO: 37791 - protein, 431 aa, Panicum virgatum
  misc_feature: Ceres CLONE 1991284
  misc_feature (40)..(295): Pfam Name: Ssl1 Pfam Description: Ssl1-like
  misc_feature (377)..(425): Pfam Name: C1_4 Pfam Description: TFIIH C1-like domain
MYGVGGGGGFNAPSTTSGGRRRNPGDEEDDEEEEGGEGRVLEAWERAYADDRSWETLQEDESGLLHPIDTKTLVHAQYRRRLLLRSAAAAAARIQKGLIRYLYIVIDLSRAASEMDYRPSRMAVVAKHAEAFIREFFDQNPLSHVGLVTIKDGISHRLTDIGGSPESQIKALMGKLECSGDSSLQNALELVHGYLDQVPSYGHKEVLILYSALNTCDPGDIMETIEKCKKSKIRCSVIGLAAEIFICKHLCEETGGSYTVALDESHFKELLLEHAPPPPAIAEYAAANLIKMGFPQRGAEDLISICSCHKKIKSGAEGYICPRCKVNVCELPTECRTCGLTLVSSPHLARSYHHLFPVAPFDEVSSVPNRIRRGVQNCFGCQQNLFNPDGQTSLHVRCPKCNQHFCLDCDIYIHESLHNCPGCESQRGFSS

SEQ ID NO: 37792 - DNA, 680 bp, Panicum virgatum
  misc_feature: Ceres CLONE 1991288
  misc_feature: Encodes the peptide sequence at SEQ ID NO. 37793
agaacgcaagccccgtttacatcctcacacctcatctctacggtctttttgagcgaagggttgaaggcaggttgatagatcacgagcagcatggctaactacccaagtgcgccacaagattttacattaagtttcctagagcatatcacaaacaatttctccgacggagtacggattggaagtggtgggtttggtcacgtttattggggtatatatagagatgaaaagattgctgtgaagaagctctatgatcaaaatccaggatttgatgacgcagcctttaaaaaagaatttaataacagtttccaactccatcatccaaatattgtacggttagttggctactgttacgaaacacgagagataaatatggaggtaaggccgggagattatcaattcgtaaaaagaatagtgcggatcctctgctacgaatactgtcagggcggaagccttgacaactacattaacgaaaaattcagagaacgtgatttggacacacgcctcaagattatcagaaggatttctgagggtttaaattaccttcattacgggcaggcgcaacatatgtatcatatggacttaaaaccagaaaatatactgctggatgagaagaatatgcccaaaattgctgatttcggtctgtcaagattcttggctatgacgaaaacccatataacaac

SEQ ID NO: 37793 - protein, 196 aa, Panicum virgatum
  misc_feature: Ceres CLONE 1991288
  misc_feature (13)..(196): Pfam Name: Pkinase_Tyr Pfam Description: Protein tyrosine kinase
  misc_feature: SWISSPROT Homolog: EC 2.7.11.1 Non-specific serine/threonine protein kinase
MANYPSAPQDFTLSFLEHITNNFSDGVRIGSGGFGHVYWGIYRDEKIAVKKLYDQNPGFDDAAFKKEFNNSFQLHHPNIVRLVGYCYETREINMEVRPGDYQFVKRIVRILCYEYCQGGSLDNYINEKFRERDLDTRLKIIRRISEGLNYLHYGQAQHMYHMDLKPENILLDEKNMPKIADFGLSRFLAMTKTHIT

SEQ ID NO: 37794 - DNA, 696 bp, Panicum virgatum
  misc_feature: Ceres CLONE 1991309
  misc_feature: Encodes the peptide sequence at SEQ ID NO. 37795
actcgatcggaaccaatggatactaatgatgtctactacgtttacctcggcctggctctcatatctatgctactagtggtcgcgaagggcagccgtcgtggtcgctccccggcacacgggcagggcctgcgcctgccgccggggccatggcaggtgccgatcatcggcagcctacatcacatagccgggaggaagctcccgcaccgcgcgctgcgtgacctggctcggcgctatgggccggtgatgatgctccgaatcggcgaggtccccacggtggtggtgtcctcgcgggaggcggcgatcgaggtgatgaagacgcacgacctggcgttcgcgtcgcggccgcagaccgccacggggcgcgtgatcaccaaggagggccgcgacatcgcgttcgctccctacggggagcactggcgccagctccggaaggtggccatcacggagctgctcagcgtgcgccgggtgctctcctaccgcgccatccgcgagggcgaggtggccgcgatgctgcgcgacctcgccggcgccgcggcggcgtcccgccccgtggagatgcgggcgcggttggccgcgctggtgtccgacacaacgctccgtgccgtggtgggtggacggtgggaggagcgcgacgcgttcctccgggagctgtcccgcgccagcgtgctcgtggcggggttaacctggccgacctct

SEQ ID NO: 37795 - protein, 226 aa, Panicum virgatum
  misc_feature: Ceres CLONE 1991309
  misc_feature: SWISSPROT Homolog: EC 1.14.13.68 4-hydroxyphenylacetaldehyde oxime monooxygenase
MDTNDVYYVYLGLALISMLLVVAKGSRRGRSPAHGQGLRLPPGPWQVPIIGSLHHIAGRKLPHRALRDLARRYGPVMMLRIGEVPTVVVSSREAAIEVMKTHDLAFASRPQTATGRVITKEGRDIAFAPYGEHWRQLRKVAITELLSVRRVLSYRAIREGEVAAMLRDLAGAAAASRPVEMRARLAALVSDTTLRAVVGGRWEERDAFLRELSRASVLVAGLTWPT

SEQ ID NO: 37796 - DNA, 705 bp, Panicum virgatum
  misc_feature: Ceres CLONE 1991318
  misc_feature: Encodes the peptide sequence at SEQ ID NO. 37797
actcctccacctccccccttccccgatctagatccacccgtccctccgccgcggctgctgcgccacccctctccgctctccgtttggacgagctcaacatccaaggttccatgtgcgctgaggaacaaccgacgacgtcaggcctggagaatggccaccaggagccctttgttattggtgttgctgggggcgcgtcttcaggcaaaactaccgtatgcaaaatgatcatcgaccagctgcgtgatcagcgcgtggtggttgttacacaggagtccttttactatggactgactgatcaggagctaatccatgttcatgattataactttgatcatccagatgcattcgatacagagttacttctctcgtgcatgaaaaacttgaagcgtggcaaagctgttgacattcctaattacaacttcaagacatacaagagtgtcccaaatgcaagaaaggttaatccttcagatgtcattattttagaaggtattctagtttttcatgattcccgcctccgggatttgatgaatatgaagatcttcgttgatacagatgctgatgtacggttaacaaggaggatccgtcgtgatactattgagaagggtagagatatcaaaactgtgttagatcagtactcaaaatttgttaagcctgctttcgaagatttcatcctcccaacgaagaaatatgctgatattattatcc

SEQ ID NO: 37797 - protein, 234 aa, Panicum virgatum
  misc_feature: Ceres CLONE 1991318
  misc_feature (57)..(234): Pfam Name: PRK Pfam Description: Phosphoribulokinase / Uridine kinase family
  misc_feature: SWISSPROT Homolog: EC 2.7.1.48 Uridine kinase
SSTSPLPRSRSTRPSAAAAAPPLSALRLDELNIQGSMCAEEQPTTSGLENGHQEPFVIGVAGGASSGKTTVCKMIIDQLRDQRVVVVTQESFYYGLTDQELIHVHDYNFDHPDAFDTELLLSCMKNLKRGKAVDIPNYNFKTYKSVPNARKVNPSDVIILEGILVFHDSRLRDLMNMKIFVDTDADVRLTRRIRRDTIEKGRDIKTVLDQYSKFVKPAFEDFILPTKKYADIII

SEQ ID NO: 37798 - DNA, 682 bp, Panicum virgatum
  misc_feature: Ceres CLONE 1991326
  misc_feature: Encodes the peptide sequence at SEQ ID NO. 37799
  misc_feature (360)..(360): n is a, c, t, g, unknown, or other
gaggccaaacgcgccgccgccgccgacaatgttccgccgcttcctcccgcaccgccgcttcttctcctcctcgtcagcctcgaatgccaccccaacactctactctaacggaaccaccccattctccctcctctcgtggggccgtggcgcgtccggccagctcggcggcggcaaggaggagcgccgcctctacccgtcacccgtcgcccacctccttctctccgactcagacccgcgactcgcgcccacccccggacgcctctcctccgagggggagacgtctggcgtggaggtggggatctcctgcgggctcttccactccgcgctcttcgtcgaaggaggcgcctgggtgtggggaangggcgacggcggccgcctcggcctcggtgacgagtcgtccgccttcgttccccgccacaaccccaacctccgggacctccgcctcctcgcgctaggcggcatccattccgctgcgctgaccacctccggtgacgtcttcacctggggttatggtggatttggagcactggggcactatgtataccatagggagcttttgccaaggcaagtgaaaggtccttgggaagggaagataacgcacattgctacaagtggtgcgcatactgcagcaatcactgactcaggtgaactttacacctggggtcgtgatgaaggcgatgga

SEQ ID NO: 37799 - protein, 217 aa, Panicum virgatum
  misc_feature: Ceres CLONE 1991326
  misc_feature: SWISSPROT Homolog: EC 2.7.11.1 Non-specific serine/threonine protein kinase
  misc_feature (111)..(111): Xaa is any aa, unknown, or other
MFRRFLPHRRFFSSSSASNATPTLYSNGTTPFSLLSWGRGASGQLGGGKEERRLYPSPVAHLLLSDSDPRLAPTPGRLSSEGETSGVEVGISCGLFHSALFVEGGAWVWGXGDGGRLGLGDESSAFVPRHNPNLRDLRLLALGGIHSAALTTSGDVFTWGYGGFGALGHYVYHRELLPRQVKGPWEGKITHIATSGAHTAAITDSGELYTWGRDEGD

SEQ ID NO: 37800 - DNA, 1709 bp, Panicum virgatum
  misc_feature: Ceres CLONE 1991329
  misc_feature: Encodes the peptide sequence at SEQ ID NO. 37801
gtgggcatagtcgcgctcctcttcgtgctcgtcctcgtcgtcaccatcgagggcgtctgcaagcgcccctccgcctcctgattctgattcgccagctccccgtaaccccccccccccccccccacgcgcggccccccacaatgcgccgccgcagcctcgccgccctcctgctgctcctggcggccgcgcccgcccccgccgcagcgcactcggactcctcctgccccttccacgaccacggcggcgcggaccacgagcaccaccaccaccaccatgcccacggccgcgacgagatccagcggcggctgctcccggaggagatggccgaggaggcggatctcgagctcgattccttcggttacgacgagcatgaccacggccaccaccaccaccatcacggccacagccacagccacggccacggccacggccacggcgacatggaggcgtcgcccatgggtgtgtggctgagcgcgatggggtgctcgctgctggtcagcatggcgtcgctcgtctgcctcatcctcctcccggtcatcttctttcaggggaaaccatcgaaggccatggtggatgcacttgcagtgtttggggcaggagcaatgcttggagattcatttcttcatcaactgccacatgcttttggtggggggcattctcactcacatgatcatgagggtcacgaccatgctcatgagcatgcacatgcacactcactggaagatctttctgtggggttgtctatactatttggcattgtactcttttttattgttgagaagattgtgaggtatgttgaagacaattctcaaaatggggcacatagcatgggtcatgggcaccaccatcaccatcataaacggcatgattctagtgataagggcaaattgaatcatcaaaagagtgatgacgacggtaaagagatcaatcaaactgacgaggaacctttggttgatggcacgactgcaaaagcaactactatccgcaagagaagctcttctgctagttccaaagccactgatggagagcacgccaattctgaaaatgaccctgcccctgataaagcattatcaagtgatggttcatacatttcaaactctaatttggtgtttggctacctcaaccttttctcatatggtgttcataacttcactgatgggatggctcttgggagtgcatttttgctacatggttccgttggtggctggtccaggactttattcctgcttgcacatgaacttccccaagaggttggagattttggaatccttgtgcgatcaggattcacggtgtctaaggccttatttttcaattttctctctgcattggttgctcttgctggaacagcactagcattgtctttgggtaaagatccagggcattcttccctgattgagggtttcactgccggtggtttcatttacattgctgtggcgggagtccttccacagatgaacgaccagaaaacaaccctccaaagctcaatagttcagttgatttccctggcgatggggatgctggtcgctctaggcatttctctggtagaatgatctgaacctccagttcaccagttgcagctttaggtctcacagcagttactccaatccggtataattcttgaacagctccaggctggaagacgggagctctaagtctgaaaaccttatataaattttgacatctgattatagattcacctgcatggtcgg

SEQ ID NO: 37801 - protein, 469 aa, Panicum virgatum
  misc_feature: Ceres CLONE 1991329
  misc_feature (106)..(466): Pfam Name: Zip Pfam Description: ZIP Zinc transporter
MRRRSLAALLLLLAAAPAPAAAHSDSSCPFHDHGGADHEHHHHHHAHGRDEIQRRLLPEEMAEEADLELDSFGYDEHDHGHHHHHHGHSHSHGHGHGHGDMEASPMGVWLSAMGCSLLVSMASLVCLILLPVIFFQGKPSKAMVDALAVFGAGAMLGDSFLHQLPHAFGGGHSHSHDHEGHDHAHEHAHAHSLEDLSVGLSILFGIVLFFIVEKIVRYVEDNSQNGAHSMGHGHHHHHHKRHDSSDKGKLNHQKSDDDGKEINQTDEEPLVDGTTAKATTIRKRSSSASSKATDGEHANSENDPAPDKALSSDGSYISNSNLVFGYLNLFSYGVHNFTDGMALGSAFLLHGSVGGWSRTLFLLAHELPQEVGDFGILVRSGFTVSKALFFNFLSALVALAGTALALSLGKDPGHSSLIEGFTAGGFIYIAVAGVLPQMNDQKTTLQSSIVQLISLAMGMLVALGISLVE

SEQ ID NO: 37802 - DNA, 1246 bp, Panicum virgatum
  misc_feature: Ceres CLONE 1991340
  misc_feature: Encodes the peptide sequence at SEQ ID NO. 37803
gtgctaatcccactcgcattgccctatctcctcctcgcccaaccaccagtccaccacccggtccggcgaattcaggctccgttccccggtggtccttgtccgtccatggccgcctcgctgcttcgccgcggcgctgccgccgcaggccgccggtggtgcccggtggacgtgctgcggcggctggtctcgtcggaggcggcgcccgagcgggcagcctcgcgggcgccgcctgagatgccgccattcgaccaccagccccgcccgtacgccgggatgggcggcgccgagatcttcgagaagaggaaggccctcctcggcccgtcgctcttccactactaccagaagccgctcaacattgtggaggggaagatgcagtatctgtatgacgagcatgggaagagatacctcgattgctttgggggtatcgtcacagtttcgtgcggtcattgccatccggatattgtcaatgctgtggtggagcagaccaagttgctccaacacacaaccaccatatacttgcatcacgccattgtcgagtttgcagaggcactcacctccaaaatgcctggcaatctcaaggttgtgtactttgtcaattcggggactgaagcaaatgaattagcaatgttgatggcccggctgtatagtgggaacctcagtatgattgcactcaggaatgcataccacggtggaagtgctggaacaataggattgactggtctgcagacatggaagtacccaattcctcagggtgaaatacatcatgtcatgaaccctgatccttaccgggggacttttggatctgatgctgcagcttatgccaaggaggtccaagaacatataacctttggaagttcaggaagggttgcaggcttcatttcagaaacatttcagggtgttggaggtgctgtcgaactagctcctggataccttaagttagcttatgacattgtgcggaaggctggtggtgtttgtattgctgatgaagtccaaagtgggttcggtcgtactggaagtcattactggggattccagacacaagatgtcattccagacattgtaacaatggcaaagggcattggcaatggtctaccattgggggctgttgtaacaactcctgagattgcaagtgtgttgtctcagaaaatccaatttaatacatttggtggaaacccagtttgttctgctggtggtttggctgtgcttaaggttcttgacaaggagaagcgccaggcacattgtgctg

SEQ ID NO: 37803 - protein, 380 aa, Panicum virgatum
  misc_feature: Ceres CLONE 1991340
  misc_feature (83)..(378): Pfam Name: Aminotran_3 Pfam Description: Aminotransferase class-III
  misc_feature: SWISSPROT Homolog: EC 2.6.1.44 Alanine--glyoxylate transaminase
MAASLLRRGAAAAGRRWCPVDVLRRLVSSEAAPERAASRAPPEMPPFDHQPRPYAGMGGAEIFEKRKALLGPSLFHYYQKPLNIVEGKMQYLYDEHGKRYLDCFGGIVTVSCGHCHPDIVNAVVEQTKLLQHTTTIYLHHAIVEFAEALTSKMPGNLKVVYFVNSGTEANELAMLMARLYSGNLSMIALRNAYHGGSAGTIGLTGLQTWKYPIPQGEIHHVMNPDPYRGTFGSDAAAYAKEVQEHITFGSSGRVAGFISETFQGVGGAVELAPGYLKLAYDIVRKAGGVCIADEVQSGFGRTGSHYWGFQTQDVIPDIVTMAKGIGNGLPLGAVVTTPEIASVLSQKIQFNTFGGNPVCSAGGLAVLKVLDKEKRQAHCA

SEQ ID NO: 37804 - DNA, 560 bp, Panicum virgatum
  misc_feature: Ceres CLONE 1991340-R
  misc_feature: Encodes the peptide sequence at SEQ ID NO. 37805
ttgggagcctcactttggtggaggcgtccaaaatcgcttccaggagaagcatgaaatcataggtgatgttagaggaaggggactcatgctttggcgttgaactcgttaccgatagaaacgagaagacccctgccaagccagaaactgcggaactgtttgagaaactcaaagatctcggggtactagttggaaaaggcggtctgcatggtaacgtcttcagaatcaaaccaccaatgtgcttttcaaaggaggatgcagatttcttggtggacgccatggactacgcaatgtcaggcctctgaattgagaatgcgtctccgtggaaccgacagttcctgtaacccgcaagatatgcatggcctgatactggaaggcagatgattcgatggcatcttcccggttgatgtgcttctggtggtgacatggtgaaatagaaccctgcagggataaatgaatgaaggggaagaaaatattggaaattcagaatgtactgtcggcttgcgagctgtaagctgtctgtaaaagaactagttaataaataataacgagcatgttagtat

SEQ ID NO: 37805 - protein, 78 aa, Panicum virgatum
  misc_feature: Ceres CLONE 1991340-R
  misc_feature: SWISSPROT Homolog: EC 2.6.1.44 Alanine--glyoxylate transaminase
MLEEGDSCFGVELVTDRNEKTPAKPETAELFEKLKDLGVLVGKGGLHGNVFRIKPPMCFSKEDADFLVDAMDYAMSGL

SEQ ID NO: 37806 - DNA, 718 bp, Panicum virgatum
  misc_feature: Ceres CLONE 1991341
  misc_feature: Encodes the peptide sequence at SEQ ID NO. 37807
cttgcgctcttcggtttgcttctcttttcttctatctcctttcactcgtttcaatcttgtgttctcgccgaattgtgcctgatggccatatgcttgtttgatttacttggcagcgcagcaagacatcgaagaatcccctactactcatgcatgagcaccgcctcctcgcgccgcatatgaatcagacatgaataagggccacagcagcagctcctcgaagctcatcaacgagaagcttgaggaacaccggatctccaccgccaagcactgcccccactgcggtgagaaaatcgacagcaagccgaaggattgggtggggctgccggccggagtcaagttcgatccaactgaccaggagctgatcgagcacctcgaggcgaaagtgaaggatgaaggctcgagatctcaccctctcatcgacgagttcatacccacaatagatggggaggacggtatatgttacacccaccccgagaaacttccaggtgtgaccagggatggcctgagcaagcacttcttccaccggccatccaaggcctatacgacgggcacgaggaagaggaggaagatacagacggagtgcgacgtccacaagggcgagacgaggtggcacaagaccggaaagacgcggccggtgatggtgaacggccggcagaaggggtgcaagaagattctggtgctgtacaccaacttcggcaagcaccgcaagccggagaag

SEQ ID NO: 37807 - protein, 176 aa, Panicum virgatum
  misc_feature: Ceres CLONE 1991341
  misc_feature (45)..(176): Pfam Name: NAM Pfam Description: No apical meristem (NAM) protein
  misc_feature: The sequence is a functional homolog of SEQ ID NO 1710 in the 10/374,780 US patent application
  misc_feature: The sequence is a functional homolog of SEQ ID NO 542 in the 10/666,642 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 1711 in the 10/374,780 US patent application
  misc_feature: The sequence is a functional homolog of SEQ ID NO 1712 in the 10/374,780 US patent application
  misc_feature: The sequence is a functional homolog of SEQ ID NO 1713 in the 10/374,780 US patent application
  misc_feature: The sequence is a functional homolog of SEQ ID NO 210 in the 10/666,642 US patent application
  misc_feature: Useful for making plants with altered carbohydrate content
  misc_feature: The sequence is a functional homolog of SEQ ID NO 562 in the 11/435,388 US patent application
MNKGHSSSSSKLINEKLEEHRISTAKHCPHCGEKIDSKPKDWVGLPAGVKFDPTDQELIEHLEAKVKDEGSRSHPLIDEFIPTIDGEDGICYTHPEKLPGVTRDGLSKHFFHRPSKAYTTGTRKRRKIQTECDVHKGETRWHKTGKTRPVMVNGRQKGCKKILVLYTNFGKHRKPE

SEQ ID NO: 37808 - DNA, 389 bp, Panicum virgatum
  misc_feature: Ceres CLONE 1991350
  misc_feature: Encodes the peptide sequence at SEQ ID NO. 37809
gtacatacaggagccacagcaaccatcaaagttcaagaacgtggttagcacacataactcctctctctctctctctctctctctctctctctctctctctctctctctctctctctctctatctctctctccactattatatgctgacgctgaaactgctgctatttttcatattattactgataggacacaccagcgaaaatgagcggtggcggcggtaagagctcgtggccggaggtggttgggctgccggccgaggcggggaagcgtaagatcgtggccgaccggccggacgtgcaggtggttgtgctgcccgtgggctccttcgtgaccactgagttcaaccccaagcgcgtgcgcgtcttcatcaacccggccggcgacgttgt

SEQ ID NO: 37809 - protein, 62 aa, Panicum virgatum
  misc_feature: Ceres CLONE 1991350
  misc_feature (7)..(62): Pfam Name: potato_inhibit Pfam Description: Potato inhibitor I family
MSGGGGKSSWPEVVGLPAEAGKRKIVADRPDVQVVVLPVGSFVTTEFNPKRVRVFINPAGDV

SEQ ID NO: 37810 - DNA, 650 bp, Panicum virgatum
  misc_feature: Ceres CLONE 1991361
  misc_feature: Encodes the peptide sequence at SEQ ID NO. 37811
tattacgcctctacagtcttgacttcccctctctctctctctccggcggccggaaatctcctcaaattccgctgattttatccctgctgaccagcaggcgagggggaaggacgactcttgagctcaatttcttggaggatcggctggcatttgtaagatagtgctcaggaacggggacatgagctgcttgccgtgctccggttcgtcggggaaggatgccaagagcttggaagcgctctcgccgtccccccggcctgcggcgaagtcggcaccagttcggtcaaattcacgtgcttcaggctccaggaaggaaaattctgtacctgttcgcagaggaggaaatacttcacatggcccagcacagattttcactttccgggagttggccattgctaccaagaatttcaggaaagattgcctgttgggagaaggtggctttggtcgtgtgtataaaggacgcatggaaaatggacaggtcattgctgtgaagcaacttgatagaaatggctttcaaggaaatcgtgaatttcttgtggaggttctcatgctaagtctcttacaccaccctaatctggtcagattaattggctattgcgcagatggtgatcagcgcctcctagtttacgaatatatggcgttgggatcactag

SEQ ID NO: 37811 - protein, 157 aa, Panicum virgatum
  misc_feature: Ceres CLONE 1991361
  misc_feature: SWISSPROT Homolog: EC 2.7.11.1 Non-specific serine/threonine protein kinase
MSCLPCSGSSGKDAKSLEALSPSPRPAAKSAPVRSNSRASGSRKENSVPVRRGGNTSHGPAQIFTFRELAIATKNFRKDCLLGEGGFGRVYKGRMENGQVIAVKQLDRNGFQGNREFLVEVLMLSLLHHPNLVRLIGYCADGDQRLLVYEYMALGSL

SEQ ID NO: 37812 - DNA, 1748 bp, Panicum virgatum
  misc_feature: Ceres CLONE 1991371
  misc_feature: Encodes the peptide sequence at SEQ ID NO. 37813
gattgtctcctctccgtctcaactggggaaagccgccgaatcggggggaatcgacgcgcagccgcctccacctccggcgccgccatgctgctcctccgcaggcacctcctccctctccaccgcgcggcttcctcgctccctttcccccatctaccaacgcgcctggctcctctccacctccacctcggcctccaccgccccgttctccctcgaggactacctcgtcgccgcctgcggcctccacccagctcaagccctcaagacggctaagaaggcgttcgatgaagcatccaaactttgtaacaagaaggcattcgaggagctatgctggtcccgcctcaaatccgcctccaaccccgacgccatcctcgccctgctctccggcgtcggcctctccagcgccgacatcgccgcagtcgtcgtcgcggacccgttgctcctgcgcgcctcccccaagaacattggcccccgccttcatgctctccgcgaccgcctcggcctgtccaacctccagatcgctcgcttcctccttgtaggctcacgcgccctccgcagccgcggctgcgacgtcgttccgaggctcgagtttttcatctctctattcggttcatttgaacagctcctcgcgatattgaagaagagtgatagcattctgcaggcggatgttgaaagggttatcaatcctaatatcgcgttgcttcgtcagtggggcttaagtgttcgagatattgcccagctgtgttcaaacaactcgtgggtgcttacctatagcctggagcgcgtcaaggaattcttgctgcgcgcggaagagcttggggtgccccgcagctcgcgaagtttcaagtatgcggtgtccgtcgtctcaaatatcaacaaagaaaaggctgcttccaaacttaagtttttgaagagtactcttggttgctctgagagtgaagttgcaattgcagtgtccaagatgccaagtattctgcctttctctgaggagatccttctccgcaagattcagttcttgatcaaagaggtcctgcaggcaaagggattgctgagtagtaaaatgggcttttactcattcgctcaaattggagagaagactttcaaattgaagtacattgactgtcacaaggactctgttcctgggcttgcagatgcttatgctgcagctagtgctggtgttgtgccctctggaatcaaatttgaacatcttaaaatattccaatcctttttgttcgatgatgcaagtgctactcacgctcattagcagctggcgatggtgaaggcattctcaattcttctttctgcggtagaacaactggtgacctctgaccactcatcatccatgtttaagttatggttgtctattattctgtcaaagagttgattggcttattctggagctttactgcacgtgtttgttagtcgcttcttctgtctagcgcatggctgaagattatccttaactgaggtgttcatctgtggataggcccttgtcctagcacctgatctagttggaatttgttagcactggctttcgctttttctctaaccgtgtttgctcaatatgtttcatttctactgacattttatagcgctcactgatacttatttgttccctagttcgttttgagaggatgtgttatgtttgctctactgatgtttacattgcacttccaaactgagcaatagctcagtggtgggcttgttgtagttgtgcccaccgaccaggttcgaaccttgatattgcaccc

SEQ ID NO: 37813 - protein, 419 aa, Panicum virgatum
  misc_feature: Ceres CLONE 1991371
  misc_feature (97)..(368): Pfam Name: mTERF Pfam Description: mTERF
IVSSPSQLGKAAESGGIDAQPPPPPAPPCCSSAGTSSLSTARLPRSLSPIYQRAWLLSTSTSASTAPFSLEDYLVAACGLHPAQALKTAKKAFDEASKLCNKKAFEELCWSRLKSASNPDAILALLSGVGLSSADIAAVVVADPLLLRASPKNIGPRLHALRDRLGLSNLQIARFLLVGSRALRSRGCDVVPRLEFFISLFGSFEQLLAILKKSDSILQADVERVINPNIALLRQWGLSVRDIAQLCSNNSWVLTYSLERVKEFLLRAEELGVPRSSRSFKYAVSVVSNINKEKAASKLKFLKSTLGCSESEVAIAVSKMPSILPFSEEILLRKIQFLIKEVLQAKGLLSSKMGFYSFAQIGEKTFKLKYIDCHKDSVPGLADAYAAASAGVVPSGIKFEHLKIFQSFLFDDASATHAH

SEQ ID NO: 37814 - DNA, 672 bp, Panicum virgatum
  misc_feature: Ceres CLONE 1991373
  misc_feature: Encodes the peptide sequence at SEQ ID NO. 37815
tccccaccaaccacttcgccaccccgccgctcgccatctgctcccctgcggctgcgacttcgagacatggcagcgcaaacttcggcggcctcgacccttgccttcgggcaccacaaaaccctagccgccgcggcctccgtctccttcccggccacccagccggcgtgcctcctctccgcgtccgccgcccgccgccgggatgtcgccgccatggtctcggcgccgccggccgtcggcaccgccatgccgtcgctcgacttcgagaccaccgtcttcaagaaggagaaggtctcgctcgccggccacgaggagtatattgtcaggggcgggaggaacctgttcccgctgctcccggaggcgttcaagggggtcaagcagatcggtgtcattggatggggctcgcagggtcctgcacaagcccagaacctgagagattcactggccgaagcaaagtcagacattgttgtgaagattggtctccggaaaggttccaaatcttttgaggaagcacgtgctgctggattcactgaagagagtggaaccttgggcgatatttgggagactgtttcaagcagcgatctcgtgttattgttgatatcagatgctgcacaggcagacaactatgagaagatcttctcttacatgaaaccaaatagcattcttgggttatct

SEQ ID NO: 37815 - protein, 201 aa, Panicum virgatum
  misc_feature: Ceres CLONE 1991373
  misc_feature (98)..(200): Pfam Name: IlvN Pfam Description: Acetohydroxy acid isomeroreductase, catalytic domain
  misc_feature: SWISSPROT Homolog: EC 1.1.1.86 Ketol-acid reductoisomerase
MAAQTSAASTLAFGHHKTLAAAASVSFPATQPACLLSASAARRRDVAAMVSAPPAVGTAMPSLDFETTVFKKEKVSLAGHEEYIVRGGRNLFPLLPEAFKGVKQIGVIGWGSQGPAQAQNLRDSLAEAKSDIVVKIGLRKGSKSFEEARAAGFTEESGTLGDIWETVSSSDLVLLLISDAAQADNYEKIFSYMKPNSILGL

SEQ ID NO: 37816 - DNA, 1469 bp, Panicum virgatum
  misc_feature: Ceres CLONE 1991377
  misc_feature: Encodes the peptide sequence at SEQ ID NO. 37817
ccccccactcgcccaaatccaccacccccacgtctctcctcccaagtcccccattccatccccgtgtagaattcaaatccgcgtcaggccaggaggggcagctcgaggctcggtctccgccgccgcccgcagctcccgatcccccgagatctgcccccgcctccgcccgagggaccgccgaccatggaggccatagaggagctgtccgagctctccgagtcgatgcgccaggcggcgtcgctcctcgccgacgacgacccctccgacgacgccgcgccgcgtcgccccaccaccttcctcaacgccgtcgcccttggcaacgtcggagcaggcaagtcggccttgctgaacagcctcatcggtcacccggtcctgccgacaggggagaacggggcaacgcgggcgccgatagtggtggacctgcagagggagccgggtctcagcagcaagtccatcgtgctccagatcgacagcaagtcacagcaggtgtccgcaagtgccctccggcattcactgcaggacagactcagcaagggggcgtctggtggatcagggaggggccgcgctgatgagatttacctcaagctgcggacgagtacagctcccccattaaagctgattgatttacctgggatagaccagcgagctgttgatgattccatgatcaatgagtatgctgggcacaatgatgcaatactgcttgttgtgatacctgcaatgcaagctgctgatgtcgcatcatctcgagctctaaggctggccaaggatattgattcagatgggacgagaactgttggtgttataagcaaagttgatcaagcaaatggagatgcaaaaactatagcttgtgttcaggctctactgtcaaacaagggcccaaaaaaccttccagacattgagtgggttgctctaataggacaatctgttgcaattgcgtcagcgcaatcagttgggtctgaaaactcgctagaaacagcttggcgagctgaagctgaaagcctgaaaaacatcttaactagtgctcctcagaataagcttggcagacttgctttggttgacaccattgcaaagcagatacgtaaaagaatgaaagtgcggcttcctaacctattgagtggccttcagggtaaatctcagatggtgcaagatgaactagcaagactaggagagtctatggtgcaaagtcccgaaggaaccagggcagttgctttggagctatgccgggaatttgaagataaatttcttgctcatataacatctggtgagggatctggttggaaaattgttgcaagctttgaaggcaagtttccagatagaattaaacagctaccattggacaggcattttgatctcaacaatgtcaaaaggattgtcttggaagccgatggttatcaaccatatttgatatctccagagaaaggactgagatccttaataaaaatagtactggaaatggcaaaggagccatc

SEQ ID NO: 37817 - protein, 428 aa, Panicum virgatum
  misc_feature: Ceres CLONE 1991377
  misc_feature (41)..(210): Pfam Name: Dynamin_N Pfam Description: Dynamin family
  misc_feature: SWISSPROT Homolog: EC 3.6.5.5 Dynamin GTPase
MEAIEELSELSESMRQAASLLADDDPSDDAAPRRPTTFLNAVALGNVGAGKSALLNSLIGHPVLPTGENGATRAPIVVDLQREPGLSSKSIVLQIDSKSQQVSASALRHSLQDRLSKGASGGSGRGRADEIYLKLRTSTAPPLKLIDLPGIDQRAVDDSMINEYAGHNDAILLVVIPAMQAADVASSRALRLAKDIDSDGTRTVGVISKVDQANGDAKTIACVQALLSNKGPKNLPDIEWVALIGQSVAIASAQSVGSENSLETAWRAEAESLKNILTSAPQNKLGRLALVDTIAKQIRKRMKVRLPNLLSGLQGKSQMVQDELARLGESMVQSPEGTRAVALELCREFEDKFLAHITSGEGSGWKIVASFEGKFPDRIKQLPLDRHFDLNNVKRIVLEADGYQPYLISPEKGLRSLIKIVLEMAKEP

SEQ ID NO: 37818 - DNA, 694 bp, Panicum virgatum
  misc_feature: Ceres CLONE 1991377-R
  misc_feature: Encodes the peptide sequence at SEQ ID NO. 37819
gctgttttgaatagtcttgcagcaaatgtcccaaaggccattgtgctttgccaagtggagaaagcaaaggaagatatgcttacccagctatacagctcaataagtgggcaaagcaatgctaagattgaggagcttctccaagaagaccataatgctaagcgcagaagggagaagtaccaaaaacaatcatctctcctgtcaaaacttactcgtcaactcagtatccatgacaacagggcatctgtttcctcttattctaacgacacctgtgaagctgagagccctcgaatacccagccgctcaggtgaggactggaggtctgccttcgattctgcatctaatgggcctgctgctgccagctcaaacagcgagtcaaggtcgagaagcgctgatggtcgcagccggcgctacgagaatggggatgtgagcacaggtgccaactctggcaaccgacgcacgccaaaccggttgcctccagcaccaccaagatactagtcgtgctgattggtatccatgaacatgtattcttgcctggcacacgccctgtttgtcgtatcgattattggagcgtattccggatcggctgctagagattccaacgtagtggagtcgggtgatttcatgaatgttgtctttacaggtagctgggactcgagagttgtttatagaaatatataggtaatctatggtctcc

SEQ ID NO: 37819 - protein, 164 aa, Panicum virgatum
  misc_feature: Ceres CLONE 1991377-R
  misc_feature: SWISSPROT Homolog: EC 3.6.5.5 Dynamin GTPase
AVLNSLAANVPKAIVLCQVEKAKEDMLTQLYSSISGQSNAKIEELLQEDHNAKRRREKYQKQSSLLSKLTRQLSIHDNRASVSSYSNDTCEAESPRIPSRSGEDWRSAFDSASNGPAAASSNSESRSRSADGRSRRYENGDVSTGANSGNRRTPNRLPPAPPRY

SEQ ID NO: 37820 - DNA, 617 bp, Panicum virgatum
  misc_feature: Ceres CLONE 1991389
  misc_feature: Encodes the peptide sequence at SEQ ID NO. 37821
agagctcaagaaccgaagctgcgaaggcttccaaacttttcatccttcccgtttggcttggtgatcctgccgtcttcgtgtcaatcccctggtccctgtcaagacaccgagatgtacctggtgaaggacattagcggcgccatcggcctgatggtggtggcgctggtgctcctgggcacccggccggtggtcctggccgtgctggaacgccgaggccggctgccgcagcacaccttcctggacttctccgtcaccaacttcctcgccgccgtgctcatcgccctcaccttcggccagatcggccccgacacgccggcgacgcccaacttcctcacccagctcactcactttcagaataactggccttcagtcttgttcgcgacggccggcggcgtcaccctcagcctcggcacgttggccacgcagtacggctgggcgttcgtgggtctgtcggtcaccgaggtcatggcgtcgagcctcaaggttgtcatagggacaactctgaactactttctcgacggtcggatcaataaggccgagatcatgttccccggtgtcgggtgctttctgatcgcggcgatcctcgggtcactcgtccactcctccaatgctgccga

SEQ ID NO: 37821 - protein, 168 aa, Panicum virgatum
  misc_feature: Ceres CLONE 1991389
  misc_feature (14)..(168): Pfam Name: FAE_3-kCoA_syn1 Pfam Description: Fatty acid elongase 3-ketoacyl-CoA synthase 1
MYLVKDISGAIGLMVVALVLLGTRPVVLAVLERRGRLPQHTFLDFSVTNFLAAVLIALTFGQIGPDTPATPNFLTQLTHFQNNWPSVLFATAGGVTLSLGTLATQYGWAFVGLSVTEVMASSLKVVIGTTLNYFLDGRINKAEIMFPGVGCFLIAAILGSLVHSSNAA

SEQ ID NO: 37822 - DNA, 332 bp, Panicum virgatum
  misc_feature: Ceres CLONE 1991395
  misc_feature: Encodes the peptide sequence at SEQ ID NO. 37823
cgaccccgccccggctgtcgccatggacgacgaggcgaaggccaagggtaatgcggcgttctccgccggccgcttcgaggaggcggcacggcacttctcgcacgccatcgcgctcgccccgggtaaccacgtcctctactccaaccgctccgccgcgctcgcatcgctccaccgctactcggacgcgctcgtcgacgcgcacaacaccgtcgagctcaagcccgactgggccaagggctactcgcggctcggcgccgcgcacttcggcctcggcgaacccgtccgcgccgtaaccgcctacaagaaggggctcgcgctcgaccccaccaacg

SEQ ID NO: 37823 - protein, 103 aa, Panicum virgatum
  misc_feature: Ceres CLONE 1991395
  misc_feature (2)..(35): Pfam Name: TPR_2 Pfam Description: Tetratricopeptide repeat
  misc_feature (70)..(103): Pfam Name: TPR_2 Pfam Description: Tetratricopeptide repeat
  misc_feature: SWISSPROT Homolog: EC 3.1.3.16 Phosphoprotein phosphatase
MDDEAKAKGNAAFSAGRFEEAARHFSHAIALAPGNHVLYSNRSAALASLHRYSDALVDAHNTVELKPDWAKGYSRLGAAHFGLGEPVRAVTAYKKGLALDPTN

SEQ ID NO: 37824 - DNA, 412 bp, Panicum virgatum
  misc_feature: Ceres CLONE 1991399
  misc_feature: Encodes the peptide sequence at SEQ ID NO. 37825
acgagcgacagccagtcaccacctacccgaagccgccgcgaccgatcgagccgagcgccccgcccccacgccgcgccgcgccgcgccgccaccgaaaccctagctcctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcaactgcagcaacatcggcgtcgcgcagatcgtcgccgcggcgtggtcggactgccccgccggccgcccccactccgggcggcggcggagggcggggcggcgccgttgttgctgttgtggcggggggcggtggtgcggtggtggcggtcgttgggcggcggg

SEQ ID NO: 37825 - protein, 95 aa, Panicum virgatum
  misc_feature: Ceres CLONE 1991399
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGRRRRAGRRRCCCCGGGRWCGGGGRWAA

SEQ ID NO: 37826 - DNA, 677 bp, Panicum virgatum
  misc_feature: Ceres CLONE 1991400
  misc_feature: Encodes the peptide sequence at SEQ ID NO. 37827
gggatgggtattacttcacactcactgtctctgttggctcaccaagtgtacgcttaactcttgattacacaggcatgttaaatatccaaagatggaacagcagcacgtcctcatggacagtcttcgaaaaattccccagtccaacctgtgacaggtatgccttttgtcgcctgtttggctactgtgatagcactgagtatgttccgacatgcaagtgcctcgatgggtatgagcccagtggtcttaatttttcccaaggatgtcggagaaaggaggagctcaaatgtggccatggagagagtttcttgaccttgcccaccatgaagactcctgacaagttcttgtacatcaagaacagaaccttcgatcaatgcactgcagagtgcagtcacaactgctcatgtacagcgtatgcttatgctaacctgaaaaatgttaacacgacggtggaccagacaaggtgcttggtttggatgggggagcttgtcgatgtagagaagcttgatagcacttttggtgagaacctatatctccgtgttcccaggtcaccaggtatttacttttcctcgtgcaccttgacacttgacctattcacagacgattaattaggaatgctagtacaattaaagcatggtccagtggtattttctgccagttgatgctgcctcaattggccc

SEQ ID NO: 37827 - protein, 200 aa, Panicum virgatum
  misc_feature: Ceres CLONE 1991400
  misc_feature (95)..(164): Pfam Name: PAN_2 Pfam Description: PAN-like domain
DGYYFTLTVSVGSPSVRLTLDYTGMLNIQRWNSSTSSWTVFEKFPSPTCDRYAFCRLFGYCDSTEYVPTCKCLDGYEPSGLNFSQGCRRKEELKCGHGESFLTLPTMKTPDKFLYIKNRTFDQCTAECSHNCSCTAYAYANLKNVNTTVDQTRCLVWMGELVDVEKLDSTFGENLYLRVPRSPGIYFSSCTLTLDLFTDD

SEQ ID NO: 37828 - DNA, 643 bp, Panicum virgatum
  misc_feature: Ceres CLONE 1991423
  misc_feature: Encodes the peptide sequence at SEQ ID NO. 37829
acacacacccagctcacagcctcctccaccagcacacacagctccagcagcaggggccgtcacagccatgggcaaggactgcggcaaccacggcgacgacgagttcaagcagtcgctccggcgcctgctgggcgtcctcctgttcctcgccctcctcgtcggcctcatcgcgctcatcgtctacctcgtcctccgccccacgcacccgcgcttcgtcctccaggacgccgcgctccgccagctcgacctctccaacggctccgcgccgctgctctccacggcggcgcagttcaccgtcgcctcccacaaccccaacggccgcgtcggcgtgcactacgaccgcctcgacgtctacgcctcctacaagtaccagcaggtcacgctcgcgtccaggctcccgccggtgtaccagggccacggcgacgtcgacgtctggtcgcccgtcctggccggcccgaacgtccccttcgcgccgttcctcgccgacgccatgaggaaggacatcgccaacgggtacctcatcatggaggtcaggatcgacggccgcgtccgctggaaggtcggcagctggacctccggccactaccacatcttcgtcacctgcccggcctacttcatcggcagcggcagctccagcgtcgtc

SEQ ID NO: 37829 - protein, 191 aa, Panicum virgatum
  misc_feature: Ceres CLONE 1991423
  misc_feature (39)..(179): Pfam Name: Hin1 Pfam Description: Harpin-induced protein 1 (Hin1)
MGKDCGNHGDDEFKQSLRRLLGVLLFLALLVGLIALIVYLVLRPTHPRFVLQDAALRQLDLSNGSAPLLSTAAQFTVASHNPNGRVGVHYDRLDVYASYKYQQVTLASRLPPVYQGHGDVDVWSPVLAGPNVPFAPFLADAMRKDIANGYLIMEVRIDGRVRWKVGSWTSGHYHIFVTCPAYFIGSGSSSV

SEQ ID NO: 37830 - DNA, 1554 bp, Panicum virgatum
  misc_feature: Ceres CLONE 1991425
  misc_feature: Encodes the peptide sequence at SEQ ID NO. 37831
gagcctggctcgctaatctcgcgcacaggaaagacgagagcagctacctgctagagtggtcagcaatggcgcagctgggagcacccgctgacgagcagcggcaggaggaggcgctgcacggcgagaaggacggcgtcgacgtcgccggcggcggcagcgagagcaacaagaaggcgcgcgcggggctatgcggcgtgctccgggagcgcaaggtgggggacctggcgcgcgccaagcgccggctggtggaggtcccctacaccgcgacgctggcgcacacggcgaacgcgctcctcgcggcgcgcgtctccgcggtcgccgtggccgcgccgccgggccactggatcggcgccggcgggtccatgatcctcgagtccgacccggccaccggcgccgtccgcaagcactacatcggcatggtcaacatgctcgacatcctcgcccacatcgccgaggccagtgacgaggccgaggccgacgacgaggcggtcgacctcgaccgccgcatggccgtcccggtgtcctccgtcatcggccactccctcgagggcctcaccctctggacgctccatcccaacaccagcgtgctggactgcatggagacgttcagcaagggggtgcaccgggcgctggtgccgctggagagctcggcggacaacgtggtggcggtggagctcgtggagtccgcgccggggtaccggatggtcacccagatggacgtggtgaggttcctccgggcgcacggcgcggagctcaagggcgtgctgtcgcgcaccgtgcgcgagctcggcgccgtgagtgaggccgtgttcgcggtcgcgagcggcgccagggtgatcgacgccatcaaggcgatgcgcgcggcgtcgctcaccgccgtgcccgtcgtggacgccgccgccgtcggcgaggagaccctgcaggacgtgagtgcatccagtccagctccgatgagcacatcggcggcggcgacatctctgggttattatatcctgttgcttgtctcgcaggggatggggaagaaggcgatcgagaccttctcggcgacggacctgcgcgactgcccggtggcgcggctgcagccgtggctggggatcagcgtgacggagttcaagaggaaggtggccgagtaccgggcgagcaacaagcccgtcgtccccggcgccgatgccacggacacaggcgtcccggctgctgccgacgacgccgacacccccgcggcggctgccgttgccaccgatgaagagcagagcaacgagcagccgctggtgacgtgctccctggagagcaccatcggcgaggcgatcgaggcggcggccacgaggcacgtgcaccggctgtgggcggtggacgaggaagggctgctgcgcggggtcgtgtcgctgaccgacgtcctccgggcggtgagggaggccgcgctcggcgaggaccgggagctccacagcatcgtgtcgtcctagaagttggcatcgaagtgcgtctgtactaagtgtcaacagataaaattttgttgacttttccactcgtgttcgtcggcaaagtttggtgcttgtg

SEQ ID NO: 37831 - protein, 464 aa, Panicum virgatum
  misc_feature: Ceres CLONE 1991425
  misc_feature (242)..(448): Pfam Name: CBS Pfam Description: CBS domain pair
MAQLGAPADEQRQEEALHGEKDGVDVAGGGSESNKKARAGLCGVLRERKVGDLARAKRRLVEVPYTATLAHTANALLAARVSAVAVAAPPGHWIGAGGSMILESDPATGAVRKHYIGMVNMLDILAHIAEASDEAEADDEAVDLDRRMAVPVSSVIGHSLEGLTLWTLHPNTSVLDCMETFSKGVHRALVPLESSADNVVAVELVESAPGYRMVTQMDVVRFLRAHGAELKGVLSRTVRELGAVSEAVFAVASGARVIDAIKAMRAASLTAVPVVDAAAVGEETLQDVSASSPAPMSTSAAATSLGYYILLLVSQGMGKKAIETFSATDLRDCPVARLQPWLGISVTEFKRKVAEYRASNKPVVPGADATDTGVPAAADDADTPAAAAVATDEEQSNEQPLVTCSLESTIGEAIEAAATRHVHRLWAVDEEGLLRGVVSLTDVLRAVREAALGEDRELHSIVSS

SEQ ID NO: 37832 - DNA, 1225 bp, Panicum virgatum
  misc_feature: Ceres CLONE 1991439
  misc_feature: Encodes the peptide sequence at SEQ ID NO. 37833
acccgcacacgaatcaccatcggaaagcgaaagattctcacgcccggacgcccccgagcctgacctgtgcagtgagtgaccgctgcgaccccgccccggcggctgaacccaaacaaaaccccgatgtcgccggcggcgaggcgcctcctgctcgcccgccgccgatgcctctccacgggcgcggcgtcatcggcccccacgtcgtcgcagctgcccaggggcaagcgctgggacgcagtggtgatcggcggcggccacaacggcctcgtcgccgccgcctacctcgcccgcgcgggccgctccgtcgccgtgctcgagcgccggggcgtcctgggaggcgccgcggtgtcggagtccgacctcgtcccgggcttccgcttctcccgctgcagctacctcctcagcctcctccgccccgccatcctccgcgatctggagttggagaggcacgggctgaagctgctgccgcggagcccgtcatcgttcacaccatgcctagacggcagatacctgcttcttggtccggatgcagagctgaaccactcagagatcagcaagttctccaacarggatgcaaatgcgtacccaaggtacgaggagcagctggagaagttctgcaagctcatggactttgtcattgactcrgctccacccgagctgaggcaggacttccacacctctatggttgacaggatgaaggatagggtcgataagtcagcattctggggaaatcttcttcggcatgtgatgcagcaggggcagaagaacatggtggaattctttgacctcctcctttcgccggcatcgaaaatcttgaactgctggtttgagagcgaggttttgaaggcgactcttgcaactgatgcagtgataggtaccatggctggtgtcaacactccaggttctggatatgttcttctgcaccatgtaatgggggaaactggtggtcgacgtggtgtttgggcgtatgtccaaagtggtctgggttcagtgtcatcagctataagcaaagcagctcttgaagcaggagtacagattgtaacaaatgctgaggtttcccaagtgatggttaatgaaactacaggaaaggttgaaggggtagctttggctgatggaacccaggtgcactcgccagttgttctatcaaatgccactccatacaaaacatttgtggacctagtgcctgtcaatgttcttccagagtactttctctccactattaaga

SEQ ID NO: 37833 - protein, 367 aa, Panicum virgatum
  misc_feature: Ceres CLONE 1991439
  misc_feature: SWISSPROT Homolog: EC 1.3.99.23 All-trans-retinol 13,14-reductase
  misc_feature (149)..(149): Xaa is any aa, unknown, or other
MSPAARRLLLARRRCLSTGAASSAPTSSQLPRGKRWDAVVIGGGHNGLVAAAYLARAGRSVAVLERRGVLGGAAVSESDLVPGFRFSRCSYLLSLLRPAILRDLELERHGLKLLPRSPSSFTPCLDGRYLLLGPDAELNHSEISKFSNXDANAYPRYEEQLEKFCKLMDFVIDSAPPELRQDFHTSMVDRMKDRVDKSAFWGNLLRHVMQQGQKNMVEFFDLLLSPASKILNCWFESEVLKATLATDAVIGTMAGVNTPGSGYVLLHHVMGETGGRRGVWAYVQSGLGSVSSAISKAALEAGVQIVTNAEVSQVMVNETTGKVEGVALADGTQVHSPVVLSNATPYKTFVDLVPVNVLPEYFLSTIK

SEQ ID NO: 37834 - DNA, 642 bp, Panicum virgatum
  misc_feature: Ceres CLONE 1991451
  misc_feature: Encodes the peptide sequence at SEQ ID NO. 37835
gctcggcagctcacacccgagcagcagcgcagcgcacagccggcgcatgtgagcgggccggcgccgcgaggggcacacgcattctttctccgccgggaaacgaggtccggcggcgatggaggcgagcgcggggctggtggccggctcgcacaaccggaacgagctggtggtgatccgccgcgagcccggcggcggggggcccggggcggcggcgcggctggcggcggaggcgccgtgccagatatgcggggacgacgtcggggtgggcttcgacggggagcccttcgtggcctgcaacgagtgcgccttcccggtctgccgcgcctgctacgagtacgagcgccgcgagggctcgcaggcgtgcccgcagtgccggacgcggtacaggcgcctgaaagggtgcccccgcgtcgccggcgacgaggacgaggacggcgtcgacgacctcgagggcgagttcggcctgcgccacggcggggaggagggcggggacggcggcggcgacccccgggacgtcgccgcgtccatgctgcgggcgcacatgagctacggccgcggcgacgcgcaccacccggccgccggcttcggcgccgcccccggcgtcccgctcctcaccaacggccagatggtcaacgacatccc

SEQ ID NO: 37835 - protein, 175 aa, Panicum virgatum
  misc_feature: Ceres CLONE 1991451
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Useful for making plants with altered cell wall content and/or composition
  misc_feature: Useful for making plants with modulated biomass
MEASAGLVAGSHNRNELVVIRREPGGGGPGAAARLAAEAPCQICGDDVGVGFDGEPFVACNECAFPVCRACYEYERREGSQACPQCRTRYRRLKGCPRVAGDEDEDGVDDLEGEFGLRHGGEEGGDGGGDPRDVAASMLRAHMSYGRGDAHHPAAGFGAAPGVPLLTNGQMVNDI

SEQ ID NO: 37836 - DNA, 1858 bp, Panicum virgatum
  misc_feature: Ceres CLONE 1991462
  misc_feature: Encodes the peptide sequence at SEQ ID NO. 37837
tcggtcgagccgctgatcggtctcgtctcccactctccccaacatctccgtcgcacctgataccttccctctccttgccttcgcctggtgagttcccctcaccgccgtggacgcgaaaaccgtcgcttcgcttcccaacagataacaccgcccggcagcggccgggcccggcgccagccgagctctaggcccggtcccgcggccccaaccctagctccctcccgcagccccggaggcggcgcgggcggcgggggcagccgcgatgctgttccaggtgggagggcagggcgcgcggcccaccttcttcgagatgtcggccgcgcagcagcttcccgccagcctccgcgccgcgctcacctactcgctcggggtttttgcactaagaaggccaatactacacaaagttttagattatgaagatgaattctttgctttgttaatgggtgtccttgagtctcatagtctacggacaacagatggttctttttcagagtcattatatggtctcaggaggagacctgttaaggtttcagtgaagagaaagagccctggtacagaatccagtgacaaagtctatgattctgcactaaggaagcgtcagaaaatcctctcggtggttttcttggttgttttgccatattttaagtcaaagttgcagtctatatacaataaagaaagggaagccaggttgcaggcaactctttggggtcaggatgatgtgaggtttgatgaagctggctttgtattagatcaggagcagacttcccaagcacagaatgaccctacaaccggagaagtgtcaaacttgacacgttttaagaactttgcttcactcataggtgtttgctatccatggattcatgcaactaatgaaggtctctcgtttgcataccagctgctatatttgttggatgccactgctttttatagtccagcactgcatgtgctagggcttcacgtttgtcgtgctactggacaagagctgatggattcatcttctaggatatcaaggattagaaatcgtgaacttaagagacttcgtggtcctccatggttgaaggctgtgcaacgggtgttccttagttgtatatatacaactctagattatgcacaaacaggtttaattgctgcagtcttctttttcaagatgatggagtggtggtaccaatccgctgaagaaagaatgtcagctccgactgtatacccaccgccgcctccaccaccaactccaaaggttgccaaagacggaatccccttgccaactgacaaaacgctctgccccctgtgctgccagaagcgcgccaacccctctgttctttctgtttctggttttgtattttgctacagctgcatattcaagtccgtctctcagcataaaaggtgccctgtcacgctgatgcctgccactgttgaacaaattagtcgcctcttcaatgatttgtagccatgaatatacacaacacttgaatttttgctgaggaacaggaggaagtcagcatataaaaaacatatagcgcaaccactgctttgtccaaccacaagagtacttggtttgaatctcaccttttgatactcaagcacgatacacagatggcccaattcttctcgttttaggaaaattgatttgttctcatactcctgtacttttctttttgtggttcattgagaattgaagctttggtaatttttggctggggtttataatttgttgttaggtgatacagcacagatgaggtaactataaccagttaggtcatgtgaaggttctgcacatctctttgtaaaagtttggttgtaatttggtaataactctgttatgtttttaacgccacattgctttctcttcggagcaaacttc

SEQ ID NO: 37837 - protein, 393 aa, Panicum virgatum
  misc_feature: Ceres CLONE 1991462
  misc_feature (16)..(304): Pfam Name: Pex2_Pex12 Pfam Description: Pex2 / Pex12 amino terminal region
MLFQVGGQGARPTFFEMSAAQQLPASLRAALTYSLGVFALRRPILHKVLDYEDEFFALLMGVLESHSLRTTDGSFSESLYGLRRRPVKVSVKRKSPGTESSDKVYDSALRKRQKILSVVFLVVLPYFKSKLQSIYNKEREARLQATLWGQDDVRFDEAGFVLDQEQTSQAQNDPTTGEVSNLTRFKNFASLIGVCYPWIHATNEGLSFAYQLLYLLDATAFYSPALHVLGLHVCRATGQELMDSSSRISRIRNRELKRLRGPPWLKAVQRVFLSCIYTTLDYAQTGLIAAVFFFKMMEWWYQSAEERMSAPTVYPPPPPPPTPKVAKDGIPLPTDKTLCPLCCQKRANPSVLSVSGFVFCYSCIFKSVSQHKRCPVTLMPATVEQISRLFNDL

SEQ ID NO: 37838 - DNA, 1877 bp, Panicum virgatum
  misc_feature: Ceres CLONE 1991473
  misc_feature: Encodes the peptide sequence at SEQ ID NO. 37839
gccttgtcctcgcctgctgcttcaaacaacagactcgcaaaccgggaaatccccagtccgggcactcagccatgggcaaccgcgggtcgcgccaccaccgccacgcagccgaccagcagcaaccggcggcgccgcccaagccccaggcccaagcgccgccgccgcagcagcagcagcagccgcaggcgaggccgaagccggcggcggcggacgcgggggcggtggggcgcgtgctggggcggccgatggaggacgtgcgcgcggcctacaccttcgggcgcgagctcggccgcggccagttcggggtcacctacctcgtcacgcaccgggagaccggccagcgcttcgcctgcaagtccatcgccacgcggaagctcgtccaccgcgacgacatcgaggacgtgcgccgggaggtgcagatcatgcaccacctcacgggccaccgcaacatcgtcgagctccggggcgcctacgaggaccgccactcggtcaacctcgtcatggagctctgcgagggaggggagctcttcgaccgcatcatcgccaggggccactacaccgagcgcgccgccgcggcgctctgccgcgagatagtcgccgtcgtccacagctgccactccatgggggtcttccaccgggatctcaagcccgagaatttcctcttcctcaacgacaaggaggactcgccgctcaaggccacggacttcggcctctccgtcttcttcaagcccggggagacattcaaggatcttgtgggaagcgcgtattatgttgctcctgaggtactcaaacggcactatggggcagaggctgatatttggagtgctggggttattctttacatccttctttctggtgttcctcccttttgggcagagaatgaggatggcatatttgatgccgtcttgcacggtcacattgatttctcttctgatccttggccatcaatatctaatggtgccaaggatttggttaagaagatgctgcggcaggaccccaaagagcgcctgactgcttctgaaattttgaatcatccatggattagagaggatggagaggccccagataagccacttgacatcacggtcatcagtagaatgaaacagttcagggcaatgaacaagctcaagaaagttgctttgaaggttgttgctgagaacttatcagatgaagagattatgggccttaaagaaatgtttagatcccttgatacagataatagtgggacaattactcttgaagagctaagatctggtttaccaaaacttggcactaaaatttctgaatcagatatcagacagttgatggaggcggctgatgttgatggaaatggtaccattgattatgcggagttcatatcagccacaatgcacttgaatagattggagaaggaagaccacatactcaaagcttttgaatattttgataaggatcacagcggatacataacagtagatgagttggaagaagctctgaagaagtatgatatgggagatgataaaacaataaaagagatcattgctgaagtagatacagatcacgatggaagaattaattatcaggagtttgttgccatgatgaggaacaacagccctgagattgttccgaaccggaagcgcatgttctaactgccgtgtacaatttgaatgaacccttttgagcatattttgcccttagacatcttctcctggagccattttcttttggggaaagccgttaagaaaactacatttgagatccatatatctgcagccaggaccagtttgtaccagaatgggtcgcatgatataaggagtcgagcctagatgctatggactctgggtgcagtatttctactcactgtatgcataatgcctttgagattgttttgcggcttt

SEQ ID NO: 37839 - protein, 518 aa, Panicum virgatum
  misc_feature: Ceres CLONE 1991473
  misc_feature (66)..(324): Pfam Name: Pkinase Pfam Description: Protein kinase domain
  misc_feature (478)..(506): Pfam Name: efhand Pfam Description: EF hand
  misc_feature (443)..(471): Pfam Name: efhand Pfam Description: EF hand
  misc_feature (371)..(399): Pfam Name: efhand Pfam Description: EF hand
  misc_feature (407)..(435): Pfam Name: efhand Pfam Description: EF hand
  misc_feature: SWISSPROT Homolog: EC 2.7.11.1 Non-specific serine/threonine protein kinase
  misc_feature: The sequence is a functional homolog of SEQ ID NO 2 in US patent 7084323
MGNRGSRHHRHAADQQQPAAPPKPQAQAPPPQQQQQPQARPKPAAADAGAVGRVLGRPMEDVRAAYTFGRELGRGQFGVTYLVTHRETGQRFACKSIATRKLVHRDDIEDVRREVQIMHHLTGHRNIVELRGAYEDRHSVNLVMELCEGGELFDRIIARGHYTERAAAALCREIVAVVHSCHSMGVFHRDLKPENFLFLNDKEDSPLKATDFGLSVFFKPGETFKDLVGSAYYVAPEVLKRHYGAEADIWSAGVILYILLSGVPPFWAENEDGIFDAVLHGHIDFSSDPWPSISNGAKDLVKKMLRQDPKERLTASEILNHPWIREDGEAPDKPLDITVISRMKQFRAMNKLKKVALKVVAENLSDEEIMGLKEMFRSLDTDNSGTITLEELRSGLPKLGTKISESDIRQLMEAADVDGNGTIDYAEFISATMHLNRLEKEDHILKAFEYFDKDHSGYITVDELEEALKKYDMGDDKTIKEIIAEVDTDHDGRINYQEFVAMMRNNSPEIVPNRKRMF

SEQ ID NO: 37840 - DNA, 1145 bp, Panicum virgatum
  misc_feature: Ceres CLONE 1991482
  misc_feature: Encodes the peptide sequence at SEQ ID NO. 37841
aatgtatcctttttgctgcaactgaaaaaatgctacccaggcgtagctggctacttttaactgttttgtgagacttggtgttgttaatcgtatttgaatgttgttaatcgtataggcaacttaatgttgttgcgtgctacagtaggacgacgcgcatttgaatgcaaaaaaaaaaaaaaaaaaactctctcttcccagtccgctcggccaccagctttgaccgcctcctcccgtcctccgctcccctccgctactgctcctccccatcccacttccccgcaggagaggcagcggcggcggcggcggcggcggcgacggcggctaagcgtaacccccacctcggcgagcggcaccggcggcggcaaaggcaagatgttcgggcgcgcgccgaagaagagcgacaacaccaagtactacgagatcctcggggtgcccaagtccgcatcccaggacgacctcaagaaggcctaccgcaaggccgccatcaagaaccaccccgacaagggcggcgaccccgagaagttcaaggagcttgcacaagcttatgaggttttgagtgatccagagaagcgtgagatttatgatcaatatggtgaagatgccctcaaagaaggaatgggtggaggaggagcccatgtagatccatttgacatcttctcatcattctttggaccctcttttggaggaggtggtggcagcagcagaggcagaaggcaaaggaggggagaagatgtcgtgcatccacttaaagtttctctagaagatctttacaatggtacctcaaagaagctctcgctttcacgtagtgtcatctgctccaagtgcaaaggcaagggctccaagtctggtgcttcaatgaggtgcccaggttgccagggttcaggtatgaagatcaccatccgccagctgggtccttccatgatacagcagatgcagacagcttgcaatgagtgcaaggggactggagagagcatcaatgagaaggatcgctgcccagggtgcaagggtgagaaagttgttcagaagaagaaggttctggaagttcacgttgagaaggggatgcatcacaaccagaagatcactttccctggcgaagctgatgaagcgcctgacactgtcaccggagacattgtattcttccttca

SEQ ID NO: 37841 - protein, 257 aa, Panicum virgatum
  misc_feature: Ceres CLONE 1991482
  misc_feature (135)..(221): Pfam Name: DnaJ_CXXCXGXG Pfam Description: DnaJ central domain (4 repeats)
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAQAYEVLSDPEKREIYDQYGEDALKEGMGGGGAHVDPFDIFSSFFGPSFGGGGGSSRGRRQRRGEDVVHPLKVSLEDLYNGTSKKLSLSRSVICSKCKGKGSKSGASMRCPGCQGSGMKITIRQLGPSMIQQMQTACNECKGTGESINEKDRCPGCKGEKVVQKKKVLEVHVEKGMHHNQKITFPGEADEAPDTVTGDIVFFL

SEQ ID NO: 37842 - DNA, 626 bp, Panicum virgatum
  misc_feature: Ceres CLONE 1991482-R
acgaggggatgccaatgtaccagaggcctttccatgaaggggaagctctacattcacttcacagtagagttcccagactcgctggcaccagagcagtgcaaggcccttgaggcggtacttccaccaaagcttacatccaagctgacagacatggagatagatgagtgtgaggagaccactatgcatgatgtgaacaacatcgaggaagagatgcgcaggaagcaagctcatgccgcccaggaggcgtacgaggaggacgacgagatgcctggaggagcccaaagagtgcagtgtgcacaacagtaagctgagtgtatcatcaaggggcttcgcagcgctgcacacgtagtaatctgcaaggtttgcggtggacctttggacccagtgtgatctctctggttttgtcgtcggagttatgaaacagaggaagctgattctgattctaccccgttgggggcggggaatgtatcctttttgctgcaactgaaaaaatgctacccaggcgtagctggctacttttaactgttttgtgagacttggtgttgttaatcgtatttgaatgttgttaatcgtataggcaacttaatgttgttgcgtgctacagtaggacgacgcgcatttgaatg

SEQ ID NO: 37843 - DNA, 558 bp, Panicum virgatum
  misc_feature: Ceres CLONE 1991487
  misc_feature: Encodes the peptide sequence at SEQ ID NO. 37844
acagccccttccccacccacccccccccccccccccccgcgtcgtggtggaggtggtctggcagctagcaccgccaaggcgccaacccgcgagcagatcacgagagatggccacggcgacctacctctccttctcggcggcgccgtcgtcgtgcgccggccggcagcggcggcggcaggcgacgcgggcgtcggcgtccgcgacggaccggccgcgcgaggtggtgtcgccgaagcggcggctgccgctgcggaaggtgccgggcgactacggcccgccggtggtgggcgcgctccaggaccggctcgagtacttctacgggcccggcgggcgcgacggcttcttcacggcccgcgtccgcgcgcacggctccaccgtggtgcggctcaacatgccgccggggcccttcgtggcgcgcgacccgcgcgtggtggcgctgctcgacgccgcctccttcccggtgctcttcgacacctcgctcgtcgacaagacggacctcttcaccggcaccttcatgccctccaccgacctcaccggcggctaccgcgtgctctccta

SEQ ID NO: 37844 - protein, 150 aa, Panicum virgatum
  misc_feature: Ceres CLONE 1991487
  misc_feature: SWISSPROT Homolog: EC 4.2.1.92 Hydroperoxide dehydratase
MATATYLSFSAAPSSCAGRQRRRQATRASASATDRPREVVSPKRRLPLRKVPGDYGPPVVGALQDRLEYFYGPGGRDGFFTARVRAHGSTVVRLNMPPGPFVARDPRVVALLDAASFPVLFDTSLVDKTDLFTGTFMPSTDLTGGYRVLS

SEQ ID NO: 37845 - DNA, 1336 bp, Panicum virgatum
  misc_feature: Ceres CLONE 1991505
  misc_feature: Encodes the peptide sequence at SEQ ID NO. 37846
agtggagtggagcggtgaccactctgctgtgcagcagacagcagctcgccgccgcggccgctgtgcgaccgtcgggggtgatggaggcgccggcaccatggagagtgctcgagttctacagcggcatcggcggcatgaggtactcgcttatggcgtccggcgcgcgggcggatgtggtggaggccttcgacatcaacgacgtcgcgaacgacgtctacgagcacaacttcggccaccgcccctgccaggggaacattcaaacactcactgctagcgaccttgacaaatataaggcacatgcatggcttctttctcctccatgtcagccatacacacggcaagggcttcagaagcattcagctgatgcccgtgcattttcgttcatcaagattcttaacctcatgcagaacatgagctaccctccacaaatgttatttgtggaaaatgtagtcggatttgaggtgtctgatacacatgaccagttgctggaggtcctttcaagtctaaattttaacttacaagaattcatcctaagcccattacagtttggtgtcccatactctagacctcgctacttttgtttggtaagaacttttgagtatcttggcatgtctagattttgtgtcacactgtcactgttatggcattctgatagccattgtttttatttttatttgcttattgcttcttaaactctctatatcctgaaggaagtccagggaatgtgttgtgtaggattgtcaaaatatgatacttttccaagcatgttgacaaatgtataactagtgactgcaaatgtatctatttctctcagaaaagagaaagtgtctctttatggtgcattttatgaaaaatccactggattgtgacattgtgtaaagcaattctgtgtctacctgccaattttgaatcaacaggcgaaacgagaacctatgcgatttcaaaatgcatcagtcaacaataagttgctctggacacctatgtgcctaagccagacagtgaaatgtacatcacaggatagggaccaccaaactgaagaagagcaggatccagtatgtaaaccagtaaatgactttcttgtcatggaggctgatgcaggcattcaaaatcaaacaattttgcaagattacatagtcccgctaaacttgattgagcggtgggggaatgctatgggtatccttggttctttcttgtataaagttaccttctttattatttttttattgttccttaggtagggttctttctgttcgttactttgatgctttttagttaacttgtaatgatcaatgtcgtattgtgatgactcttgactatttgcaagatattgtatacc

SEQ ID NO: 37846 - protein, 203 aa, Panicum virgatum
  misc_feature: Ceres CLONE 1991505
  misc_feature: SWISSPROT Homolog: EC 2.1.1.29 tRNA (cytosine-5-)-methyltransferase
MEAPAPWRVLEFYSGIGGMRYSLMASGARADVVEAFDINDVANDVYEHNFGHRPCQGNIQTLTASDLDKYKAHAWLLSPPCQPYTRQGLQKHSADARAFSFIKILNLMQNMSYPPQMLFVENVVGFEVSDTHDQLLEVLSSLNFNLQEFILSPLQFGVPYSRPRYFCLVRTFEYLGMSRFCVTLSLLWHSDSHCFYFYLLIAS

SEQ ID NO: 37847 - DNA, 691 bp, Panicum virgatum
  misc_feature: Ceres CLONE 1991505-R
  misc_feature: Encodes the peptide sequence at SEQ ID NO. 37848
cctgaatccaagcggtgctgttgtttcactaaaagctactatcgctatgtgaaggggacaggctccttgctggctacatctgaaaacctcaaatgggttcctgaagagaagcttgcaatttcttccctgaaggagttaggcctacgatttttcacccctcgagaggtcgccaatttccattccttcccttcaagcttctgcttcccggatcacataagccttaggcaacagtatgctatgttgggcaacagtctgagtgtagcagttgtgggtcctttgctgcgttatctgtttgctgaggcatagataagtccaccagccagctggtgatgttaacctgtcacaaacacttcggctactagttgctggtcaaaattttccataacttaagcaaggttttaggaagtttggtcagtgggaacacttcgaaaaggaggctgctacccgcaaaggatcactggaactatggcggatctaacctattattacaagagaagctgtttctgcgttgcttttcccccatgcgcacctcgtcatgtcgaatacttgaatgatggttggaattatgacatgtgatccatcgatatgtactttaatgaggttattgtaatgattgtggatctgagcacaagtaacttccactgaatcctgtagccaattattaatagcgaatatatttgttttttttttc

SEQ ID NO: 37848 - protein, 101 aa, Panicum virgatum
  misc_feature: Ceres CLONE 1991505-R
  misc_feature: SWISSPROT Homolog: EC 2.1.1.29 tRNA (cytosine-5-)-methyltransferase
PESKRCCCFTKSYYRYVKGTGSLLATSENLKWVPEEKLAISSLKELGLRFFTPREVANFHSFPSSFCFPDHISLRQQYAMLGNSLSVAVVGPLLRYLFAEA

SEQ ID NO: 37849 - DNA, 665 bp, Panicum virgatum
  misc_feature: Ceres CLONE 1991517
  misc_feature: Encodes the peptide sequence at SEQ ID NO. 37850
atcgaagaagcggcatcgaggaaaccggtacgaacgctcgagaaaatcaagatgtgggggaaggggaagaagcgcttcggcggcgggggcgggggcgagccggcggccaagcgccaggccgccggggacgaggggccttctgaatccgccgaagacggaaccgtcgtggccgagatatcgaagaacaagaaggtgtcggtgaggagctggaagggcaaggtctacgtcgacatgcgcgagttctacgtcaaggacggcaagaccctccctacccgcaaaggtaccgccagcgccttcttccccctcattgctattctgccattcctgtcgactggactgtttcctagcagcgcctcgcatgtccgagtagagcgctccaagtccatgcgtcttgcacgattgttgtcttagatggatttgttctagggctcgacataggacgctggtgggtttattgtagaaatcaataaaatgggatgaatggctttgtttaacttcctccccccacgctctaggaccattttggttttattagattgatgccatttttatttgaaccaccatgtgaatcacatatgcagttctaatatttgcctagttaatgtacaatgatggtcttgtgagaagcatgcaaagtacatcaaaccgggtctatttatcatgtt

SEQ ID NO: 37850 - protein, 119 aa, Panicum virgatum
  misc_feature: Ceres CLONE 1991517
  misc_feature (12)..(96): Pfam Name: PC4 Pfam Description: Transcriptional Coactivator p15 (PC4)
MWGKGKKRFGGGGGGEPAAKRQAAGDEGPSESAEDGTVVAEISKNKKVSVRSWKGKVYVDMREFYVKDGKTLPTRKGTASAFFPLIAILPFLSTGLFPSSASHVRVERSKSMRLARLLS

SEQ ID NO: 37851 - DNA, 1940 bp, Panicum virgatum
  misc_feature: Ceres CLONE 1991525
  misc_feature: Encodes the peptide sequence at SEQ ID NO. 37852
aggcgaacaggaaatggtcgatttggtgttgactggacccaacataggcttctcagcgcttgggtgctttgctatcaaagttgacatcccaggcaccgccactgcaggtagcagcagaggtgatgccggtggtcccatcgaatgggaatgggattgctatgaccctgctgaagttggccacaaaccaaaaaccgtgacccgcaccatcatctcttcgggccccggtcgcaacgtagaggtcacgtatgcggtgatgcctgacgctcttgaggctagtgtgcaggtcaagctgcggctcaaagatgggcacagccatagcgttcacggtaacatcaaagcacgcccacgcccatacatcaggcgctatgaagcctggagtgtcgtcctcttcaggcgaacaaaggggatgggtcagcgtttctcccccactgattcccggttccttcagctagcgcggtctgttgttgcggtgccacgtggtcgggaccttcacatagaggtggagctgcagattgaaacttccaacatccaagggtgcaagcctttgaaagttggtttccacttaaaagcaggtcaaaatcattggcgtactcaagttgacggcgacgaaattgaagtgaatgtcacctggtatccagatagctggcaagcgcagaaacactacgaaatgcctcggcagcagcaacctgacatatcatacatcattggggatgaaggagggttccgtagattcatcgaggggctgcgtaacactgtcgcggaccatccaccacgccgcgaggatgtcttagacaacctagatccctccaaacgaaaccatccagtgatggtctccaaggacagttatgagaaacaacccaggtggcttgaaatcaagctgcaagtggcgggcgaggagacgtcgacgaccctagcagttcgggctgacagcttgaaagtcataggcttcatgaaccagaacggaaattggttcgttcttgttcatgaaacagaacgaagactcttcccctggcggggcctcccacacaattacaaagcacaacttctacactggggcaaaagcttgttgggcaactataaaaacatactggatgccggaaacgaggaggaagtcgtgaagatactggactccgcgaggctgggcaagaccttcgctgcggacgccgtgcgcgtgctttcgcgctacccagatgtggcggacggtgacaactccaggctggccctggtgggcctaagcgtcatggtctgcgagtccgcgaggatgaaacgtctccacgacgccattgcaggtgactgggataccggggcgagcttcaccatgcaactgctggattacataaagaattgggagagaatatcaagggctctgcttgtctggaaggatcacagctacgaagcatggatcaaagatgagctactagagatgattggaatcaagagcccggaagaagcactggacgtcgttcacctcgtgtgcagagttccaatccaggagagagaactagaacaaagtgtgtatacgtatgattccttctagggccgtggtggaggaacctgcagcagggtggagccgccgtgcatggtcgctgcgccaaatcaggttatttaattgttcccccccttttcttgtgacaaatcagcattatcgatcgtgtgcaccctgcgttttttttttttgccaaatccatccgttaccctttcgttttcgtctttatttattcttctttcacaaatcaaatagagcatgccgtcccgtggagctagcattatgtgtgatcatttaataaggccggtgggtgtttggtttgatccggcctgtaaacccgacagtacgtaacaatgcaaatgtaaaccgtatgtattttttgtttcagcatgtaatgtaacggtttgcgataacaataatactgctgctcgagtgctcgttatatttggcgtcc

SEQ ID NO: 37852 - protein, 507 aa, Panicum virgatum
  misc_feature: Ceres CLONE 1991525
  misc_feature (224)..(493): Pfam Name: RIP Pfam Description: Ribosome inactivating protein
  misc_feature: SWISSPROT Homolog: EC 3.2.2.22 rRNA N-glycosylase
MVDLVLTGPNIGFSALGCFAIKVDIPGTATAGSSRGDAGGPIEWEWDCYDPAEVGHKPKTVTRTIISSGPGRNVEVTYAVMPDALEASVQVKLRLKDGHSHSVHGNIKARPRPYIRRYEAWSVVLFRRTKGMGQRFSPTDSRFLQLARSVVAVPRGRDLHIEVELQIETSNIQGCKPLKVGFHLKAGQNHWRTQVDGDEIEVNVTWYPDSWQAQKHYEMPRQQQPDISYIIGDEGGFRRFIEGLRNTVADHPPRREDVLDNLDPSKRNHPVMVSKDSYEKQPRWLEIKLQVAGEETSTTLAVRADSLKVIGFMNQNGNWFVLVHETERRLFPWRGLPHNYKAQLLHWGKSLLGNYKNILDAGNEEEVVKILDSARLGKTFAADAVRVLSRYPDVADGDNSRLALVGLSVMVCESARMKRLHDAIAGDWDTGASFTMQLLDYIKNWERISRALLVWKDHSYEAWIKDELLEMIGIKSPEEALDVVHLVCRVPIQERELEQSVYTYDSF

SEQ ID NO: 37853 - DNA, 731 bp, Panicum virgatum
  misc_feature: Ceres CLONE 1991535
  misc_feature: Encodes the peptide sequence at SEQ ID NO. 37854
aagcagccaagcagccaagcaccgaacgaagcaaagcacacgacacgagatcgccgctgccactccaccgcaatggcgaccgccagagccaggacggctcctttcctcctcgtcctcctcgccaccctcctctgcgccgccgccgtcgccgcgtcgtcctgggacgacgaccgcgagccctcgcgctgcgtgcggcggtgcgaggactggccccggcaccagcgcgcccggtgcgtgcaggagtgccgccgggaggagcaggagcgggagcgggagcggggcgggcacgagctcggccgccgccgcggcgaggggtccggtgacgagcgcgagagcgagggcgagggcgagcaggagcaggagcggagccggcggccgtacgtgttcggccggcgcagcttccggcgcgtcgtccggagcgagcaggggtccgtgagggcgctccggccgttccacgaggcgtccaagctcctccgcggcatccgcgactaccgcgtcgcggtgctggaggccaacccgcgctccttcatcgtgcccagccacaccgacgcgcactgcatcggctacgtcgcccaaggcgagggagtggtggcgacgatcgagaacggcgagcggcggtcgtacaccgtcaaggaaggcgacgtcttcgtggcgccggccggggcggtcacctacctggccaacaccgacggccggaggaagctcgtcatcgccaagatcctccacaccat

SEQ ID NO: 37854 - protein, 219 aa, Panicum virgatum
  misc_feature: Ceres CLONE 1991535
  misc_feature (110)..(219): Pfam Name: Cupin_1 Pfam Description: Cupin
MATARARTAPFLLVLLATLLCAAAVAASSWDDDREPSRCVRRCEDWPRHQRARCVQECRREEQERERERGGHELGRRRGEGSGDERESEGEGEQEQERSRRPYVFGRRSFRRVVRSEQGSVRALRPFHEASKLLRGIRDYRVAVLEANPRSFIVPSHTDAHCIGYVAQGEGVVATIENGERRSYTVKEGDVFVAPAGAVTYLANTDGRRKLVIAKILHT

SEQ ID NO: 37855 - DNA, 1407 bp, Panicum virgatum
  misc_feature: Ceres CLONE 1991544
  misc_feature: Encodes the peptide sequence at SEQ ID NO. 37856
cttctctctttgctccctcgtcggctcctcctccggcagcacggcccccgcgacgccgccatcctccccacctcccgtctcagctggaagcgcgaggcctctcctccgcacaagccctagcaacagctcaccatccgtctgtatcccgcagcgaggagtgcacgcgcgcgggcgcgattcgccgcatctaggcgccacggctgcgaccgcgcgccctccggcgacttccgccgccgcgctcgcagctcggcccagacggatgctcggccgcttccccgtcgctttccgcctcccgcgcggtatactgcgggggagcagcggccgcctcggctcgtccgcaatggccggaggcgacgaggagggtcggctcggggatttcttcgagtacatggagcggctgcgcaactacgagcgctcgggcgtgccgcgaggcgccggaacagactctgacgacggtttcgacctcggccgcatgcgccgtctcctccgaaggctcggcgacccccacacccacttccccgctgtgcatatcgccggcaccaaggggaaaggttctactgctgcattcctgtctaatatcatgagggagcaaggctacaatgtgggctgttattccagcccacatcttctaacgatacgtgaacgaatttctgttggaaatgatggaggacctgtcccagttagactcttaagtgatatttttgatcaggctaaggaagctattgatgaatcgatagaatcagaaaacggagccctgacacattttgaggtttttactgctctgtcatttcttctattctcacaagaaaatgttgacattgccatcgttgaagctggccttggtggagctagagacgccacaaatgtcatacaaagtactgaattagcagcatctgtcataacaacagtagggtgcgagcatctggctgcattgggtggctccctgcaaagcatagcattagcaaagtctggaatcatcaaacagggacgaccagttgtgattggtggaccattttcagcggacattgagcaaattattcgtgacagagcattcttgacacaatctcccgtgatatctgcttgtgatcctggaatcaagagtattacgaaatgcatagattgggataatggaaagccgtatcaatgctgtgacatcagcatcaagatttcaaatgatatgccattgtccattgaattgtgtgacgtaaaccttcagctgctgggagatcatcagcgccagaatgctgttacagcttcttgcacagctctatgtctccgtaacctaggatgggatatttccgatgcttcaatccaagctggcttagaggaaacgcaacttcctgggagaagccagatccttacacaagaggaagccttgctgcttgggcttcatggagcaaccgtact

SEQ ID NO: 37856 - protein, 382 aa, Panicum virgatum
  misc_feature: Ceres CLONE 1991544
  misc_feature (89)..(336): Pfam Name: Mur_ligase_M Pfam Description: Mur ligase middle domain
  misc_feature (82)..(276): SWISSPROT Homolog: EC 6.3.2.17 Tetrahydrofolate synthase
  misc_feature (315)..(370): SWISSPROT Homolog: EC 6.3.2.13 UDP-N-acetylmuramoyl-L-alanyl-D-glutamate--2,6-diaminopimelate ligase
MLGRFPVAFRLPRGILRGSSGRLGSSAMAGGDEEGRLGDFFEYMERLRNYERSGVPRGAGTDSDDGFDLGRMRRLLRRLGDPHTHFPAVHIAGTKGKGSTAAFLSNIMREQGYNVGCYSSPHLLTIRERISVGNDGGPVPVRLLSDIFDQAKEAIDESIESENGALTHFEVFTALSFLLFSQENVDIAIVEAGLGGARDATNVIQSTELAASVITTVGCEHLAALGGSLQSIALAKSGIIKQGRPVVIGGPFSADIEQIIRDRAFLTQSPVISACDPGIKSITKCIDWDNGKPYQCCDISIKISNDMPLSIELCDVNLQLLGDHQRQNAVTASCTALCLRNLGWDISDASIQAGLEETQLPGRSQILTQEEALLLGLHGATV

SEQ ID NO: 37857 - DNA, 690 bp, Panicum virgatum
  misc_feature: Ceres CLONE 1991544-R
aggctccagagcacattacaaacctggccgcatcttcatcgagcttcgatggaaaacccacggtgatgatcgggtgccaggacgacacggtactgttctcctgcgatctgatcagggccgcctctcagctcatcctcgagagcagaggcagtgacgatccatctccaggcctcgtctgtgtgaccggctccctgcatttggttgcatctgtactgcagcatctggaggggcactagcgcatgctggttgcctggttgtgaaggaacgattggatatcatacactgggagctgttccagtacaatagtggcatgaacccatcgatgggtccacagttgtgcagattggttgagtgctgaaggcctgaagctgtacctgcgcacggctggtgcagatggatcggttcacggctgtgctgaagtagtgaagtaggagtggtggtgcgtgtgcctgctcctggccgagggttcgagatggaaaagatcttcaactatttccttttgttttctttctttttttttggttgagattccaagatggtcggttccgtgagcccagctatcatgcatgtcagcatgtggcatccttaaactttgagcctttgaggtttaaggagcgctgggaatccaacctgatcacagtgccaacatccttgtagggatgactcaacaaccagtaacctttgctctcc

SEQ ID NO: 37858 - DNA, 698 bp, Panicum virgatum
  misc_feature: Ceres CLONE 1991549
  misc_feature: Encodes the peptide sequence at SEQ ID NO. 37859
aagcatcggcccattcgccccccacacccgtcacactcctccacacctcccatccgccgcggcattccaccgagcacctcgcgcgcgcgcatggccgccatggccccgcaccacctctcccgccccgccgccgccgccgcggcatccggcgccgtgtcgggtgctctcagcaggcaccgcgccttcccatccacctcctgctcccctctccgcctcccgctcctccgcgccgccgccgccgccaggcccgcgcgcctctccgccgcggtttccaccgccgccccgaccatggaggccgaggcgatggacgccgtggccaagtgggggctcaccccgctctccgaggccgacccggaggtctacgacctcatcgagcgcgagaagcgccggcagcgcgcgggcatcgagctcatcgcctccgagaacttcacctcgctcgccgtcatggaggcgctcggctccccgctcaccaacaagtactcggagggcatgccgggggcgcgctactacggcggcaacgaggtcatcgacgaggtcgaggagctctgccgcgcccgcgcgctcgccgcgttccgcctcgacccggcgcgctggggcgtcaacgtgcagccctactcgggctcgccggccaacttcgccgcctacacggggctgctccagccacacgataggatcatggggctcgacctgccgtcggg

SEQ ID NO: 37859 - protein, 199 aa, Panicum virgatum
  misc_feature: Ceres CLONE 1991549
  misc_feature (80)..(199): Pfam Name: SHMT Pfam Description: Serine hydroxymethyltransferase
  misc_feature: SWISSPROT Homolog: EC 2.1.2.1 Glycine hydroxymethyltransferase
  misc_feature: Useful for making plants with modulated nitrogen use efficiency
MAPHHLSRPAAAAAASGAVSGALSRHRAFPSTSCSPLRLPLLRAAAAARPARLSAAVSTAAPTMEAEAMDAVAKWGLTPLSEADPEVYDLIEREKRRQRAGIELIASENFTSLAVMEALGSPLTNKYSEGMPGARYYGGNEVIDEVEELCRARALAAFRLDPARWGVNVQPYSGSPANFAAYTGLLQPHDRIMGLDLPS

SEQ ID NO: 37860 - DNA, 710 bp, Panicum virgatum
  misc_feature: Ceres CLONE 1991550
  misc_feature: Encodes the peptide sequence at SEQ ID NO. 37861
ctttttgatacctcaaaggcaggggaggggtagtctctccaattctttctccattgctccttcactctcctctgctccattgcttcctattctccactccacttgctctcattctcacctcctccctagtcttctccttcctcgctttgccaccgttttggtgaaccaccctctcaaccaatccaagcaaaaccagcaccaccattgacatcaccattgccacagcacttcctcttcataacctccatccatgtatgctgcatgccacggcatcagcacgcctcgccagtcacctccaccgccatggccggcaatggcgcgcctcgccttctctggctccctactgctgccacctcgttgccgctgctgcagctagcagggctggtgcaactgctgtgcctcgcctcggcgctgaaccaggacggcacactgctcctctccttcaagctctcgctcgccgccgacccgctcggctccctctctggctggggctacgccgacgccacgccctgcgcgtggaacggcgtcgtctgctcgccggactcgcgggtcgtcagcgtcgtcctccccaacgcgcagctcgtcggccccgtggccaaggagctcggcctcatcgagcacctccgacaccttgacctctccgggaacgcgctcaacggcaccatccccgcccgagctgctccgcgcgccggagctcgagtgctctccat

SEQ ID NO: 37861 - protein, 135 aa, Panicum virgatum
  misc_feature: Ceres CLONE 1991550
  misc_feature (37)..(78): Pfam Name: LRRNT_2 Pfam Description: Leucine rich repeat N-terminal domain
  misc_feature: SWISSPROT Homolog: EC 2.7.11.1 Non-specific serine/threonine protein kinase
MAGNGAPRLLWLPTAATSLPLLQLAGLVQLLCLASALNQDGTLLLSFKLSLAADPLGSLSGWGYADATPCAWNGVVCSPDSRVVSVVLPNAQLVGPVAKELGLIEHLRHLDLSGNALNGTIPARAAPRAGARVLS

SEQ ID NO: 37862 - DNA, 483 bp, Panicum virgatum
  misc_feature: Ceres CLONE 1991553
  misc_feature: Encodes the peptide sequence at SEQ ID NO. 37863
aacgacctgtctgttctagttctagcaccagcttcgttctcccgtcctcccacacacggccccgcctctcccgaggcttgttcggtgcctgcgcgcccgccaccgcaccgccggccaagccgcccgccgggaggacggccgcgtccttgccgctgccgctcgcggcagcgggggtgccggcggcgacgctcctcctgtggggcggcaccgaggcccgcgtcctcctcacgctcgacgacttcggcggagtcggccatcgcattgccaaccacacgcaggctttcatggacgcgtgggacgcggcgtgcgcctccagcgagcaggccgtcctcgccgtgccggtcggcaaggcctaccggatttggccggtgcagctcttctggccctgcaagaggaagctcaagctgctgatttccggcgcgatcgtcgcgccggcgaacccggactactgggctggacgggacccgatgaagtggctctacg

SEQ ID NO: 37863 - protein, 160 aa, Panicum virgatum
  misc_feature: Ceres CLONE 1991553
  misc_feature: SWISSPROT Homolog: EC 3.2.1.15 Polygalacturonase
  misc_feature: Useful for making plants with altered carbohydrate content
RPVCSSSSTSFVLPSSHTRPRLSRGLFGACAPATAPPAKPPAGRTAASLPLPLAAAGVPAATLLLWGGTEARVLLTLDDFGGVGHRIANHTQAFMDAWDAACASSEQAVLAVPVGKAYRIWPVQLFWPCKRKLKLLISGAIVAPANPDYWAGRDPMKWLY

SEQ ID NO: 37864 - DNA, 366 bp, Panicum virgatum
  misc_feature: Ceres CLONE 1991559
  misc_feature: Encodes the peptide sequence at SEQ ID NO. 37865
acacgagcgccagccagtcacctaccccgaagccgccgcgaccgatcgagccgagcgccccgccccacgccgcgccgcgccgcgccgcgccgcaccgaaaccctagctccttctcctcagccatggccaccgtctcgctcacgccgcaggtggtcttctccaccgagtcgggcggcgccctctcgtccgccaccatcctccgcttcccgccaaacttcgtgcgccagctcagcaccaaggcccgccgcaactgcagcaacatcggcgtcgcgcagatcgtcgccgcggcgtggtcagactgccccgccggccgcccccactccggcggcggcggaggccgcgacggcggcgtagtctctcgcgtga

SEQ ID NO: 37865 - protein, 81 aa, Panicum virgatum
  misc_feature: Ceres CLONE 1991559
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGGGGGRDGGVVSRV

SEQ ID NO: 37866 - DNA, 746 bp, Panicum virgatum
  misc_feature: Ceres CLONE 1991559-R
  misc_feature: Encodes the peptide sequence at SEQ ID NO. 37867
gcattgacagtacttttgcctcccctatcaatcagaaggcactaactttaggtgctgacctagttattcattctgcaacaaagtacattgctggacacaatgacgttattggaggatgtgtcagtggcagagatgagttagtttccaaagtccgcatttatcaccatgtagttggtggcgttctgaacccaaatgctgcctacctgatccttcggggcatgaagacactgcatctccgtgtgcaatgtcagaataacactgctctgcggatggcccaatttttagaggaacatccaaagattgcacgtgtctactatcctggtttgccgagtcaccctgaacatcacattgccaagacccaaatgactggctttggtggtgttgtcagttttgaggttgctggggattttgatggtacaaggagattcattgattctgttaagataccctatcatgccccttcttttggaggctgtgagagcattatcgaccagcctgccatcatgtcttactgggattcgaaggagcagagggacatatacgggatcaaggacaacctgatcaggttcagcattggagtggaggattttgaggatctgaagaacgatcttgttcaggcccttgagaaggtctaagcacttgattcgttcactttaatatgtatatcagatcatggttgtcctggatcttgagagatctgtgagaatatttgagccgatggctgccaataaattttctccttttgc

SEQ ID NO: 37867 - protein, 210 aa, Panicum virgatum
  misc_feature: Ceres CLONE 1991559-R
  misc_feature (1)..(208): Pfam Name: Cys_Met_Meta_PP Pfam Description: Cys/Met metabolism PLP-dependent enzyme
  misc_feature: SWISSPROT Homolog: EC 2.5.1.48 Cystathionine gamma-synthase
IDSTFASPINQKALTLGADLVIHSATKYIAGHNDVIGGCVSGRDELVSKVRIYHHVVGGVLNPNAAYLILRGMKTLHLRVQCQNNTALRMAQFLEEHPKIARVYYPGLPSHPEHHIAKTQMTGFGGVVSFEVAGDFDGTRRFIDSVKIPYHAPSFGGCESIIDQPAIMSYWDSKEQRDIYGIKDNLIRFSIGVEDFEDLKNDLVQALEKV

SEQ ID NO: 37868 - DNA, 1771 bp, Panicum virgatum
  misc_feature: Ceres CLONE 1991567
  misc_feature: Encodes the peptide sequence at SEQ ID NO. 37869
aaaatcgctcgccatttgggcgggcgggcgcctcccttgccccccgctcgtcgccgacccgccccgccccgctgcgccgcgccgcgcgagtggttggtttgtcggttgtcggggccgaggggagccgcaacgcaatgccggaggcggcggcgcgcccgccgggcccggatccggcggccgaggacgcggggcaggaggagttctacgagtcgctggatcggatcctctcctcctcctgctcctccacctccgcctccgacgacgacgccgaccaccgccgccgcaggcgctcccaccgccacctgcagcccccgccctcgcccgcgcccgcctccgcgtacgacgtctggatctccgagcccacctccgtcgaggagcgccgccgcctcctgctccagcgcctcggcctctcctccgatccgacgcagcctccctcgccgcgccgcgagcctcgttcgccatccactccgccgtctcccccggcctcgcctccgccccgcccggaggagcccagatccgggggcctcgggaagccgccgctggcgcggaaccccagctccagcggcggggagcaatgccggatccggaacctcgacgacggcaccgagttcgaggtcggggaggtgcacgaggaggtggtccgggaggtgggcaccggccgccagctcaccctcgaggagttcgagctctgcgtcggccgatccccgatcgtgcacgagctcatgaagcggaccacaaccgccgcgtccgcgtccgcctccgatcatgccgcacccgcatccaggccccggaggaagcctggaggagggtggctgcgcggcatcaggcagctggctggcagcgtcgcgtacggccgccgcagcaccgaagagggggacaaggacaaggagagggaagcgcggcgcctgagctccgccaccgacgacagccttgacggcaccggctctcgcaatgctggaagggtccgggtgcgccagtacgggaaggcgtgcaaggagctcaccgggctgttcatgacgcaggaattggctgcccactcgggctctgtgtggtgcatcaacttcagcctggatggacgataccttgcaactgctggagaggaccgtgtcatccatgtgtgggaggtgtcggagggagacagaaagggtgagttgcttggggaagcttcagcgacaaaggagaatggcggtggctgcagcccatttcttgcagttgttgggaatgattcaccagagatcgctgcattgtcattgacctgtgctgatggaggctatgtggagaagaagaggaggccgaggaagcagagcaatcgaaagtctgtaggttctgatcatctagtggtgccggagtgcgtctttggcttcagagacaagccagtttgctcgctcctggggcatgctgctgacgtccttgacctgtcatggtccaaatctcagtacttgatctcatcatccatggacaaaaccgttaaactttgggacattactaccagtacctgtttgaaaacattctcacatacagactacgtaacttgcatccagttcaatcctgtagatgataacttcttcattagtggatcactggatgagaaagttcgcatctggaatgtcagagatcgtaagattgaggattggaatgatcttcatgagatggttaccgctgcttgttattcccctgatggacaggttgctctggtgggctctcacaagggaagctgtcatatattcgatacatctgagaagaagcttcagtataaaagtcacatagattt

SEQ ID NO: 37869 - protein, 545 aa, Panicum virgatum
  misc_feature: Ceres CLONE 1991567
  misc_feature (412)..(449): Pfam Name: WD40 Pfam Description: WD domain, G-beta repeat
  misc_feature (292)..(330): Pfam Name: WD40 Pfam Description: WD domain, G-beta repeat
  misc_feature (453)..(491): Pfam Name: WD40 Pfam Description: WD domain, G-beta repeat
  misc_feature: SWISSPROT Homolog: EC 2.3.1.48 Histone acetyltransferase
MPEAAARPPGPDPAAEDAGQEEFYESLDRILSSSCSSTSASDDDADHRRRRRSHRHLQPPPSPAPASAYDVWISEPTSVEERRRLLLQRLGLSSDPTQPPSPRREPRSPSTPPSPPASPPPRPEEPRSGGLGKPPLARNPSSSGGEQCRIRNLDDGTEFEVGEVHEEVVREVGTGRQLTLEEFELCVGRSPIVHELMKRTTTAASASASDHAAPASRPRRKPGGGWLRGIRQLAGSVAYGRRSTEEGDKDKEREARRLSSATDDSLDGTGSRNAGRVRVRQYGKACKELTGLFMTQELAAHSGSVWCINFSLDGRYLATAGEDRVIHVWEVSEGDRKGELLGEASATKENGGGCSPFLAVVGNDSPEIAALSLTCADGGYVEKKRRPRKQSNRKSVGSDHLVVPECVFGFRDKPVCSLLGHAADVLDLSWSKSQYLISSSMDKTVKLWDITTSTCLKTFSHTDYVTCIQFNPVDDNFFISGSLDEKVRIWNVRDRKIEDWNDLHEMVTAACYSPDGQVALVGSHKGSCHIFDTSEKKLQYKSHID

SEQ ID NO: 37870 - DNA, 680 bp, Panicum virgatum
  misc_feature: Ceres CLONE 1991575-R
  misc_feature: Encodes the peptide sequence at SEQ ID NO. 37871
acatgagtcctaagattagtgactttggaatagctaaaatgtttgaacaaagtgatcatgaatttacgacacaaaacgttgtggaaggcacaatgggatacatggcaccagaatatattatggatggtaggttgacgaccatggttgacttgtacagttttggcaccatcctccttgagaccattagcggcatgtgcaaatctaaacctaagctcagagatttggctgcatgggcatggggcgcgcggcaagttggacatagaatgaaggagttgtttgatccttcattgtatgatgacgactatcagctgaaggagattgaaaaatgcttggagatagggctcctgtgcgctcagtatgataggggagaccggcccaccatggcggaggttcttgagatgctagacggcaagagaagcttatgggccccaaagaaaccagcatacctccgatgatatagatagtggtgtgcacttatattacttgtgatgggtgtgtacaataattgtgagcagagcagtacacgaaaactcccaaacaatacatgtacagtatattgggaacgaggaattaagatgaggtcatgaattctgcggtatgcatgtgtatatagtgcgcacatatattaatgtgctgtttggttggatcaacagtatcacaaatgtaaatgtaattagttc

SEQ ID NO: 37871 - protein, 150 aa, Panicum virgatum
  misc_feature: Ceres CLONE 1991575-R
  misc_feature: SWISSPROT Homolog: EC 2.7.11.1 Non-specific serine/threonine protein kinase
MSPKISDFGIAKMFEQSDHEFTTQNVVEGTMGYMAPEYIMDGRLTTMVDLYSFGTILLETISGMCKSKPKLRDLAAWAWGARQVGHRMKELFDPSLYDDDYQLKEIEKCLEIGLLCAQYDRGDRPTMAEVLEMLDGKRSLWAPKKPAYLR

SEQ ID NO: 37872 - DNA, 1352 bp, Panicum virgatum
  misc_feature: Ceres CLONE 1991575
ataacaacagctcggatcaggcttgcttccaccacgcagaagaccagcaatcggtcgcttggtaatacagggctacaaggaagagttagaggtcaggagaagaacggaagatcggaggtagcagatcgatatcacatattctacttgcatgtacggcaccgatggcagatgccatgggcagcctgaagcagattgctgatgcagcgctagcgatcaagaacgcagcagagacggttcgccagaacaaggaggagtgccgtgccatcgagaagctcgtgggcagagtcagcgccctggtgacaaagctcaaagagacagaaacgatgaatgcgccggagatggatggtgccctggaggatcttgcagagtccctcaacctctcgctcaagctcgtcaagagctgtcagaagaggagcatcatgtgtcttttctgctttgctagtgacttgtccaaccagctgcgtcaggcccgggatgacatatccgccaaaatgatgcttggcgtcctcgccaccaatatccaattcaccgtatttttcacaaggattcggaacattggttcaactcctacgcaaacatatacacacaggtgaacaatgaattaatttttcttagacggtataaagcatatatatatatatatatattaaaaaaacgtaacctcccgtgaatcatgaatatgttaaattaattagtttcctgctgatgctactgctacgtatactagcgtacagatgcaccactagataactgtgcatgctttccatgatacgtaccttgtaataattagttctaattaatgaatctcattggcaatgaaggaaatacagtgacacaaatttcaactaatgaattacatgtccattgcaaatctatgtaactaatgcacattccatgataccttgtaattcccatcatatgcaattcgcaatgcatgtgtagactttcctgttttccatttttgtagcatgtactactgtgtccactctctcacacacacatcaatatttgatgtgtactatgcagcagccatacttctgaaattttcaagatcaaatcataattatatattctatacctaggtgctatttaaatgggtaggccggtgcaagactatttttatttctttcgttttgcgccaatgtccatctacaaggtttccctgcagggtctagttgtaaacttctcttctttatgcattttcaaaatccacacatgaccttgctggttttgttaaaaagaacttggtattgtaagtattatagtaccatacaaactgataaaaagactgtttacggcacaatctctcttgcaaattgtagatacggttagatttaaaaaccaatatggtg

SEQ ID NO: 37873 - DNA, 705 bp, Panicum virgatum
  misc_feature: Ceres CLONE 1991578
  misc_feature: Encodes the peptide sequence at SEQ ID NO. 37874
cgatgcaactcctaaacctccgccgccgccgccggggccacccgctggccaattatcagcaagccggctgctgaaaccagagcaaacagaggggccaagtgtcgccatgccgagagcgcctttcatgtcagtgaagagggacaatgacggcatgccaattcggatgcaggatgatgctgctgttgatgaagcccggcccaagctgaagccgctgcactgggacaaggtccgggcgtgctccgaccgtgacatggtctgggaccggctcaagtccaactcattccagttggatgaggacatgatcgaggtgcttttcaccaacaatgcggcaaatgcacctcacagggacacaccgaagaaagctggagtgccacaatgtaggtctgaagagaaggtccttgatcccaagaaggcacagaacattgccatccttctgcgtgcactgaatgtgacgctggaggaggtctccgatgcactgctagatggcaatgctgaatgtctgggggctgatctgttggaaaccttaataaagatggctcctactaaagaggaagaactgaaacttcgaaactttactggggacttatcaaagctgggttcggcagagcggtttctcaaggtcgtgcttgatatacctttttccttcaaaagagttgacgctatgctctatcgagctaattttgagagcgaaataaatacctcaag

SEQ ID NO: 37874 - protein, 234 aa, Panicum virgatum
  misc_feature: Ceres CLONE 1991578
  misc_feature (59)..(234): Pfam Name: FH2 Pfam Description: Formin Homology 2 Domain
DATPKPPPPPPGPPAGQLSASRLLKPEQTEGPSVAMPRAPFMSVKRDNDGMPIRMQDDAAVDEARPKLKPLHWDKVRACSDRDMVWDRLKSNSFQLDEDMIEVLFTNNAANAPHRDTPKKAGVPQCRSEEKVLDPKKAQNIAILLRALNVTLEEVSDALLDGNAECLGADLLETLIKMAPTKEEELKLRNFTGDLSKLGSAERFLKVVLDIPFSFKRVDAMLYRANFESEINTS

SEQ ID NO: 37875 - DNA, 684 bp, Panicum virgatum
  misc_feature: Ceres CLONE 1991579
  misc_feature: Encodes the peptide sequence at SEQ ID NO. 37876
aaggcaggcagaccaacaccgtgacccggacccctcctcccctctctctctctctcctcgtcctcaagctctccctctcccctcccgcggcgtggccgaatgccgcgagccgggcggagctgaccccgcccgccggcgactccgctcggccgccgccgccgcagcagcgacgcggattcggctgccgagcgcggaatgcccgcggagggagggcactgaggcgcccagattcgggagcacgggagagcctcgcttggggcaccggggattcgcctcgccggggcggcggaggctctccggattccagcgtgtgggacctcaacgcgatggccggcggcggcggcgcctccgccgaagccaagtacaactcgtacaaggcgccgggcctgcgcggggccttccttgaggcggcgcacgtctcgtgcctcgaggaccgctacgcgctcgggccgcagcttgggtggggccagttcggcgtcatccgctcctgctccgacctggtcaccggcgaggcgctcgcctgcaagtccatcgccaaggaccgcctcgtgtcccccgacgacgtgaggggcgtcaagctcgagatcgaggtcatggcgcgcctctcgggccaccccaacgtcgttgacctcaaggcggtgtacgaggacgaggactccgtgcacctcgtcatggagctctgcg

SEQ ID NO: 37876 - protein, 119 aa, Panicum virgatum
  misc_feature: Ceres CLONE 1991579
  misc_feature: SWISSPROT Homolog: EC 2.7.11.1 Non-specific serine/threonine protein kinase
  misc_feature: The sequence is a functional homolog of SEQ ID NO 2 in US patent 7084323
MAGGGGASAEAKYNSYKAPGLRGAFLEAAHVSCLEDRYALGPQLGWGQFGVIRSCSDLVTGEALACKSIAKDRLVSPDDVRGVKLEIEVMARLSGHPNVVDLKAVYEDEDSVHLVMELC

SEQ ID NO: 37877 - DNA, 662 bp, Panicum virgatum
  misc_feature: Ceres CLONE 1991595
  misc_feature: Encodes the peptide sequence at SEQ ID NO. 37878
acgcagcttcacctcacctcccaaccgcccgcgtggccgacgctgacagcatcgccatcgtcggggtccagccacccagcgccacccgaaaaagccacggcgctggcctcccctcccctcccctcccctcttcccgccctgcagcgagctacctatccactcgcccaaatcgccgccgccgccggcgcccggtcgatagatgaaggtgctctgctccgcgtgcgaggcggccgaggcgcgcgtgctctgctgcgccgacgaggccgccctctgcgcgcgctgcgaccgcgacgtgcacgccgccaaccgcctcgccggcaagcaccaccgcctgccgctccagccgcccgccgccgcctccgcgcccggctgcgacatatgccaggagtcccatgcctacttcttctgcgtcgaggaccgcgcgctgctctgccggagctgcgacgtcgccgtgcacacggccaacgccttcgtctccggccaccgaaggttcctcctcaccggcgtccaggtcggcctgcagcccgacgcccaggaacccgcgccagatcccccgaacgccgccgccgccgccgcagcagcaccacctcccctgccaacaccgccgcccgccaagaaggcgcgcagcagcccggcgccgctctacagcgacgacgacatcg

SEQ ID NO: 37878 - protein, 154 aa, Panicum virgatum
  misc_feature: Ceres CLONE 1991595
  misc_feature (53)..(100): Pfam Name: zf-B_box Pfam Description: B-box zinc finger
  misc_feature (1)..(47): Pfam Name: zf-B_box Pfam Description: B-box zinc finger
  misc_feature: Useful for making plants with altered lignin content
  misc_feature: The sequence is a functional homolog of SEQ ID NO 1478 in the 10/666,642 US patent application
  misc_feature: The sequence is a functional homolog of SEQ ID NO 1890 in the 10/412,699 US patent application
  misc_feature: The sequence is a functional homolog of SEQ ID NO 2148 in the 10/374,780 US patent application
  misc_feature: The sequence is a functional homolog of SEQ ID NO 454 in the 11/435,388 US patent application
  misc_feature: The sequence is a functional homolog of SEQ ID NO 676 in the 10/225,066 US patent application
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
MKVLCSACEAAEARVLCCADEAALCARCDRDVHAANRLAGKHHRLPLQPPAAASAPGCDICQESHAYFFCVEDRALLCRSCDVAVHTANAFVSGHRRFLLTGVQVGLQPDAQEPAPDPPNAAAAAAAAPPPLPTPPPAKKARSSPAPLYSDDDI

SEQ ID NO: 37879 - DNA, 1598 bp, Panicum virgatum
  misc_feature: Ceres CLONE 1991598
  misc_feature: Encodes the peptide sequence at SEQ ID NO. 37880
acactagcccgtaaatctctagggtggacgatggtgcccgtgctgctgctgatcgccttggcgaccctcgccgccgcggtggttctccgccactaccttccgctgctccgtaaccccggcctccccaagggcagcttcggctggcctctcatcggcgagaccatcggcttcctccgctcgcacccctccaacagcaccggcggcttcctgcgcgaccgcatcggcaggtatgggacggtgttcaagtcgcacctgttcgggtcgcccacggtggtgtcgtgcgacgaggagctcaaccacttcgtgctgcacaacgaggagcgcctgttccagtgcaactaccctggcccgatccgcaccatcctcggcgactcctccacgctggtggtcaccggcgagcgccaccgcctgctccgcggcatgttcctcaccctcgtcgcctccaccggcctcaagccttcctacctcgccagcctcgacgaatcggcgcgctccgtcatcgcgtcctggcgcggccaacacgccgtcaccttctgcgaggaggcaagaaagtttccctacaaggtgatcatggagctggtgctcggcgtgtcgccagacgagccggtggctcgccgcatcctcaaagagtaccagatcttcatgaaggggatcatctcgttccctctcaccatccccgggacaccgtttgccagggctatgaaggcaaggaagaggatttctgacaccatggagagcttcatcgaggacaggaagaagcgtgggtcgtccaaggagggcgtgtttatagacgtgctcctcgccaacaaggacctgtctcacgacgaccaggtcggcttcctgctagacgccttgctggcaggccatgagaccacctccgttctgctgtctgtcctcatctacttccttgcaaaatcccccaacgtcgtcgagcaactaaagagggagcatgatagcataaggtccagcaaagggaaggaggagccattgacgcctgacgactacagaaagatggactatacccaacgtgtgatcagcgaggcactgagatgtggcaacatcgtcaagctggtgcacaggaaggccctcaaggacatcagctacaaagggtatgtgatcccggctggttggaaggtcttgcctattctgggtgcggtccacacggacccgtcacaccacgtggatccagagcagtttaacccttgcagatgggagggaccgaaccaggccaatgccaagagcttcgcgccgttcggaggaggcgcgcggctctgccctggatcagagattgtcaaagtagaggctgctttattcctgcaccaccttgtgctcaaatataggtggaagatggatggagaggacgttcccatgctgcatcaatacgtggaattcaagaggggcctgcccatactgctcgagccgatctgattcaagaccttggcgcgctagctctttctcaagactctcaagagaaaggaaataaagataggacatgccaggcctgaatcgaccttgatcacgaaaaagacaaataagagtcgttgtacattatggaatttccggttatatttttcaatccatgtacacgagtgcctatg

SEQ ID NO: 37880 - protein, 465 aa, Panicum virgatum
  misc_feature: Ceres CLONE 1991598
  misc_feature (32)..(464): Pfam Name: p450 Pfam Description: Cytochrome P450
  misc_feature: SWISSPROT Homolog: EC 1.14.13.93 (+)-abscisic acid 8'-hydroxylase
  misc_feature: Useful for making plants with modulated oxidative stress sensitivity
MVPVLLLIALATLAAAVVLRHYLPLLRNPGLPKGSFGWPLIGETIGFLRSHPSNSTGGFLRDRIGRYGTVFKSHLFGSPTVVSCDEELNHFVLHNEERLFQCNYPGPIRTILGDSSTLVVTGERHRLLRGMFLTLVASTGLKPSYLASLDESARSVIASWRGQHAVTFCEEARKFPYKVIMELVLGVSPDEPVARRILKEYQIFMKGIISFPLTIPGTPFARAMKARKRISDTMESFIEDRKKRGSSKEGVFIDVLLANKDLSHDDQVGFLLDALLAGHETTSVLLSVLIYFLAKSPNVVEQLKREHDSIRSSKGKEEPLTPDDYRKMDYTQRVISEALRCGNIVKLVHRKALKDISYKGYVIPAGWKVLPILGAVHTDPSHHVDPEQFNPCRWEGPNQANAKSFAPFGGGARLCPGSEIVKVEAALFLHHLVLKYRWKMDGEDVPMLHQYVEFKRGLPILLEPI

SEQ ID NO: 37881 - DNA, 363 bp, Panicum virgatum
  misc_feature: Ceres CLONE 1991601
  misc_feature: Encodes the peptide sequence at SEQ ID NO. 37882
acacgagcgccagccagtcacctaccccgaagccgccgcgaccgatcgagccgagcgccccgccccacgccgcgccgcgccgcgccgcgccgcaccgaaaccctagctccttctcctcagccatggccaccgtctcgctcacgccgcaggtggtcttctccaccgagtcgggcggcgccctctcgtccgccaccatcctccgcttcccgccaaacttcgtgcgccagctcagcaccaaggcccgccgcaactgcagcaacatcggcgtcgcgcagatcgtcgccgcggcgtggtcagactgccccgccggccgcccccactccggcggcggcggcggccggggcggcggcgaggacgcaggag

SEQ ID NO: 37882 - protein, 80 aa, Panicum virgatum
  misc_feature: Ceres CLONE 1991601
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGGGGGRGGGEDAG

SEQ ID NO: 37883 - DNA, 722 bp, Panicum virgatum
  misc_feature: Ceres CLONE 1991607
  misc_feature: Encodes the peptide sequence at SEQ ID NO. 37884
gaccgtcgtcttggtgcccgtgtggggcgccggccacctcatgtccctgttcgaggccggcaagcggctgctcgcccgcgccggcggcaagctctcgctcaccgtgctcgtcatgcgcccgcccacggagcagctcgcggccgaggtcgagggccacttccgccgggaggaggcatccgggcttgacgtccgcttcgtccaccttccagccgtggaccccccgacggacttcgccggcatcgaggagttcgtctcccggttcgtgcagatgcacgcgccgcacgtccgggcggcgatttccagctcggcgtccccggtggccgcggtcgtcctcgacttcttctgcacaacactcatcgacgtgtgccgcgacgtcgccgtgccggcctacgtctacttcacctccaacgccgcgatgctggcgctcatgctgcgcctgccagcgctccacgaggaggtgacggtcgagttcgaggagatggagggcgccgtggatgtgcccgggctgccgccggtgccgccgtcctcgctcccgaagccggtgatggacaagaagaacccgaactacacgtggttcgtgtaccacggcaggcgcttcgcggaggccgacggcatcatcgtcaacacggccgccgagctcgagcggagcgcgcttgctgccatcgccgacggacggtgcacgcgcggcgtccgtgccccggcggtctatccgattggccccg

SEQ ID NO: 37884 - protein, 240 aa, Panicum virgatum
  misc_feature: Ceres CLONE 1991607
  misc_feature (11)..(135): SWISSPROT Homolog: EC 2.4.1.115 Anthocyanidin 3-O-glucosyltransferase
  misc_feature (183)..(240): SWISSPROT Homolog: EC 2.4.1.218 Hydroquinone glucosyltransferase
  misc_feature: Useful for making plants with altered carbohydrate content
TVVLVPVWGAGHLMSLFEAGKRLLARAGGKLSLTVLVMRPPTEQLAAEVEGHFRREEASGLDVRFVHLPAVDPPTDFAGIEEFVSRFVQMHAPHVRAAISSSASPVAAVVLDFFCTTLIDVCRDVAVPAYVYFTSNAAMLALMLRLPALHEEVTVEFEEMEGAVDVPGLPPVPPSSLPKPVMDKKNPNYTWFVYHGRRFAEADGIIVNTAAELERSALAAIADGRCTRGVRAPAVYPIGP

SEQ ID NO: 37885 - DNA, 709 bp, Panicum virgatum
  misc_feature: Ceres CLONE 1991610
  misc_feature: Encodes the peptide sequence at SEQ ID NO. 37886
ccgatcgtgatcccgccggccaaggccgtcgcgtagtagtagtatgttgttgatggcggcgcaatcgtgtcagtcagaacaaggttacttatcagtggcagtgagtggtaggttatcataagattgagtgtgcccgtcgacgacgcgggccacggcacgcacacggcgagcacggcggcgggcaacttcgtccagaacgccgccgtgcgcgggaacgcgcacggcacggcgtccgggatggcgccgcacgcgcacctcgccatatacaaggtgtgcgcccggagccgctgctccatcatggacatcatcgccggtctggacgccgccgtcaaggacggcgtggacgtgctctccttctccatcagcgccaccgatggcgcgcagttcaactacgacctcatcgccgtcgccacgttcaaggccatggagcacggcatcttcgtcagcgccgccgccggcaatgacggccccgtcgccggcaccatccggaacggcgtgccgtggatgctgacggtggcggccggcaccatggaccgcgcgatccgcaccagcgtgaggctcggcaacgggcaggagttggacggcgagtccctgttccagccccggaacaacaccgccgggcgccagctcccgctcgtgttcccgggccgcaacggcgacccggacgcccgcgactgcagcacgctggtcgaggccgaggtgcgcgggc

SEQ ID NO: 37886 - protein, 157 aa, Panicum virgatum
  misc_feature: Ceres CLONE 1991610
  misc_feature: SWISSPROT Homolog: EC 3.4.21.25 Cucumisin
MAPHAHLAIYKVCARSRCSIMDIIAGLDAAVKDGVDVLSFSISATDGAQFNYDLIAVATFKAMEHGIFVSAAAGNDGPVAGTIRNGVPWMLTVAAGTMDRAIRTSVRLGNGQELDGESLFQPRNNTAGRQLPLVFPGRNGDPDARDCSTLVEAEVRG

SEQ ID NO: 37887 - DNA, 730 bp, Panicum virgatum
  misc_feature: Ceres CLONE 1991628
  misc_feature: Encodes the peptide sequence at SEQ ID NO. 37888
agggtcagccaagggcagccagccatgaacgcggcggcctccttcgtcgccgtggcgctggccctggcggccctcgtccccgtctcgctgctgctcctgaaccggctcctctacggcaagctgccgccgggcccccgcccccgccccgtggtgggcaacctcttcgacgtgcagccggtgcgctgccgctgctaccaggagtgggcgcggcggtacgggcccatcatgacggtgtggctggggccggagccgacggtggtggtgtcgacggcggagctcgccagggaggtgctcaagacctacgaccagagcctcgccgaccgcaagcgcgaccgctcctcggagcgcttcagccgcggcggcaaggacctgatctgggccgactacggcccgcactacatcaaggtgcgcaagctctgcaacctcgagctcttcacgccgcgccgcctcgaggcgctcaggcccatccgcgaggacgaggtcaccgccatggtcgagtccgtgcacagggccgtcaccgcgccgggcaatgaagggaagccgttggtggtgaagaaccacctctcgatggtggccttcaacaacatcacgcggctggccttcgggaagcggttcgtgaacgcggccggcgagctggacgagcaagggcgcgagttcaagggcatcatcaacgacgggatcaagatcggcgggtccctctccatcgccaagtacatcccgtggctgagtt

SEQ ID NO: 37888 - protein, 235 aa, Panicum virgatum
  misc_feature: Ceres CLONE 1991628
  misc_feature: SWISSPROT Homolog: EC 1.14.13.21 Flavonoid 3'-monooxygenase
  misc_feature: Useful for making plants with altered carbohydrate content
  misc_feature: Useful for making plants with altered lignin content
  misc_feature: The sequence is a functional homolog of SEQ ID NO 4 in US patent 7071376
  misc_feature: The sequence is a functional homolog of SEQ ID NO 6 in US patent 7071376
  misc_feature: Useful for making plants with altered cell wall content and/or composition
MNAAASFVAVALALAALVPVSLLLLNRLLYGKLPPGPRPRPVVGNLFDVQPVRCRCYQEWARRYGPIMTVWLGPEPTVVVSTAELAREVLKTYDQSLADRKRDRSSERFSRGGKDLIWADYGPHYIKVRKLCNLELFTPRRLEALRPIREDEVTAMVESVHRAVTAPGNEGKPLVVKNHLSMVAFNNITRLAFGKRFVNAAGELDEQGREFKGIINDGIKIGGSLSIAKYIPWLS

SEQ ID NO: 37889 - DNA, 1438 bp, Panicum virgatum
  misc_feature: Ceres CLONE 1991632
  misc_feature: Encodes the peptide sequence at SEQ ID NO. 37890
tgatctctctctctctctctctctctctctctctctgctttgcctaaccatccgtccatccgcgaccataccagagggcagaggctccccgcctcgagattctttacatggtgcagccggcaagaaccttccctccccggcgcaaaggggctcgctttccttgaggaggggcactgtccctttcccctgcatttaccctctgttttcaagctcttgttgttcttgcttctttggaggaatggcggcgggcctgcttctcaaggtggtcgggttctgcgtctgggccctcttctggctcggcggcaccgccaccgtgagcaccacggccctcgcgggcggcgacgcggtggtcgtggacgcgcggtccgccgtcgcggcgacggacgacgacttcatctgcaccacattggactggtggccgccggacaagtgcgactacggcacctgcagctggggcctcgcctccctcctcaacctgaatctctctaacaaaatcctgctgaatgccgtcaaagcattctcccctctgaagctccggctgggcggctccttgcaagatatgttgatatatgacactggtgactctgggcaaccatgtactccattcgtgaagaacacgtctgcgatgtttggtttctcgcaaggttgcctaccgttgcatagatgggatgagctaaatgctttcttccaaaaatctggggcaaaaattatttttgggttgaatgctctgaatggccgggtcccaatgcctgatggttctttaggggggccatggaattacacgaacgcagcttcttttattcgctacactgtcaacaaaggctacgatatccatggatgggagctcggaaatgaactcagtggtagtggagttggagcccggattgatgcagaccaatatgcagcagacgtgatcaatttggaacacatcattgacagcacctaccaaggcaacccatcaaagcctctagtacttgcaccaggaggtttctttgacgcagcctggttcaatgaactcgtcagcaaaacaaagccaggtcaaatggatgtgatcactcatcatatctataatttaggccctggtgttgatgaccatcttatcgagaagattctcaatccatcttaccttgatggcgaggcaagcacgttcagcaatcttcaggggatactgaagtctgcagggacgtccacagttgcctgggttggcgaagctggaggggcttacaacagtggtcaccaccttgtaactgatgcatttgtgttcagcttctggtacctggatcagcttgggatgtcatcaaagtatgacacaaaaagttactgtagacagaccttggttggtgggaactatggcctgctcaacacaactacatttgaaccaaatcctgactattacagtgctttattatggcatcgcctcatgggaaccacggtgctc

SEQ ID NO: 37890 - protein, 399 aa, Panicum virgatum
  misc_feature: Ceres CLONE 1991632
  misc_feature (31)..(351): Pfam Name: Glyco_hydro_79n Pfam Description: Glycosyl hydrolase family 79, N-terminal domain
  misc_feature: Useful for making plants with altered carbohydrate content
MAAGLLLKVVGFCVWALFWLGGTATVSTTALAGGDAVVVDARSAVAATDDDFICTTLDWWPPDKCDYGTCSWGLASLLNLNLSNKILLNAVKAFSPLKLRLGGSLQDMLIYDTGDSGQPCTPFVKNTSAMFGFSQGCLPLHRWDELNAFFQKSGAKIIFGLNALNGRVPMPDGSLGGPWNYTNAASFIRYTVNKGYDIHGWELGNELSGSGVGARIDADQYAADVINLEHIIDSTYQGNPSKPLVLAPGGFFDAAWFNELVSKTKPGQMDVITHHIYNLGPGVDDHLIEKILNPSYLDGEASTFSNLQGILKSAGTSTVAWVGEAGGAYNSGHHLVTDAFVFSFWYLDQLGMSSKYDTKSYCRQTLVGGNYGLLNTTTFEPNPDYYSALLWHRLMGTTV

SEQ ID NO: 37891 - DNA, 613 bp, Panicum virgatum
  misc_feature: Ceres CLONE 1991632-R
cttatgcacattgcgcgaaaaaatcgcaagggattactctgctcctgatcaatctcagtggcaacaatacaaaccgcatttacgtgacgagcgaaggcgcccaaacccagagtgcaaggaaggagggcagaaggtttagtcacattcctggtcttggtgaagcagccgagcttacaagagaagagtaccatctcactcctaaagacgggaacttgcagagccaacaagtgttgctgaatggtaatgtgttggcaactgacgccaatggagacatcccaaagctggagccaatgcaggtggagggaacaaagcccataaccgtgggtccttactccattgtgtttgctcacatccccagcttctatgctcctgcctgtaggtagatatttatatgattttttcaccttctcggtgtgaatgatgctattgtcatagattagatgatgtctgggtgatcggcgaagcttgttcacctggacacaaagtaagctgtaaggctgaaagatttgtgatttgtcattcatttaagaaagaattgtccagataatggttgagcaaaaggaaaggaaaatgataaataaattaaaagaaaaaaagatttgcagttttggtc

SEQ ID NO: 37892 - DNA, 1293 bp, Panicum virgatum
  misc_feature: Ceres CLONE 1991635
  misc_feature: Encodes the peptide sequence at SEQ ID NO. 37893
aacaaacgctaaaaaagtaacagtttctgtactttattgtcgatccgctctttgttcataccgaccatgtcgcagcctgaagtctccgacgtgacgctcgaggcggcgcgcaagcagaagatccacaacctgaagctgaagacggcgtgcctggagaacgaggagtacatccaggacctgcacgtgtcggactggagcgagacgcagaagcagaagctgcaggcggcgcacgagaaggcggcggagctgcttgcgtccgtggagagcgggacgaagtggagcctgacgtcggcgtacgacatccagaagctgatgcgcgtgtgcgggctcgagatgtctgtgcgcgagctgtacaagccggaggacaagccacagttcgtggaggttgtcgggctgaagaagacgctgaacgagctgaagcagcaccgcaacaagacgcgcatcgtgtccttcacggggacgatcgacaacggtcttgcgaagctggagaaggtcgaggacgagctgcggcggtcgcagctcgacgcgacggagcttgcgcaggtgcccgtggcgatcctgaagaacctggaggagtgcatgaacgtgacggtgatccagtctgcgctgatgggcaacgaggagcagatcaagtcgcagctcgcgaacatcgagaaggcgaaggagatccgcaacgtggcggtggctgacggcgagatggctgttgccgaggagcagttctacatcaaggcgcagctgctggagcggcttgttgagcttgtgcaggacaagttccgcatcatcgggctgacggacgacgagaacaagatgttcgcgaagatccacgaggtgcagaagaaggcattccaggagacgagctcgatgaaggacgcgaagcggcggctgaagcagcgctgcgaggaggacctgaagcacctgcacgacgcgatccagaaggcggaccttgaggacgcggaggcgatgaagcggttcatggcgcagaaggacaagagcgagaagttcatgcgcgacaaccttgagaagcaggacgacagctggcgcaagatccaggagctggagcgcacgctgcagaagctgggcacggagcgcttcgaggaggtgaagcggcgcatcgaggagaacgaccgcgaggagaagcgcaaggtggagtaccagcagttcctggacgttgtcgggcagcacaagaagctgcttgagctgacggtgtacaactgcgacctggcgatccgctgcatcggaatcatcgaggagctggtggcggagggctgcagcgcgatcaaggcgcggtacgac

SEQ ID NO: 37893 - protein, 408 aa, Panicum virgatum
  misc_feature: Ceres CLONE 1991635
  misc_feature: SWISSPROT Homolog: EC 2.7.11.1 Non-specific serine/threonine protein kinase
MSQPEVSDVTLEAARKQKIHNLKLKTACLENEEYIQDLHVSDWSETQKQKLQAAHEKAAELLASVESGTKWSLTSAYDIQKLMRVCGLEMSVRELYKPEDKPQFVEVVGLKKTLNELKQHRNKTRIVSFTGTIDNGLAKLEKVEDELRRSQLDATELAQVPVAILKNLEECMNVTVIQSALMGNEEQIKSQLANIEKAKEIRNVAVADGEMAVAEEQFYIKAQLLERLVELVQDKFRIIGLTDDENKMFAKIHEVQKKAFQETSSMKDAKRRLKQRCEEDLKHLHDAIQKADLEDAEAMKRFMAQKDKSEKFMRDNLEKQDDSWRKIQELERTLQKLGTERFEEVKRRIEENDREEKRKVEYQQFLDVVGQHKKLLELTVYNCDLAIRCIGIIEELVAEGCSAIKARY

SEQ ID NO: 37894 - DNA, 548 bp, Panicum virgatum
  misc_feature: Ceres CLONE 1991635-R
gggtcagcttgtgtacaagaaggagaagcgcctggaggacatcgaccggcagatccgcacgacgcacatccagctggagttcgccatcgagacgttcgacccgaacgcgaagaagcacagcgacacgaagaaggagctgtacaagctgcgcgcgcaggtggaggaggagcttgagatgctgaaggacaagatggcgcaggcgctggaggcgttcgggccgacggaggacgcgctgatgcaggcgggcatcgacttcgtgcacccggcggaggaggtggaggacaacaacctgacgcgtcgcagcaagatggtggagtaccgcgcgcaccttgcgaagcaggaggaggtgaagatcgcggcggagcgcgaggagctgaagcgcgtgaaggcgatccagagccagcagtatcgcggccagccggtgcagcagatcgagtaaagtttgcagccggaaccgttacgcggcgaagcagccgttgtgtgatgtacgaagcccatgttaactacgaagaaacatacggtgccatgcaccgattccaacctttccc

SEQ ID NO: 37895 - DNA, 721 bp, Panicum virgatum
  misc_feature: Ceres CLONE 1991637
  misc_feature: Encodes the peptide sequence at SEQ ID NO. 37896
aggccctcgccttcctccgtcttcctcctctcgctctcatccactctcctcccccctcgccactgcggtgcggagcttcggcggctcggctcgagcagaagaaaatgcaacgggcagtgcaagccatcaggttgcatggcagtgtgcttaaatatgctgttcaacaacacatcagcgctcccaaaccagcaatgcttcctgctgccttttctcgcttcatgtcagcttcatctgctcgcctagaggacagtggatttgaaactgccactgtagctgatatcttgaagtctaaagggaagagtgctgatggatcttggctctggtgcaccacagaggacagtgtctatgatgctgtcaaatcgatgacgcaacacaatgtgggggctttggtggtggtcaaaccgggacaggaaaaatcaattgctggcattgtcacggagagagattatctccggaaaatcatagtgcaaggacgatcttccaagtcaactaaggttggagacatcatgactgaagagaacaaactgatcaccgtgaagcctggcaccaaggtcctgcaagcaatgcagctgatgacagagaaccacatcagacacatcccggtggtcgaaggcacggggatgctggggatggtctccatcggcgacgtcgtccgtgcggtggtcagcgagcacaaggaggagctgaacaggctcaacgcctacatccaggggaggctact

SEQ ID NO: 37896 - protein, 205 aa, Panicum virgatum
  misc_feature: Ceres CLONE 1991637
  misc_feature (65)..(187): Pfam Name: CBS Pfam Description: CBS domain pair
  misc_feature: SWISSPROT Homolog: EC 1.1.1.205 IMP dehydrogenase
MQRAVQAIRLHGSVLKYAVQQHISAPKPAMLPAAFSRFMSASSARLEDSGFETATVADILKSKGKSADGSWLWCTTEDSVYDAVKSMTQHNVGALVVVKPGQEKSIAGIVTERDYLRKIIVQGRSSKSTKVGDIMTEENKLITVKPGTKVLQAMQLMTENHIRHIPVVEGTGMLGMVSIGDVVRAVVSEHKEELNRLNAYIQGRL

SEQ ID NO: 37897 - DNA, 742 bp, Panicum virgatum
  misc_feature: Ceres CLONE 1991644
  misc_feature: Encodes the peptide sequence at SEQ ID NO. 37898
  misc_feature (620)..(620): n is a, c, t, g, unknown, or other
gggcaacaccaatacaagtccacatgtcaaacatgatatcgagtggcatgacatcaacaccctctgtcatctcctctatatctggacaacctattagtactcaacaaatggtacagagcacagctcttggttcctttggctcaagcgcttctactgtatcaggcaattcaaatattgctgtatcggcctctttgcctagcatccaaagcagcatgagcatgggccaatcagtgcaacctgtggcacaaggaggcttgatggctggttcacaattaggacaaggtggaattgctgcaaaccaaaatgtgagtggccttgggcctacagctatctcttcagcgccagcaatgatgccaacacctgggatggcccagtcgacaggagtcaattccctaggtgtcacaaacaattctgccatgaatatgcctattgggcagcatcccaatgcccaacaaccgccaccaaagtatgttaaaatttgggaggggacattatccggtcaaaggcagggacagcctgtatttatctgtaaactcgaaggttataggagcggaacagcatctgaaacacttgcagcggattggccagagactatgcagattgttcgtcttatagctcangagcatatgaacaacaaacaatatattggcaaggcagactttctagtattccggactctaaatcagcatgggtttcttggacaactacaagagaagaagctgtgtgctgtgatacagttacc

SEQ ID NO: 37898 - protein, 246 aa, Panicum virgatum
  misc_feature: Ceres CLONE 1991644
  misc_feature: Useful for making plants with modulated flowering time
  misc_feature (206)..(206): Xaa is any aa, unknown, or other
ATPIQVHMSNMISSGMTSTPSVISSISGQPISTQQMVQSTALGSFGSSASTVSGNSNIAVSASLPSIQSSMSMGQSVQPVAQGGLMAGSQLGQGGIAANQNVSGLGPTAISSAPAMMPTPGMAQSTGVNSLGVTNNSAMNMPIGQHPNAQQPPPKYVKIWEGTLSGQRQGQPVFICKLEGYRSGTASETLAADWPETMQIVRLIAXEHMNNKQYIGKADFLVFRTLNQHGFLGQLQEKKLCAVIQL

SEQ ID NO: 37899 - DNA, 755 bp, Panicum virgatum
  misc_feature: Ceres CLONE 1991646
  misc_feature: Encodes the peptide sequence at SEQ ID NO. 37900
tcctctcctccgcctccgcccttcccttcgtcgcctcgcctccacaaaccaccaccccacccccaccaccgtcgaccgaccgaccgccaagatgagggagatcctgcacatccagggcggccagtgcggcaaccagatcggcgccaagttctgggaggtgacctgcggggagcacggcgtcgacgccacgggccgctactcggggtcctccgcgcagcagctcgagcggatcaacgtctactacaacgaggccgggggcggccgctacgtgccccgcgccgtgctcatggacctcgagcccggcaccatggaatccatccgcgccggccccttcggcggcatcttccgccccgacaacttcgtctacggccagtccggcgccggcaacaactgggccaagggccactacaccgagggcgccgagctcatcgactccgtcctcgacgtcgtgcgcaaggaggccgagaactgcgactgcctccaagggttccaagtatgccactccctgggcggaggcacgggttccggcatgggcaccctgctcatctccaagatccgcgaggagtaccccgatcgcatgatgctcaccttctccgtgttcccgtcgcccaaggtgtccgacactgtggtggagccctacaacgcgacgctgtccgtgcaccagctcgtggagaacgcggacgagtgcatggtcctcgacaacgaggcgctctacgacatctgcttccgcaccctcaagctcaccaccccttcat

SEQ ID NO: 37900 - protein, 221 aa, Panicum virgatum
  misc_feature: Ceres CLONE 1991646
  misc_feature (45)..(221): Pfam Name: Tubulin Pfam Description: Tubulin/FtsZ family, GTPase domain
  misc_feature: Useful for making plants with modulated flowering time
MREILHIQGGQCGNQIGAKFWEVTCGEHGVDATGRYSGSSAQQLERINVYYNEAGGGRYVPRAVLMDLEPGTMESIRAGPFGGIFRPDNFVYGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPS

SEQ ID NO: 37901 - DNA, 628 bp, Panicum virgatum
  misc_feature: Ceres CLONE 1991662
  misc_feature: Encodes the peptide sequence at SEQ ID NO. 37902
attttcgtaccagccccgagcgcccccccgagccttcccgctggcctcgcgtccccgatggcggcgacggcggcggtggcgatccaccagttcgccgagtgcatcacctgccacgcctggagccccgaccagtccatgattgccttttgtccaaacaacaatgaagtgcatatttataagtttttcacagacaagtgggagaaacttcatgttctgtcaaagcatgatcaaatagtttcgggaatagattggagtagatcatccaacaaaattgtaacagtttcacatgatagaaattcatatgtttggacacaagaaggatctgattggatacctacccttgttattctaaagttaaaccgtgcagctctgtgtgttcaatggagcccgaaagaaaacaagttcgcggtgggaagtggtgccaaatctgtgtgtgtttgctactatgaacaagaaaataactggtggattagcaaggttatcaggaaaaggcacgaatcttctgtcactagtctcgcatggcatccaaacaatatataccttgcaacaacgtctactgatggtaaatgcagagtattctctacttttatcaagggtgtggatacaaggggatcacaatcaagcactt

SEQ ID NO: 37902 - protein, 190 aa, Panicum virgatum
  misc_feature: Ceres CLONE 1991662
  misc_feature (137)..(175): Pfam Name: WD40 Pfam Description: WD domain, G-beta repeat
  misc_feature (47)..(85): Pfam Name: WD40 Pfam Description: WD domain, G-beta repeat
MAATAAVAIHQFAECITCHAWSPDQSMIAFCPNNNEVHIYKFFTDKWEKLHVLSKHDQIVSGIDWSRSSNKIVTVSHDRNSYVWTQEGSDWIPTLVILKLNRAALCVQWSPKENKFAVGSGAKSVCVCYYEQENNWWISKVIRKRHESSVTSLAWHPNNIYLATTSTDGKCRVFSTFIKGVDTRGSQSST

SEQ ID NO: 37903 - DNA, 1763 bp, Panicum virgatum
  misc_feature: Ceres CLONE 1991675
  misc_feature: Encodes the peptide sequence at SEQ ID NO. 37904
gagtctgtcgtttcagtctgaccagctcccaagacatagatacgtagcacaacaaccacagcccgataggcgcagccatggcgaaggcgagcggcgtggaggaggcgctcctcgccgcgggccggcccgacggcggcctgagcgcgcgcgaggaggtggcgaagcagctgcgcctggcggggcccatggtcgccggcgcgctgctgcagaacgtcatccagatgatctccgtcatgtacgtcggccacctcggcgagctgcccctcgccggcgcctccatggccaactccttcgccaccgtcaccggcctcagcctgctgcttggaatgtccagcgccctggacaccctgtgcggccaagcgttcggcgcccggcagcaccgcctcctgggcatctacatgcagcgcgccatgtttctcctcaccgtcgttagcgtcccgctcgccgccgtctggttctacaccggcgagatcctcctcctgttcggccaggcccccgacatcgccgcggaggccggcgcctacgcccggtggatgatcccggcgctcttcgcctacggcctgctgcagtgcctcgtccggttcctgcagacgcagaacatcgtggtgcccgtgatggcggccgccggcgccgccgcggcgtgccacctggtcgtgtgctgggcgctggtcttcggcctcggcatgggcagccggggcgcggcgctgagcaacgccgtctcctactggatcaacgtggccgcgctcgccgcgtacgtcggggtgtcgagcgcgtgcagggagacgtggaccggcttctccgcggaggccttccgcgacgcgctcggcttcttcaggctcgccatcccatctgctctcatggtctgcttggagatgtggtcgtttgagctcatcgtgctcctgtcaggccttcttcccaaccccgagctggagacgtccgtgctgtcgatcagcctcaacactgctgccttcgtgtggatgatccccttcgggcttggctccgccattagcactcgcgtgtccaacgagctgggcgcggggcggccccaggcggcgcgcctggcggtgcgcgtggtggtgttcctggccgtctcggaggggctcgccatggggctcatcctggtctgcgtccgctacgtctggggccacgcctacagcaacgtcccggaggtggtggcgtacgtggccaagatgatgctcgtcatcgcggtgtccaacttcttcgacgggatccagtgtgtcctttcaggtgtggcgagaggctgtggatggcagaagattggtgcttgcattaaccttggcgcctactacgtcgccggcattccttgtgcctacctcatagctttcgtcttgcgcgttggcgggatgggcctgtggttgggcatcatctgtggcctcttggtgcaagtcctgctgctaatggtcgtcacgctatgcaccaactgggacaatgaggcaacgaaggcgaaggacagagtgtacagttcttctcctgcagatttcgaatcatgaaactttgatggtagtcaaggaaacaagttcagaaaatataccacttgagatagtcaaacagaattggggattacacgaagcatgcctttcagctcgttcagtagaaaccaacactctatgctactgattagataggacatgattgcctattagtccatgtacatttggattcatcatatatactcctcacccaccactacaaaacgctattcccactgggacatatggaatcggtcgggatagttgggatcg

SEQ ID NO: 37904 - protein, 477 aa, Panicum virgatum
  misc_feature: Ceres CLONE 1991675
  misc_feature (36)..(196): Pfam Name: MatE Pfam Description: MatE
  misc_feature (257)..(420): Pfam Name: MatE Pfam Description: MatE
MAKASGVEEALLAAGRPDGGLSAREEVAKQLRLAGPMVAGALLQNVIQMISVMYVGHLGELPLAGASMANSFATVTGLSLLLGMSSALDTLCGQAFGARQHRLLGIYMQRAMFLLTVVSVPLAAVWFYTGEILLLFGQAPDIAAEAGAYARWMIPALFAYGLLQCLVRFLQTQNIVVPVMAAAGAAAACHLVVCWALVFGLGMGSRGAALSNAVSYWINVAALAAYVGVSSACRETWTGFSAEAFRDALGFFRLAIPSALMVCLEMWSFELIVLLSGLLPNPELETSVLSISLNTAAFVWMIPFGLGSAISTRVSNELGAGRPQAARLAVRVVVFLAVSEGLAMGLILVCVRYVWGHAYSNVPEVVAYVAKMMLVIAVSNFFDGIQCVLSGVARGCGWQKIGACINLGAYYVAGIPCAYLIAFVLRVGGMGLWLGIICGLLVQVLLLMVVTLCTNWDNEATKAKDRVYSSSPADFES

SEQ ID NO: 37905 - DNA, 1265 bp, Panicum virgatum
  misc_feature: Ceres CLONE 1991676
  misc_feature: Encodes the peptide sequence at SEQ ID NO. 37906
aggcagagaaagtgcagcacaggctcacagccaacgtacggtcgaggctgctgcttgcgtcgcatgcgatggcgcacgccgtacacgaccgcctcccgttcctcgcctcgcccccgccgcccccgccgcccgcgagggagagaggaaggaacccgcccctcgccgagatgctccgcctcgtcggcgccgccaccgtcgacccggcggccgccgcggacgacgacggctccgcgtccgtgttctcgctcccgctgccgctgcccgccacgcccgaccgtgccgcggcggcggaaggcggcggcggcgagtgtgcgcccatcgggcggagcgtccagttccgcctcgcgttcaccggcctgacctacagcgtccgcgccaagcagcgcggcgggcgcgccggcatgctgcccctgcagcgccgctccgaccgcgtcaccgccgcggcgcccgacgcgcacgcgccacgcacgagggcgctgctggacggcgtctccggggaggcgagggagggcgagatcctggccgtcatgggcgccagcggctccggcaagtccacgctcatcgacgcgctcgccaaccgcatctcccgcgacgcgctcaagggcgccgtcacgctcaacggcgagcccctcacggggaacatcctcaagtccatgtccgcgtacgtcatgcaggacgacctgctgttccccatgctcaccgtcaccgagacgccctccctcgcctcccagttccgcctcccgcgggtgctgtcgccggccaagaagcgcgcgcgcgtgcaggcgctcatcgaccagctcggactccgcgcggcggccaacaccatcatcgccaacaagggccaccccggggtgtccggaggcgaccgccacagggtctccatcggcaccaacatcatccacaacccgatcctcctcttcctcgacaagcccacgtcggggctcgactctacctcggcgttcatggtggtcaaggtgctgcgccgcatcgccaagagcggcagcattgtcatcacgtccatccaccagccgagccagcgcatcctcggcctcctcgaccgcctcatcctcctctccggcggccccacggtcttcagcgggacaccttccgccctcccgccctacttcgccgagttcggcttcccggtccccgacgacgagaaccgcgccgagttcgcgctcgacctgatccgcgagttcgagtcgtcgccgacggggacgaaaccgctcgtcgacttccaccgcgcgtggcagcgcatgcacgcg

SEQ ID NO: 37906 - protein, 398 aa, Panicum virgatum
  misc_feature: Ceres CLONE 1991676
  misc_feature (148)..(338): Pfam Name: ABC_tran Pfam Description: ABC transporter
  misc_feature: SWISSPROT Homolog: EC 3.6.3.28 Phosphonate-transporting ATPase
MAHAVHDRLPFLASPPPPPPPARERGRNPPLAEMLRLVGAATVDPAAAADDDGSASVFSLPLPLPATPDRAAAAEGGGGECAPIGRSVQFRLAFTGLTYSVRAKQRGGRAGMLPLQRRSDRVTAAAPDAHAPRTRALLDGVSGEAREGEILAVMGASGSGKSTLIDALANRISRDALKGAVTLNGEPLTGNILKSMSAYVMQDDLLFPMLTVTETPSLASQFRLPRVLSPAKKRARVQALIDQLGLRAAANTIIANKGHPGVSGGDRHRVSIGTNIIHNPILLFLDKPTSGLDSTSAFMVVKVLRRIAKSGSIVITSIHQPSQRILGLLDRLILLSGGPTVFSGTPSALPPYFAEFGFPVPDDENRAEFALDLIREFESSPTGTKPLVDFHRAWQRMH

SEQ ID NO: 37907 - DNA, 593 bp, Panicum virgatum
  misc_feature: Ceres CLONE 1991676-R
actggatctggttccactacctgtcgctggtgaagtacccgttcgagggggtgctgcagaacgagttcgggcgcgccggcgagtgcttcgtgcggggcgcgcagatgttcgacaactccccgctggccgcgctgccggacgccgtcaaggcccgggtgctcgcgtccatcagctccgcgctcggggtggggatcggcgccgacacgtgcgtcgtcacaggccgcggcgtgctgcagcaggcggcggtgacgcagctcggcaagtgggagtgcctgctcgtgaccgtggcctgggggttcctcttccggatcttcttctacttcagcctcgtgctcggcagcaagaacaagcggaggtgatcgcacccgcgcgccgccatggaattaacgcgcgtatatgtacatttgaaagcaatcaatcgtcgaagctcgccatggaagacagcaaacaagcgtgcaaaaagggaagtgaaggaagaagacgtagtcaaataggtggtggtgattgttcatgattttttttcgccttcttctttctccagtgttttgtagctaaataagtggtttattacgggtatacacatgcttggatcc

SEQ ID NO: 37908 - DNA, 674 bp, Panicum virgatum
  misc_feature: Ceres CLONE 1991690
  misc_feature: Encodes the peptide sequence at SEQ ID NO. 37909
acttgcgactccgcccccaaatgctcgccggcatctcccgttccctcactcgccgcgccccgccctttccccttgccgctaccgccgccgccgctgcagcggccatgtcgtcgtcatcgacgggagagaacgtctccgatcgtccggtctctccggacaccacccgcgtggcctgggtggggacgggcgtcatgggccagtccatggccggccacctcctcgccgccggctacgcgctcaccgtcttcaaccgcacggcctccaaggctcagggcctcgtctcccgcggcgccagcctcgcggacagcccgcgcgcggccgccgcggccgccgatgtcatcttcctcatggttggcttcccctccgacgtccgcttcaccgccctcgatccgtccaccggcgccctcgccgggctcgccccaggcggcgtcctcgtcgacatgaccacctccgaccccaccctcgccgccgagatagccgcctccgcggccgccgccggctgctcggccgtggacgcccccgtctccggcggcgaccgcggggcccgcaacgccaccctctccatcttcgcgggcggcgacgccgccgtcgtcgcccgcctggcgccgctcttcaagctcatgggaaacgcgctgtacatgggcgggcccggcgcggggcagcgcgccaagctg

SEQ ID NO: 37909 - protein, 217 aa, Panicum virgatum
  misc_feature: Ceres CLONE 1991690
  misc_feature (47)..(210): Pfam Name: NAD_binding_2 Pfam Description: NAD binding domain of 6-phosphogluconate dehydrogenase
  misc_feature: SWISSPROT Homolog: EC 1.1.1.60 2-hydroxy-3-oxopropionate reductase
MLAGISRSLTRRAPPFPLAATAAAAAAAMSSSSTGENVSDRPVSPDTTRVAWVGTGVMGQSMAGHLLAAGYALTVFNRTASKAQGLVSRGASLADSPRAAAAAADVIFLMVGFPSDVRFTALDPSTGALAGLAPGGVLVDMTTSDPTLAAEIAASAAAAGCSAVDAPVSGGDRGARNATLSIFAGGDAAVVARLAPLFKLMGNALYMGGPGAGQRAK

SEQ ID NO: 37910 - DNA, 786 bp, Panicum virgatum
  misc_feature: Ceres CLONE 1991695
  misc_feature: Encodes the peptide sequence at SEQ ID NO. 37911
aaaatctgcagccaccaattctgacaatagaagatgccatccaacgaaacagctacttccaagtccccccaagtttagctcccaagcctgttggtgactacaaccaagggatgtctgaagctgatcacaagattatatcagctgaggttaaacttgggtcccagtattatttttacatggagacacaagtggcacttgctattcctgatgaagataactgcataaccatctattcatcaacacaaatacctgaggtcacacaaaatgtggttgcaaggtgccttggcattccatttcacaatgtccgtctcatcaccagaagagttggaggaggctttggtggaaaggcaatgaaaggaatacatgttgcatgtgcatgtgctgttgctgcattcaagctacggcgtcctgttcggatgtatctcgatcgcaagacagacatgataatagcaggtgggcggcatcctatgaaggtgaagtactctgttgggttcaaatcagatggcaagatcacggccttgcaccttgaccttggtatcaattctggaatatcaccggatgtgagtccattgatgccacctgctatcataggcgctctcaaaaagtacaattggggcaatcttgcatttgacgccaaggtctgcaagacaaatgtctcatcgaaatcagcaatgaggggtcctggagatgtacagggctctttcattgctgaaggcatcattgagcatgttgcttcagcactctcagttgacactaacaccatcaggaggaagaatctgcatgact

SEQ ID NO: 37911 - protein, 261 aa, Panicum virgatum
  misc_feature: Ceres CLONE 1991695
  misc_feature (12)..(261): Pfam Name: Ald_Xan_dh_C2 Pfam Description: Aldehyde oxidase and xanthine dehydrogenase, molybdopterin binding domain
  misc_feature: SWISSPROT Homolog: EC 1.2.3.14 Abscisic-aldehyde oxidase
NLQPPILTIEDAIQRNSYFQVPPSLAPKPVGDYNQGMSEADHKIISAEVKLGSQYYFYMETQVALAIPDEDNCITIYSSTQIPEVTQNVVARCLGIPFHNVRLITRRVGGGFGGKAMKGIHVACACAVAAFKLRRPVRMYLDRKTDMIIAGGRHPMKVKYSVGFKSDGKITALHLDLGINSGISPDVSPLMPPAIIGALKKYNWGNLAFDAKVCKTNVSSKSAMRGPGDVQGSFIAEGIIEHVASALSVDTNTIRRKNLHD

SEQ ID NO: 37912 - DNA, 706 bp, Panicum virgatum
  misc_feature: Ceres CLONE 1991706
  misc_feature: Encodes the peptide sequence at SEQ ID NO. 37913
accgcccccaccaccagtcccgagttcccgccactcccctccattcccccgccctcacaatccaatccccaaatctctctaccgctccaccctctctagcggcgaggcgaggcggggaagaagagggagcggcgaggatgctgtgggtggacaagtaccgccccaagaccctagacaaggtcaccgtccacgaccaggtcgcgcagaacctcaggaagctcgtgtcggagcaggattgcccgcacttgctgttctatgggccgtcggggtccgggaagaaaaccctaatcctggcgctcatcaagcagatgttcggcgccggctcggagaaggttaagatggagaacaagacatggaagatcgatactggaacaagaacacttgagatagagttggtgatgttgtcgagtgctcatcatgtggaaatgaaccccagtgatgctgggtttcaggacaggtatgttgtccaggaggtcatcaaagagatggcgaagaataggccaatcgatgccaaaggcaagagagcatttaaagtccttgtgttaaatgaagttgacaaactctcacgagaagcccagcattccctccgtaggactatggagaagtatagcgcatcatgcagactgatcctgtgctgtaacagctcatcaaaagtcacagaagctgtaagatcccgttgcttaaatgtgcgagtgaatgctcctag

SEQ ID NO: 37913 - protein, 189 aa, Panicum virgatum
  misc_feature: Ceres CLONE 1991706
  misc_feature: SWISSPROT Homolog: EC 2.7.7.7 DNA-directed DNA polymerase
MLWVDKYRPKTLDKVTVHDQVAQNLRKLVSEQDCPHLLFYGPSGSGKKTLILALIKQMFGAGSEKVKMENKTWKIDTGTRTLEIELVMLSSAHHVEMNPSDAGFQDRYVVQEVIKEMAKNRPIDAKGKRAFKVLVLNEVDKLSREAQHSLRRTMEKYSASCRLILCCNSSSKVTEAVRSRCLNVRVNAP

SEQ ID NO: 37914 - DNA, 683 bp, Panicum virgatum
  misc_feature: Ceres CLONE 1991707
  misc_feature: Encodes the peptide sequence at SEQ ID NO. 37915
aaaccctttcgccgccgccgccgccgccgccgctagctccagcgccccgtcggccgcccttctcccgctacaagcttggcgtcaccttcgcctatccaacatgggtaagacacgtggtatgggagctgggcgcaagctcaagacccacagaaggaaccagaggtgggctgacaaagcctacaagaagagccatctcggcaatgagtggaagaaaccttttgctggctcatctcacgcaaagggaatcgtccttgaaaagattggcattgaggctaagcagccaaactctgctatccgtaagtgtgcccgtgtccagcttgtgaagaatgggaagaagattgctgcctttgtgcctaacgacggttgcttgaactacatcgaggaaaatgatgaggtgctgattgctgggttcggtcgtaagggtcatgctgtgggagatattcccggtgtccgtttcaaggtcgtcaaggtctctggagtttccctgctcgccctcttcaaggagaagaaggagaagccgagatcttaaacatctgttcccccttgccttaatgaaatttgtaatgaatgtttttggttctgtggcgcatctgaaaggctctctctcatatcggaactcatgttatgcctagatgagccttaccacagaagctttgtaagcgaagcccagttgattcaccccc

SEQ ID NO: 37915 - protein, 142 aa, Panicum virgatum; identical to SEQ ID NO: 12276
  misc_feature: Ceres CLONE 1991707
  misc_feature (8)..(141): Pfam Name: Ribosomal_S12 Pfam Description: Ribosomal protein S12

SEQ ID NO: 37916 - DNA, 1333 bp, Panicum virgatum
  misc_feature: Ceres CLONE 1991745
  misc_feature: Encodes the peptide sequence at SEQ ID NO. 37917
acgccgagttctctcttccagagacggacagagagagaaagtgagttccagcgaagcagccagcagcccgccacgccttcctccttcctctcgcggattcagagctccagacctcctccgtgtccgtgggtgcgaagcggcgcaacggcggcggcggcggcgacagcgtgatcgccttcccgggagcgggaagctcgagttgagcggcggcggaacgttgagcggcggcggaacggccgccgatgggaccaatggagccgcgctaccgtcccgccggcgcccctgaggatacaactaagagaaggacctctaaaagcaaaagcttcaaagatgtcgaaaattttgaagttcttgtcattgaaaagaactgtggttgcaagttcaaatctttgaagatcatgatcatagctatcatttctgcaacagttcttacccttataaccccaaccttgtatgagcaccaattgcagtcagcctcccggtttatggacgacggttggatgtgggacaaaacaagttctgacccgcgatatgcttcatctgttgatgttcagtgggatgatgtacatagagcactcagaaatctaaaaagtggtaatcaagatctcaaagttggactcttgaattttaacagcaccgagtatggctcctggacacagttgttgccggacagccatgtttccataataagacttgagtatgccaaggacagcattacttggcagacactgtatcctgaatggatcgatgaggaggaagaaactgagataccctcttgtccatctctcccagagcccaatgttcgaaaaggtgtacgctttgatgtcattgcagtgaaacttccttgtacccgtgttgcgggttggtcaagagacgttgcacggctccatttgcagctctcagcagcaaaattggctgtggcctcttcgaagcgcaatcacaaggtccatgtgctttttgtaagtgactgcttcccaattccgaatctcttcccgtgcaagaaccttgtgagacatgaaggcaatgcttggttatatagtcctgactcgaaagcattaagggaaaagctcaggcttccagtcggatcttgtgagcttgctgttcctctcaaagcaaaatcaagacttttctcagtagatcgacgaagagaagcatatgcaacaatactgcattcagcaagtgagtatgtctgcggtgctatctcagcagcacaaagcattagccaagcaggatcaactagggatctggtcatccttgttgacgagaccataagtgatcaccaccggagaggattggagtctgcagggtggaaggtcagaataatcaaagaatc

SEQ ID NO: 37917 - protein, 363 aa, Panicum virgatum
  misc_feature: Ceres CLONE 1991745
  misc_feature: Useful for making plants with altered carbohydrate content
MGPMEPRYRPAGAPEDTTKRRTSKSKSFKDVENFEVLVIEKNCGCKFKSLKIMIIAIISATVLTLITPTLYEHQLQSASRFMDDGWMWDKTSSDPRYASSVDVQWDDVHRALRNLKSGNQDLKVGLLNFNSTEYGSWTQLLPDSHVSIIRLEYAKDSITWQTLYPEWIDEEEETEIPSCPSLPEPNVRKGVRFDVIAVKLPCTRVAGWSRDVARLHLQLSAAKLAVASSKRNHKVHVLFVSDCFPIPNLFPCKNLVRHEGNAWLYSPDSKALREKLRLPVGSCELAVPLKAKSRLFSVDRRREAYATILHSASEYVCGAISAAQSISQAGSTRDLVILVDETISDHHRRGLESAGWKVRIIKE

SEQ ID NO: 37918 - DNA, 662 bp, Panicum virgatum
  misc_feature: Ceres CLONE 1991745-R
  misc_feature: Encodes the peptide sequence at SEQ ID NO. 37919
cgacagcgaggagatgaaggcgaagaagacacagctgttcggcgccgatcccccggtcctctatgttctccactacctgggcctgaagccgtggctgtgcttcagggactatgactgcaactggaacaaccccccgatgcgcgaattcgctagtgacgtcgcgcacgcccggtggtggaaggtgcacgacaggatgccccggaagctccagtcctactgcctcctgaggtcacggcagaaggccgggctggagtgggaccggaggcaggctgagaaggccaactctgaagatggccattggcgccgcaacatcactgaccccaggctgaagacctgctttgagaagttctgcttctgggagagcatgctctggcattggggcgagaacaataacaggacgaagggcagccccgcgacggtgacgacggcgagcttggcaagctcatgatctgtacatataaaaacaagcaacttcccataaggcaaccatacatgcatagcaatagtttgtataggtacctgtgcttcttaggtctttgctatacaaaatacacccctccctgttgctgtcatggctgcagctctatgtcagctgccggcctgcctcgatggctaacgattcttttgggttggctgagataataagttacttttacatgtag

SEQ ID NO: 37919 - protein, 148 aa, Panicum virgatum
  misc_feature: Ceres CLONE 1991745-R
  misc_feature: Useful for making plants with altered carbohydrate content
  misc_feature: Useful for making plants with altered cell wall content and/or composition
DSEEMKAKKTQLFGADPPVLYVLHYLGLKPWLCFRDYDCNWNNPPMREFASDVAHARWWKVHDRMPRKLQSYCLLRSRQKAGLEWDRRQAEKANSEDGHWRRNITDPRLKTCFEKFCFWESMLWHWGENNNRTKGSPATVTTASLASS

SEQ ID NO: 37920 - DNA, 1766 bp, Panicum virgatum
  misc_feature: Ceres CLONE 1991761
  misc_feature: Encodes the peptide sequence at SEQ ID NO. 37921
tttccaacccccaaggtgggttggtgttgcgctgcggctgccgccacagcctacagctagccgctgcccgttgccattcctgtgaagccccccgtggtgagaggttgcacaagcggcgagagcctcctcctccttcgcgagattggccgcaatcatcgccgccatcatcaccgaccgagccagccagcgagcgagcatggcatttgcggatggggactcgtcctcttcttcgtgggatagtgacgatgagtaccagaagttcatccaaaagatgaaccctccaagggtcacgattgataacgcgtcgtgtgcaaatgctacaatcattcatgtggacagcgccaacaagtatgggatactgctggaggttgtgcaggtcctcactgacctcaagctcattgtgaagaaagcctacatatcctctgatgggggatggttcatggatgtcttcaatgtgacaaatcaaaatgggcagaagataatggatgaatctgtgctggaagggataaaagattacctttacaagtctattgcacctcgttcttgctttcttcattcacgtagaagggccattggagtcgaaccttcctccgactacaccttgatagagctaactggggctgacagacctggtcttctgtctgaagtgagcgctgtgcttacaaatctggactgtaacgtggtaaatgctgaggtgtggacacataacgaaagagcagcagcagtcatccaggtcactgataggagttctgggttggcaatttcagatgcagaaaggcttggcagaatcaaggagcgtcttcgcaatgtgttcaaaggaaggagtagagatgccaaaacaacagttgcaatggggataacccacacagagcggcggctgcaccagatgatgctcgaggatagagattatgaaaggtacggcaaggatagggcaaataccaaccgcgtgcccatggtctcagttgttaattggcttcagaaagattattctgtggtgacaatgcggtgcaaggatagaccaaagcttctcttcgacacagtttgcactctaacagatatgcaatatgtggtttaccacgggagcgtggatactgagggccctgtagctcaccaggagtattatattaggcacattgatggatcacctgtcaattcggaggccgagagaaaacgaataatccaataccttgaagcagctatcgaacggagagtatccgagggcttgaagttagagttgtcaacaggagacagagtgggtctgttatcagacgtgacacgcattttccgtgagaatggcttgacagtcacaagggcagaggtttcaactaggggtaacaaggctatcaacactttctacgtgcgtgacacagcagggagctcggtcgagctgaagacactcgaagccattaggcaggagataggccagaccgtgcttcaagtgaaagggcaccctgaccaccagaagtcacaatcgcaggagtcgcctactaggtttctcttcagcagtctcttcagaccaagaacaccctgaaaccttggaattaaggctaagcagcccaacagtcgatgactacagtaggttgtgtagcagcatccaccattgtacatactttcccaactttagcgtagagctgagtaaatatccccagtcctgtatggctgcttgctcccaaagtcccaattgcatacctagtatgattcatttcaaacttgtgtaaacgctgtcctctgccatctctagcagctgtctaaatgtctttcaatcc

SEQ ID NO: 37921 - protein, 444 aa, Panicum virgatum
  misc_feature: Ceres CLONE 1991761
  misc_feature (135)..(207): Pfam Name: ACT Pfam Description: ACT domain
  misc_feature (343)..(409): Pfam Name: ACT Pfam Description: ACT domain
  misc_feature: SWISSPROT Homolog: EC 2.7.7.59 [Protein-PII] uridylyltransferase
MAFADGDSSSSSWDSDDEYQKFIQKMNPPRVTIDNASCANATIIHVDSANKYGILLEVVQVLTDLKLIVKKAYISSDGGWFMDVFNVTNQNGQKIMDESVLEGIKDYLYKSIAPRSCFLHSRRRAIGVEPSSDYTLIELTGADRPGLLSEVSAVLTNLDCNVVNAEVWTHNERAAAVIQVTDRSSGLAISDAERLGRIKERLRNVFKGRSRDAKTTVAMGITHTERRLHQMMLEDRDYERYGKDRANTNRVPMVSVVNWLQKDYSVVTMRCKDRPKLLFDTVCTLTDMQYVVYHGSVDTEGPVAHQEYYIRHIDGSPVNSEAERKRIIQYLEAAIERRVSEGLKLELSTGDRVGLLSDVTRIFRENGLTVTRAEVSTRGNKAINTFYVRDTAGSSVELKTLEAIRQEIGQTVLQVKGHPDHQKSQSQESPTRFLFSSLFRPRTP

SEQ ID NO: 37922 - DNA, 741 bp, Panicum virgatum
  misc_feature: Ceres CLONE 1991766
  misc_feature: Encodes the peptide sequence at SEQ ID NO. 37923
accgcatcgcatcgctccaccaccacccaacccccgttcctcgcagttgcagcacacgctcttctgctcctgcgcctgccctgctctcacccgttccaagcgaatccgagcgcaagaccgcggcccaacgcgcggcggatggcggaggcggagcccaccaccaacggcggcagcggcatcggggccatcctcgccgccggcgatcgggacttcctcgtccgcaactccggcgagcaggtgaagatcagcagcatagaggcgagccctgtggccctctacttctcagcctcatggtgcccgccatgcaggcggttcacgcccaagctaatcgaattatacaaagaactggcctctcagggcaagagctttgaggttgtctttgtttcaggtgatcaggatgaggaagcattcaatgcatactttggaaagatgccatggctggctgtccctttctctgactctgaaggccgtgaaggccttgatggccggtttaaggtctctggtatcccacaccttgtcattcttgatgcaaaaactggcgaagtttacactgaagatggtgttgagttcgtgagcgagtatggtgtagaggcttaccctttcacaccagagaggatcaatgaactgaaggagcaggaaaaagcagcaaaggataatcaaactattcaaagcgtgcttggcacatccactcgggactatctaatttcaaacaagggagacaaggtacccatctctgagctc

SEQ ID NO: 37923 - protein, 200 aa, Panicum virgatum
  misc_feature: Ceres CLONE 1991766
  misc_feature (14)..(139): Pfam Name: AhpC-TSA Pfam Description: AhpC/TSA family
MAEAEPTTNGGSGIGAILAAGDRDFLVRNSGEQVKISSIEASPVALYFSASWCPPCRRFTPKLIELYKELASQGKSFEVVFVSGDQDEEAFNAYFGKMPWLAVPFSDSEGREGLDGRFKVSGIPHLVILDAKTGEVYTEDGVEFVSEYGVEAYPFTPERINELKEQEKAAKDNQTIQSVLGTSTRDYLISNKGDKVPISE

SEQ ID NO: 37924 - DNA, 596 bp, Panicum virgatum
  misc_feature: Ceres CLONE 1991766-R
  misc_feature: Encodes the peptide sequence at SEQ ID NO. 37925
gtgggatcccttcacttgtcgctattggtcctactgggcagactgtcagtaaggatgcaaaggcccagcttatgatccacggtgctgatgctttccccttcaccgaggagagacttgaggagctgcagaaggagctggatgagatggcaaaggggtggcctgagaagttgaagcatgcgctgcatgaagagcatgagcttgtcctgctgcgccgtggcacttacggctgcgacgggtgtgaagagatgggcagcacatggtcctacaggtgtgatgagtgtgacttcgatctgcaccccaagtgtgcgctggctgaggaaaagaagggggaggaggaggatgggaaggctgctgaggaagccccggctgggtatgtgtgcgagggagatgtgtgcaggaaggcctagagctgttattgtggggttgtgttagtgctgtctgagtggtgtgtggtgtggtaataaataatcatcagatggtttgcttggagttgaggtgtttggcctgtcgatgtctgtgttaatcgatagtagtcgcaccctgaacttttagatgtatacgtgagtgctatttcagatcaaagaactggttttgcc

SEQ ID NO: 37925 - protein, 134 aa, Panicum virgatum
  misc_feature: Ceres CLONE 1991766-R
  misc_feature (74)..(102): Pfam Name: C1_3 Pfam Description: C1-like domain
GIPSLVAIGPTGQTVSKDAKAQLMIHGADAFPFTEERLEELQKELDEMAKGWPEKLKHALHEEHELVLLRRGTYGCDGCEEMGSTWSYRCDECDFDLHPKCALAEEKKGEEEDGKAAEEAPAGYVCEGDVCRKA

SEQ ID NO: 37926 - DNA, 723 bp, Panicum virgatum
  misc_feature: Ceres CLONE 1991772-R
  misc_feature: Encodes the peptide sequence at SEQ ID NO. 37927
gtgatccaacggctgttcaatgaatacctcaaattgaatggtaatggttcagatcctatgtcacaaggggttgatgttgaaatggtagccactgatcatgatcctatcctttggctacttgggaccgacatgttacagttagagcccaatctggaggtgaggcttctttggaactggagtcatacttgtcaaaggtaacaattcatcgaagtgatcagttcaatatcctcgcatggtggcaaatgaattcagctgaataccctacactaagtcgtatggtgagagatatattagcagttcctgcatctaccgtggcatctgaatctgcgttcaatacagggtcaacagtactttcagattttcgaagtcgaatgacaccagaaactgtggaagctctagtgtgccttcaggactggataagggcctcaggaaatacgcagcgtagcatggagtctgttcatgatatcatgaccttggaaggtgaggaggaaccttgaggcatcgttccataaccttcagtagatgaagctggaactaagtttacctactaagtttaccttcagtagatgaaactggaactaagttaaatcttatttatgtgaaatcattactcttaaactcgtgtgttgatggcacgtaatggtgactgttgctttgatgactatatgtaataacgttcatgaatagagctaattctcagttatttatgtgtgatttgctatg

SEQ ID NO: 37927 - protein, 84 aa, Panicum virgatum
  misc_feature: Ceres CLONE 1991772-R
  misc_feature (1)..(59): Pfam Name: hATC Pfam Description: hAT family dimerisation domain
MNSAEYPTLSRMVRDILAVPASTVASESAFNTGSTVLSDFRSRMTPETVEALVCLQDWIRASGNTQRSMESVHDIMTLEGEEEP

SEQ ID NO: 37928 - DNA, 651 bp, Panicum virgatum
  misc_feature: Ceres CLONE 1991772
ctctcccagtagtctgtagtctcccgcagtcccgagccgcaaggtcgcgacagaagcgccgcgcgccgccgccggcttcgccttcctgccgacgagccgccactcccccagcggcatctactcttcacctcgacttcgacttcgccttcctgctccggatttccagaaacatggaagaggaaggagaagctcaagaagggtcccaagggcgtctcttatcattgataaccaaggtaacagggtcaaggacaataaagtttccagtacaagcaccaccagtgttatctccttcatcagtatacaattgcaaagcctttcttggtaagcatttttagtctaaattaaattgtatttgcattttgcaacatgattctgcgatgccatatttttcatttttgattggaaagtctccttcccattctcatcaccatcaataattgtaccctgttgtgtaattgtactactgtcccaaacatataaattaatttcactaaacatgaaattaaattgtatttgcattttgcaacatgattctgcgatgccatatttttcatttttgattggaaagtctccttcccattctcatcactatcaataattgtaccatgttgtgtaattgtactactgtcctaaacatataaattaatttca

SEQ ID NO: 37929 - DNA, 662 bp, Panicum virgatum
  misc_feature: Ceres CLONE 1991777
  misc_feature: Encodes the peptide sequence at SEQ ID NO. 37930
gtcccgtatcgcgcagacgcagacgcagacgcagacgcgcacgccgttccccgctgccagctctcggttcccccgccccgcgccaagcacgcgcacgatagccgcgcacccggatcggatggcccccgctagcgtgcgcgcggcgcaggcgccggcgcaggcgcaggcgcaggagcccagccccagccccagccccagcgccgaccgcaggttaagtacgctggcgcggcacctgctgccttcctccccacgaagagcagcggcagcggcagcagcagcagcagacacctccgccaccctcgaatcgtccccaaccatggcgtcgcaggtcgcctccgtcttcgctggcatcgcgcaggccccggaggaccccatcctgggggtgacggttgcgttcaacaaggatcccagccccgtgaaggtcaacctcggcgtcggcgcctaccggaccgaggaagggaagcccctcgtgctgaatgtggtccggcgcgccgagcagatgctgattaatgacccgtctcgatttaaggaatacctaccaatcactggtttggctgaatacaataagctgagcgctaagcttatctttggtgctgacagctctgctattcaggagaatagggttgttacagtgcagtgcctatctggaactggttctttaa

SEQ ID NO: 37930 - protein, 115 aa, Panicum virgatum
  misc_feature: Ceres CLONE 1991777
  misc_feature: SWISSPROT Homolog: EC 2.6.1.1 Aspartate transaminase
  misc_feature: Useful for making plants with modulated nitrogen use efficiency
MASQVASVFAGIAQAPEDPILGVTVAFNKDPSPVKVNLGVGAYRTEEGKPLVLNVVRRAEQMLINDPSRFKEYLPITGLAEYNKLSAKLIFGADSSAIQENRVVTVQCLSGTGSL

SEQ ID NO: 37931 - DNA, 1615 bp, Panicum virgatum
  misc_feature: Ceres CLONE 1991785
  misc_feature: Encodes the peptide sequence at SEQ ID NO. 37932
tgatccctgtactccgccatcccctccctctcccctcaacccccagcgccccctcccgccgccgctagggtttctcctcccctcgccgcctccccccaaatctccccaccggagcttctagagcctcgagcggcccctgcgcagcagccatgagcgacggcaaggactccctcgacctctccggcctcggcgccgccgttcccaactcgaacgagctcagcgcggaggataaggctaacctcgtggcctcgttgaagaacacgctcgagggattggcgtcgcagcatatggacgtgctcgaaggcctcgagcccaaggtcaggaagcgtgtcgagaagctcagggagatccagggacaacatgatgaacttgaggcaaagtttttcgaggagagagctgcacttgaagctaagtatcagaagatgtatgaaccactttactcaaagcgttacgaaattgtcaatggtgtgatcgaggttgagggtatcacagaaagtgcagatgaaacccctgcagaggaaaagagtggagatgaaacccctgctgagcaaaaagaagaaaaaggtgtgccagctttctggcttaatgcaatgaagaaccatgaaatcctggctgaggagatccaggagagggatgaggaagctctcaagtaccttaaggacatcaagtggtacaggatcagcgaacctaagggttttaagcttgagtttcactttgatacaaatccattcttcaagaattcagtgcttacaaaaacatatcacatgattgatgaggatgagccgattctagagaaagccattggtactgaaatcgaatggtaccccgggaagtgcttgacacaaaaggttctaaaaaagaagccgaggaaggggtcaaagaacactaaacctatcacaaaaactgaagactgcgatagcttcttcaacttcttcagtccacctcaagtccctgatgatgatgaggaaattgatgaggatacagctgaacaattgcagaaccaaatggagcaagattatgatatcggatctaccatcagagacaagatcattccacatgctgtctcatggttcactggagaggctgctcaagatgatgactttgaaggccttatagatggtgatgaggatgatgaagaagaagatgatgaagaggatgaggaaagtgaagatgattatgatacgaagaagaccaagggagctgccggaggggatggccagcagggtgaacgacccgccgagtgcaagcagcagtgaggtgctgcacattgaatttctgcacacagtggattcttgcatgatggaagtttggttctgcttgatgcaatgtcattgagttggttttgtggggcccttggaggggcgtgtgttagttttgtggagtcggtgggggggatttttctgggccatggtatcgctatcatatgttggtagttttgtcacttgatgtattgggtttcagatattatgtgctctacttatgctttgagtgatcattgttgccagtctggtatttcttattgcacataccgctggcttagcatgctgtacattcatgaagcgtgttgtggagaaattttgccctagaggaaagccggaaaggctactttcaccgg

SEQ ID NO: 37932 - protein, 368 aa, Panicum virgatum
  misc_feature: Ceres CLONE 1991785
  misc_feature (58)..(314): Pfam Name: NAP Pfam Description: Nucleosome assembly protein (NAP)
MSDGKDSLDLSGLGAAVPNSNELSAEDKANLVASLKNTLEGLASQHMDVLEGLEPKVRKRVEKLREIQGQHDELEAKFFEERAALEAKYQKMYEPLYSKRYEIVNGVIEVEGITESADETPAEEKSGDETPAEQKEEKGVPAFWLNAMKNHEILAEEIQERDEEALKYLKDIKWYRISEPKGFKLEFHFDTNPFFKNSVLTKTYHMIDEDEPILEKAIGTEIEWYPGKCLTQKVLKKKPRKGSKNTKPITKTEDCDSFFNFFSPPQVPDDDEEIDEDTAEQLQNQMEQDYDIGSTIRDKIIPHAVSWFTGEAAQDDDFEGLIDGDEDDEEEDDEEDEESEDDYDTKKTKGAAGGDGQQGERPAECKQQ

SEQ ID NO: 37933 - DNA, 1469 bp, Panicum virgatum
  misc_feature: Ceres CLONE 1991812
  misc_feature: Encodes the peptide sequence at SEQ ID NO. 37934
agaacagcacttgcactcgtctgaccgacgaacacgcgcgtgtgaatcacacagccaccacttcccaacactctcagttcccaacacaaacacaacacaaagagcaacatgtgtcgcgcacccggctatctcatctaccgcaggccccaccccgtggcgccccatccccagcccgtccgcccaacgccgatgcggcccgctgaggaaaccttccccctccccatcaaggcggtgagcgtggaggccaaggtgcgggacttttgctcgtcggtcaccgtgcgtcaaaccttcgtcaacactgagtccacccccatcgaagcgatctaccagttcgagctcgaggaaaaggccacggtgagcgagttcgtggcgctcatcgacggcaacaagatcaagggcaccatccaggagaaggaagacgccaagaacacctacgacgatgcgatcgcgagcgggcatggagcctacctcatagaagaaaaggaagacgagcccaacatcttcaccgtcaacgtgggcaacctgccgccgggcaagagcgtcgacatcgccatcacctacgtcagcgagctcgagttcgacgagggccagcagctcaagttccgtctgccctccaacaacgacaacccgtcgtacaaggccgcggcgtcgtccaactcggcacccaacctcaagctgcgcatcgactttgacatgacgagcaacatcaggagcctgtcgtcgccctcgcacccgatcacgttcgagttcggcgaggagcccacccaggccacggtcacgctgagcgacagtgcgcaggcgcaagccgccaaggatctcatcgtgctcaccaagctcgccaagccccaccaggcgtgcgggcgggtggaggtggacgagaaggggacgagcaagacggtcatggtgtcactgttcccgcagctggagctgggcgacgacgaggacatctacacggagatgatcttcatcgtcgaccggtcgggcagcatgtccggcagccgcatgaaccaggtcaaggacacgctgcagatcttcttgcgcagtctgggcgagggcaccatgttcaacatcatcgggttcggcaccagcacgcagcacctgttccgcgagggcagcgtcgagtacaacgacaagaatctggagatcgcgacgaagcacgtgaaggagatgagcgcgaacctgggcggcaccaacatcctgcggccgttgcaggaggtgttgcgggcacagaccaaggagggctacccgcggcagctgttcatcctcacggacggcgaggtgggcaacacgcaggagtgcgtggactttgtgcgcaagcacgccgagacgacgcgcgtgttcacctttggcgtgggcaacgaggcctcgcaggacctcgtcaagggcctcgccaaggctggcgaagggttcttcgagttcgtgcggtcgggcgaggccatggaggagaaggtcatgcggcagctgcatcg

SEQ ID NO: 37934 - protein, 426 aa, Panicum virgatum
  misc_feature: Ceres CLONE 1991812
  misc_feature (256)..(421): Pfam Name: VWA Pfam Description: von Willebrand factor type A domain
  misc_feature: SWISSPROT Homolog: EC 2.4.2.30 NAD(+) ADP-ribosyltransferase
MRPAEETFPLPIKAVSVEAKVRDFCSSVTVRQTFVNTESTPIEAIYQFELEEKATVSEFVALIDGNKIKGTIQEKEDAKNTYDDAIASGHGAYLIEEKEDEPNIFTVNVGNLPPGKSVDIAITYVSELEFDEGQQLKFRLPSNNDNPSYKAAASSNSAPNLKLRIDFDMTSNIRSLSSPSHPITFEFGEEPTQATVTLSDSAQAQAAKDLIVLTKLAKPHQACGRVEVDEKGTSKTVMVSLFPQLELGDDEDIYTEMIFIVDRSGSMSGSRMNQVKDTLQIFLRSLGEGTMFNIIGFGTSTQHLFREGSVEYNDKNLEIATKHVKEMSANLGGTNILRPLQEVLRAQTKEGYPRQLFILTDGEVGNTQECVDFVRKHAETTRVFTFGVGNEASQDLVKGLAKAGEGFFEFVRSGEAMEEKVMRQLH

SEQ ID NO: 37935 - DNA, 646 bp, Panicum virgatum
  misc_feature: Ceres CLONE 1991812-R
cggtcgaattcgccgccgaccaattcgttggtctttgccaagcccgcggaggaggagtgctgcgcagcgctcgattacaacgacgacgacgacgacgacgacgacgcttcctccgaagatgaggaggaaccgaagatccaggtgcagaggaaggaaaagaaggaagtaatggaggagaagaaggaagaggagaaggcgggaccgccgccggcgcagatgcgggacgtcatcatgaagcagaaggccagcggcagctgggactggagcgacgctgtcggcctcgtgggtctcaccgccgacaagctgcgcagcggcatcccctcggccaagctcctcgccggtggtggtggtggtggtgtggtgcgaacaacagtggacaaggaggtggaggcgctgtgggcgacggccgtggtggcggccttcctgcagaagcggttccccggtcagaagaccaactgggacctggtggtgaagaaggcgctcaagttcatcgcgcgtcagaagaagaacgtcaagctggcctcctcggaaagcgaggacatcgactgggtgcagctcgccgccgccttcctcccctgatcgcccaccgcgcaccgagccagtgttcagtgttcaccgagccagtgttcagcacacgccacgtcac

SEQ ID NO: 37936 - DNA, 1718 bp, Panicum virgatum
  misc_feature: Ceres CLONE 1991829
  misc_feature: Encodes the peptide sequence at SEQ ID NO. 37937
agagccaggtcaagccaacaaccaaatcaaaatcaaagcctagcaaggagagcagagcacccgcggccaccaccagctccagcctccagctaccaggtcatccgcctcgttcgttggctttccagcatctccattccgcgattcatggcggcggccaagtccatcaagcggctgccggcgcggcgggtggtcccggccgagcccacgccggccggcccgctccgcctctcgtggctggaccggtaccccacgcagatggcgctcatcgagtcgctccacgtgttcaagccggccgctgaccgcgtcgccgccggcggcggcgacgtcgatgcctccgccagcccggccaggacgatcgagcgcgccctggcccgcgcattggtgcgctactacccgctggccgggcggctggtgctctcggcggacggcgcgcagcaggcggtggactgcagcaacgcgggcgtgtggttcacggaggccgcggcggcgtgcagcctcgaggacgtggactacctggaggccccgctgatgatccccaaggacgagctcctcccgcccacgcccgccggcgaggacgagcgcgcgctcgtcctgctcgtccaggtcaccgccttcgcgtgcggcggcttcgtcgtcggcttccggttcagccacgcggtcgccgacgggcccggcgccgcgcagttcatgaacgccgtcggggagctggcgcgcggcgcggaggcggaggccgcgccggtggagccgcagtggggccgcgacgcgatcccggaccccgcggccgccctggtcggcagcctcccgcggcccgacggcgccaagcggctcgagtacctcgccatcgacatctccgccgactacatcaaccacttcaagggccagtacagcgcggcgcacggcggcggcggcgcctggtgctcggcgttcgaggtgctgatcgccaaggcgtggcagagccgcacccgggccgccggcttcgagccggactcccccgtccacctctgcttcgccatgaacgcgcgccccatgctgcacgcctccctcccgcgcggcggcgccgggttctacggcaactgctactacatcatgcgcgtgtcggcgccggcgggcaaggtggccgggtcgtcggtgacggaggtggtcaggatcatcaaggacgggaagcgccgcatgcccgcggagttcgcgcggtgggcggcgggggagatgggagccgccgacggcgtcgacccgtaccagatcacgtccgactaccggacgctgctggtgtccgactggacgcggctcgggttcgcggaggtggactacggctggggcccgcccgcgcacgtcgtgccgctgacaaacctggactacatcgccacgtgtatcctggtgaagccttgggcccacaagccaggggcgcggctcatcacgcagtgcgtcaccccggaccgcgtcgccgccttccacgagggcatgctcgacatgaactgaacaagtctgaatgtctgatggaggagagcgagtcggtcagagaagcccaaggcgaaaagggagctcgtggttaaggctaatgacgtgtgattaggtggggttaattagagatggtagttggtgtcatgtggggattggtattggattagctaaccgatggggggttgatgagtgttgttggttggtgatgtgtgcgtagcatctgaataaccgaactcctgaattcaggaaggttttggcgg

SEQ ID NO: 37937 - protein, 443 aa, Panicum virgatum
  misc_feature: Ceres CLONE 1991829
  misc_feature (5)..(442): Pfam Name: Transferase Pfam Description: Transferase family
  misc_feature: SWISSPROT Homolog: EC 2.3.1.162 Taxadien-5-alpha-ol O-acetyltransferase
MAAAKSIKRLPARRVVPAEPTPAGPLRLSWLDRYPTQMALIESLHVFKPAADRVAAGGGDVDASASPARTIERALARALVRYYPLAGRLVLSADGAQQAVDCSNAGVWFTEAAAACSLEDVDYLEAPLMIPKDELLPPTPAGEDERALVLLVQVTAFACGGFVVGFRFSHAVADGPGAAQFMNAVGELARGAEAEAAPVEPQWGRDAIPDPAAALVGSLPRPDGAKRLEYLAIDISADYINHFKGQYSAAHGGGGAWCSAFEVLIAKAWQSRTRAAGFEPDSPVHLCFAMNARPMLHASLPRGGAGFYGNCYYIMRVSAPAGKVAGSSVTEVVRIIKDGKRRMPAEFARWAAGEMGAADGVDPYQITSDYRTLLVSDWTRLGFAEVDYGWGPPAHVVPLTNLDYIATCILVKPWAHKPGARLITQCVTPDRVAAFHEGMLDMN

SEQ ID NO: 37938 - DNA, 692 bp, Panicum virgatum
  misc_feature: Ceres CLONE 1991836
  misc_feature: Encodes the peptide sequence at SEQ ID NO. 37939
aaaccacgcgacagcccgtcgcatccctcaccctgccaccatcccacactccttggtttcaacggcattgctcggacctctctggctagctgcaacaatggccaccaagatcaccttccccgagttccaggccacggccttggacgccatcccaggcatcgccagcgctgctcgcggcgccttccgcatccacaagaccaagaacttggagtggcgccggctccagctgcgcaagctgtactgggctctggaggactaccagcctcagatcctggctgccctcatgcaggacctgcacaagtccgacttcgagtccctgcttaccgagatcgactgggtcaagaaggactgcttgttcatgctcgagcatctcgagaagttcgccaaggacgagaagctgggctcgccccatgtcccgaccacctactcgttcatgaagttccgcgtccgcaaggagcccctgggtgccgtcctcatcatcggtccctacaacttcccggtccagctttgtctcgcccccctgatcggcgccatcggcgccgggtgcaccgccgtcctcaagccgtccgagctgacgcccgcatgcgccatggtgctcaaggagctgatcgagaagaccctcgacccgaccgccatcgctgtggtcaacggcgccatccccgagacgaacgcgctcatgaacgagaaatggg

SEQ ID NO: 37939 - protein, 198 aa, Panicum virgatum
  misc_feature: Ceres CLONE 1991836
  misc_feature: SWISSPROT Homolog: EC 1.2.1.3 Aldehyde dehydrogenase (NAD(+))
MATKITFPEFQATALDAIPGIASAARGAFRIHKTKNLEWRRLQLRKLYWALEDYQPQILAALMQDLHKSDFESLLTEIDWVKKDCLFMLEHLEKFAKDEKLGSPHVPTTYSFMKFRVRKEPLGAVLIIGPYNFPVQLCLAPLIGAIGAGCTAVLKPSELTPACAMVLKELIEKTLDPTAIAVVNGAIPETNALMNEKW

SEQ ID NO: 37940 - DNA, 623 bp, Panicum virgatum
  misc_feature: Ceres CLONE 1991836-R
  misc_feature: Encodes the peptide sequence at SEQ ID NO. 37941
tctccatctccccggtgaactcgctcgacgaggcgcttaatgttgcgaacacggtccaccggacgccgctgtctttgttctcgtttggctccaaggcggagaaccagagaatcctcaacgagatgacatcgggcggcgcgaccctcaacgacgccttcttccacgcgtcggtgaacacggtgccgttcggcggcgtgggcgacagcgggtggggcgcgtaccgcggcaaggcgagcttcgactgcttcacgcacttccgcaccatctcggagacgccctcgtggtccgagaagctcatcgccgtacgctacatgccgttcgacatgggcaagctcaagatcgtgagccgcctgaccaacgggaagcccaactttgaccgcaacgggaaggtggtcaaagggtttgggtactgggccgccctgttctgtggcctcggtggcaagagcgcgaaaggtgcgttggtgaggtggatggttgttctcgtggcccattatctttatacaaatcgggttggaaaataggggtcgcattggattttcttgctctgggttttcatgttcagcaatctaattccagctctgtgttatctaggacacgatgaataaaatctattcgatatgctg

SEQ ID NO: 37941 - protein, 172 aa, Panicum virgatum
  misc_feature: Ceres CLONE 1991836-R
  misc_feature: SWISSPROT Homolog: EC 1.2.1.5 Aldehyde dehydrogenase (NAD(P)(+))
SISPVNSLDEALNVANTVHRTPLSLFSFGSKAENQRILNEMTSGGATLNDAFFHASVNTVPFGGVGDSGWGAYRGKASFDCFTHFRTISETPSWSEKLIAVRYMPFDMGKLKIVSRLTNGKPNFDRNGKVVKGFGYWAALFCGLGGKSAKGALVRWMVVLVAHYLYTNRVGK

SEQ ID NO: 37942 - DNA, 657 bp, Panicum virgatum
  misc_feature: Ceres CLONE 1991880
  misc_feature: Encodes the peptide sequence at SEQ ID NO. 37943
aatggacgcttccaccgcccgcgctttatttcctccccgcacgcgcactaagcgcgccgattagcatgcgcggttgttccattcgctaatctctcgcgtaccagcgacgtcccggcggtggcacatgtcgttgcgacgtctctgcttcgtgctgccgatggacgtgggcgaggccgtcctggcgccggcggcggcggcggaggaggaggaggaggcgcgctgctgggtgacgacggcccgccagacggttcggtcgtgcgtccgcggcacggtcggccgcgtgctgtcgtgcctccgctgccagtcctgtgccggtgctggccgccgccgcgactcgtcggggatggcgttcgaggatatcgccggcgtggatgagggcggagggaggaagcttgcggggtccggcagcagccccaggatcttcagctactcggagctgtacatagggaccaacgggttcagcgataaggaggtccttgggagcggagggttcgggcgggtgtaccgcgccgtgctacccagcgatggcacgacggtggccgtcaagtgcatcgccagccacggcgaccggttcgagaagtccttcctggcggagcttgcggcggtggcgaggctgcggcaccgcaacctcgtgcggctccgcggatggtgcgtgca

SEQ ID NO: 37943 - protein, 177 aa, Panicum virgatum
  misc_feature: Ceres CLONE 1991880
  misc_feature: SWISSPROT Homolog: EC 2.7.11.1 Non-specific serine/threonine protein kinase
MSLRRLCFVLPMDVGEAVLAPAAAAEEEEEARCWVTTARQTVRSCVRGTVGRVLSCLRCQSCAGAGRRRDSSGMAFEDIAGVDEGGGRKLAGSGSSPRIFSYSELYIGTNGFSDKEVLGSGGFGRVYRAVLPSDGTTVAVKCIASHGDRFEKSFLAELAAVARLRHRNLVRLRGWCV

SEQ ID NO: 37944 - DNA, 1472 bp, Panicum virgatum
  misc_feature: Ceres CLONE 1991888
  misc_feature: Encodes the peptide sequence at SEQ ID NO. 37945
acccacacccacccagaccccgaaaatccccaaatcccaatccgacccatctttttccccgacaccgtaccacaccaaccacctcttcctccgctccgggaccagccgaagcaccggtgcgcacgctcccacgcagcagaaatctagctgcggcctccggctccgagggaggagattcccgcggagaaagcgagcgagtgcgcatcgaaagcagcagtctttgccgaaagaagcaatcccggaggaggaggaggaggaggaggagcggcagggcgcgcgcactctcaatggggagctggagcagaggagggagcggcagcagcttgcttaccccactcctcttcctcctcctctctcttcactgctcgccggtgctggtgtcggcggcggggagcggcgagccgtacgtgggcgtgaccatcggcacggcggtgacgaacctgctgtcgccgtcggacctggccgacttcctccgcgcgcagcacatcacccgcgtgcgcctctacgacgcggacccgcgcctgctgtcggcgctggccaccgcgggggtgcgcgccatcgtgggcgtccccaacgacgagctcctcgcgctgggctcctccccggcgacggccacggcgtgggtggcccgccgcgtgctcccgttcgcgggcgtcaactcgagcaccccggccgtcatctccgccatcgccgtcggggacgaggtgccgaccgcgctcccctccgcgctgcccgtgctcctcccggccatccggtccttggccgccgcgctcgccgcggcgaacctgtcctcctccatcccggtgtcgacgccgctgcccttctccgtggtggaggacccgttcccgccgtcgcaggccttcttcaaccagaccctggccaagtccctggtggcgccgctgttcgcccacctcgccagcacctcggcgccgctgatgctgaacctgtacccctactactcgctgatgcagagcaagggcgtgatcccgctggacaacgcgctgttccggccgctgccgccgtcgctggagatggtggaccccaacacgctgctccactacaccaacgtgttcgacgcgatgctggacgccgtgcacgtggccgtgcagaacctgaacgtgagcggcggcggcggcgtgcccatcctggtgacggagacggggtggccgtcgtacggggaccggcgggcggagccgtacgcgagcaaggacaacgcggacgcgtacaactcgaacctgatcaagcacgtcctggagaacaagcccgggacgcccatggcgcccggcgcggcggcgcagtcgagcgcctacgtgtacgagctcttcaacgaggacctccggccgggccccgtgtcggaggcgaactggggcctgttctacggcaacggcacgccggtgtacctcctccacgtgtctggcgccggcgggttcctggcgaacgacacgacggaccgggtcttctgcgtggcggcg

SEQ ID NO: 37945 - protein, 394 aa, Panicum virgatum
  misc_feature: Ceres CLONE 1991888
  misc_feature (41)..(375): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
MGSWSRGGSGSSLLTPLLFLLLSLHCSPVLVSAAGSGEPYVGVTIGTAVTNLLSPSDLADFLRAQHITRVRLYDADPRLLSALATAGVRAIVGVPNDELLALGSSPATATAWVARRVLPFAGVNSSTPAVISAIAVGDEVPTALPSALPVLLPAIRSLAAALAAANLSSSIPVSTPLPFSVVEDPFPPSQAFFNQTLAKSLVAPLFAHLASTSAPLMLNLYPYYSLMQSKGVIPLDNALFRPLPPSLEMVDPNTLLHYTNVFDAMLDAVHVAVQNLNVSGGGGVPILVTETGWPSYGDRRAEPYASKDNADAYNSNLIKHVLENKPGTPMAPGAAAQSSAYVYELFNEDLRPGPVSEANWGLFYGNGTPVYLLHVSGAGGFLANDTTDRVFCVA

SEQ ID NO: 37946 - DNA, 587 bp, Panicum virgatum
  misc_feature: Ceres CLONE 1991888-R
  misc_feature: Encodes the peptide sequence at SEQ ID NO. 37947
tggactgggcgtgcgggcccgggcgcgccgactgcacggcgatccagccagggcaggggtgctacatgcccgacgacgtgcgcagccacgcgtcgtacgcgttcgacgcctactaccagtcccaggcccgcgccgccggctcgtgctacttccagggcgccggcatggtcaccaccacggatcccagtcatgacaactgcttattccctggaagtaagcggctaggtaacgactccaaatccggcagcgcaaacaacgctacgacaccgacaagtgacgccgagggatctgcaatatggaggctaagaacaggaagggagaacgggttctcgctcttcctccggctgcttctgagcatcgcggtggttatcgtgacggattcaaacttttggacatgacaagagagtgctagttgtaacaaaaccagaaatttttggagtggggcaagttagaggtgggattgggttgtgcttagcgattctttattgttaggagtaagcatcaataaattaatcttttttttcttaagctaatgaaatgtgtctatgatctgctgaaatctctctacatttcaatctgtcccaacc

SEQ ID NO: 37947 - protein, 131 aa, Panicum virgatum
  misc_feature: Ceres CLONE 1991888-R
  misc_feature (1)..(68): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
DWACGPGRADCTAIQPGQGCYMPDDVRSHASYAFDAYYQSQARAAGSCYFQGAGMVTTTDPSHDNCLFPGSKRLGNDSKSGSANNATTPTSDAEGSAIWRLRTGRENGFSLFLRLLLSIAVVIVTDSNFWT

SEQ ID NO: 37948 - DNA, 500 bp, Panicum virgatum
  misc_feature: Ceres CLONE 1991893
  misc_feature: Encodes the peptide sequence at SEQ ID NO. 37949
aagctgacaaaagcaaagccaaggcggcgggagccctcggggccccgaccggccaaaaggactgccgctccacaccataccacaccaccatccccattccccaaacccaagcgaaccacccccgcagccgcagccgcagccgcagctgcccgccaccggcctccgactcggcggagagcgcggcggctccgcatcccaccccgacgcatggaggcaccgccggggcaggaacccatggcgctggacgcgccccctgccgccaccgccggctcccaggacggggcggcggcggatccccccgccggctgcaaaaagaaggaacgcgaggggggagagaggataccgggccacatcatctccaccagcatcggcgggaacaacggcgaaccgaagacgactataatttacatggcggagcgtgttgtgggtacaggttcattaggaatactcttccacgctaactgtctggagactggcgagacctttgccatcaacaacga

SEQ ID NO: 37949 - protein, 97 aa, Panicum virgatum
  misc_feature: Ceres CLONE 1991893
  misc_feature: SWISSPROT Homolog: EC 2.7.11.1 Non-specific serine/threonine protein kinase
MEAPPGQEPMALDAPPAATAGSQDGAAADPPAGCKKKEREGGERIPGHIISTSIGGNNGEPKTTIIYMAERVVGTGSLGILFHANCLETGETFAINN

SEQ ID NO: 37950 - DNA, 1445 bp, Panicum virgatum
  misc_feature: Ceres CLONE 1991898
  misc_feature: Encodes the peptide sequence at SEQ ID NO. 37951
ataaggacggcgagagggcagaggtactactgccaggacaaggcattgcttgccaaaagctattgctcgaaaaggggcaggtcggcctggacgtgggccggtgcggcggcgagttccctagtcctactactagcttgtgctctagtcgagctagctagtagcttgtttgccatggaggtcgccgtcgagaggccgacgccggtgaaggaggagaagagagccgatgccaagccggagattgcagcgatgggaagccctctcccgatcgtcttcgaaagctttccatcaacgcaaagagacgcgagcatcaagcaggaacagcgcacgctagaggcggccaaggcggagatgggtgaggtgagggaggagaacgagcgcctcaagacgatgctgtcccgcatcgtcagccagtaccagttgctgcacacgcacttcctcgacgtcgtcaaggtgcacgagcaagcagccaaagccaagctccccgcggcgccggcgccggcggcctcgctgcccaccggagccgccgacgacgccgacgacctcgtctccctgagcctcggcacgcggtccaacggcgcccgccgcaagggccacgagaggtcctcgtcctcgtccggcggcaccgccgagaccaccgccgaccaaggccagctctccctcgggctcggcatcgcgccgggcagcgggctgtccgccgacgacgacaaggcgagcggcgcgtcggcggcgcccgttctgaacctgagctccgacagcagcagcgccggcgacgccgctaagccgcctgcccaggacgacgccgacgcgtgcccgcctgctggtacctcgcgcaagagcccgagcgccggggagggcgccgacgacgaggtccagcagcaggccaagaaggctagggtttccgtcagggtcaaatgcaacactcccacgatgccggatggttgccaatggcggaagtatgggcagaagatctccaaggggaacccctgcccgcgcgcctactaccgctgcacggtggcgccccactgcccggtgaggaagcacgtgcagcggtgcgccgaggacacgtcgatcctgatcaccacgtacgagggccagcacaaccaccagctcccgccggcggccacggccatggcgtccacgacctccgccgcggcggccatgctcacctcgggctccacctcctcctcctccccggcctcgctcgcccacggccaccacctcccgctcgcggccgccgggctgctcggcccgaccaccatggtctccaccgccgcgtcgtgccccaccatcacgctcgacctcacgaccccggcgccgccgcactccctcatgcacccctcgccgtacgccgccgccgccgcggccggctacgagtccaaggcggtcccggcggcgtggagcagcgggtacctggcgtacggcgctgcgcctccgtcgtactacgg

SEQ ID NO: 37951 - protein, 424 aa, Panicum virgatum
  misc_feature: Ceres CLONE 1991898
  misc_feature (253)..(313): Pfam Name: WRKY Pfam Description: WRKY DNA -binding domain
MEVAVERPTPVKEEKRADAKPEIAAMGSPLPIVFESFPSTQRDASIKQEQRTLEAAKAEMGEVREENERLKTMLSRIVSQYQLLHTHFLDVVKVHEQAAKAKLPAAPAPAASLPTGAADDADDLVSLSLGTRSNGARRKGHERSSSSSGGTAETTADQGQLSLGLGIAPGSGLSADDDKASGASAAPVLNLSSDSSSAGDAAKPPAQDDADACPPAGTSRKSPSAGEGADDEVQQQAKKARVSVRVKCNTPTMPDGCQWRKYGQKISKGNPCPRAYYRCTVAPHCPVRKHVQRCAEDTSILITTYEGQHNHQLPPAATAMASTTSAAAAMLTSGSTSSSSPASLAHGHHLPLAAAGLLGPTTMVSTAASCPTITLDLTTPAPPHSLMHPSPYAAAAAAGYESKAVPAAWSSGYLAYGAAPPSYY

SEQ ID NO: 37952 - DNA, 484 bp, Panicum virgatum
  misc_feature: Ceres CLONE 1991898-R
cttgggcacctgttcggcggcggcctggcgggtcgtccaggccggagcagctgtacggcgcccagacgtacttgcagaggacgagcagcctcggggccggccatggcgcggtggcgccggccgtcacggacacgctcgccaaggcgatcacgtcagacccgagcttccagactgcgctggtggcggcgatcacgtcgatcatggggcgcggcggaggcgccgccgcccagaagtgatcggcgcccgcacgcacgaattagattttgtgtagggcagtggttcatatgtaattaataagtgcatcgtggttaattactttgttgatcggattagttttgaagtttttagtagtcattggcttgggaagaaatggtgatcatatctatgtaacagggatgaaatgatcaatcggtgtacatagagcgggatgagtaaactgtatctaccatgaatgggtggaattaaaagtaaagaagttttgatc

SEQ ID NO: 37953 - DNA, 1885 bp, Panicum virgatum
  misc_feature: Ceres CLONE 1991908
  misc_feature: Encodes the peptide sequence at SEQ ID NO. 37954
gatttgcaagaagagggataggatttaggcagctggtaggtaggtttcagagagagagagagagagagagagggagagagagagagagaggagccagattgggtctcggataggtcataggagtcgagagagtggagtgagagagattggccgctgccagattctgaatctcctcctacaatccgtgctcccaccatcgctgtgtctcaggccagcctatcaagtcagtagtcagcataagaaaaatgagctcccagagtgttgctactggggagcagattattgctcctaaccaaatagtacacgcctgcacatccacacaaacttcagttcataagctgtttgatgctaaactggaccacgggttcttgatatatgacactttgtcatccacaagtcaatcatcaaacatcaagactgaattgatccggacatcgagcttgtcaaggagcctatcagttaaccttcagaaaagaagccctgaatctgatccagaaagcccgctgtctcacgtttcacatcccaaattttctgacccaatattgtcaaactcgtcaacgttctgcacaagtttgttttcttcgtcttcaaaaacacagatccatgccggcaaatgggcactttacctttcctgcctcaccctcctaagtgtgagcagcaggtttcagctgggcagtcatcgagctcctctcttctcttaagtggtgatactggcaatgctttagatgaagctggacagtcagatgatcttaaagattttctcaatctttctggagatgcttctgatgggagcttccatggagagaacaataccttggcttttgatgaacatatggaatttcagtttctgtctgagcagctgggaattgccatcactgacaacgaggaaagtcctcatttagatgacatatacggcacaccaccacaactgtcatcacttccagtgtcatcttgctccaaccagagtaaacagaatctagggtcaccagttaaagtccagcttagctcatctcggtcatcttctgactctgcaacaactaacaagtcgagattgaggtggacacttgagcttcatgagcgttttgtggaggctgtgaacaagcttgaaggaccagaaaaagcaactcctaaggctgtgctgaaacaaatgaaggtagaaggcctaacaatttatcatgtaaagagtcatctgcagaagtatcgacttgcgaaatatcttcctgagcctaaagaagacaagaaggcttcctctgaggataagaaagcacaattgggtagcagcagcagtgattccagcaaaactaagaatttacaagtagcagaagctctaaggatgcaaatggaggttcagaaacagcttcacgaacaattagaggtccaaaggcaattgcagctacggatagaggaacatgcaagatacttgcagaaaatactggaagagcaacagaaggctggcaacttgtcgatgaaagcgccaaccaaagcacaagcaggatcacctgagacgacttcaaaggagagaagcgaatctgagggaggcaccacttcgccgcggccatccaagaacagaaacccggacgtagacgcagaatgcaagtcgcctggagggagcaagagaacaaaggttcaggttgatcctgagagagtggccccgtgctcgtagccgtgcggccgaggccaatgactctctgaatgtttggcccccattctatcttctttcaggagctacttgctactgtctgtagcttgcacaaccgtagtatctctagactctagtcactgttgatatcttggcatgaattgtggaatgatgtttggtacggacttcaggtctttgccattgtatcatatagctccactttggaatggaaattggaagttaatg

SEQ ID NO: 37954 - protein, 349 aa, Panicum virgatum
  misc_feature: Ceres CLONE 1991908
  misc_feature (146)..(197): Pfam Name: Myb_DNA-binding Pfam Description: Myb-like DNA-binding domain
  misc_feature: Useful for making plants with modulated oxidative stress sensitivity
  misc_feature: Useful for making plants with altered lignin content
  misc_feature: Useful for making plants with altered terpenoid content
  misc_feature: The sequence is a functional homolog of SEQ ID NO 384 in the 10/374,780 US patent application
  misc_feature: The sequence is a functional homolog of SEQ ID NO 426 in the 10/225,066 US patent application
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MGTLPFLPHPPKCEQQVSAGQSSSSSLLLSGDTGNALDEAGQSDDLKDFLNLSGDASDGSFHGENNTLAFDEHMEFQFLSEQLGIAITDNEESPHLDDIYGTPPQLSSLPVSSCSNQSKQNLGSPVKVQLSSSRSSSDSATTNKSRLRWTLELHERFVEAVNKLEGPEKATPKAVLKQMKVEGLTIYHVKSHLQKYRLAKYLPEPKEDKKASSEDKKAQLGSSSSDSSKTKNLQVAEALRMQMEVQKQLHEQLEVQRQLQLRIEEHARYLQKILEEQQKAGNLSMKAPTKAQAGSPETTSKERSESEGGTTSPRPSKNRNPDVDAECKSPGGSKRTKVQVDPERVAPCS

SEQ ID NO: 37955 - DNA, 1483 bp, Panicum virgatum
  misc_feature: Ceres CLONE 1991923
  misc_feature: Encodes the peptide sequence at SEQ ID NO. 37956
agtccaccaacccgctgctccgtcctcgacccgacctgcacctcctctctcctgctccgacatgcacgcggctggccttcctaccccccgtcgcctgcttgtctcttcttcttcctcctccgaaccgcggccacgggtataaatgcgccgcgccctgccgtgttccagagagagacagagacggagagagcgagaggcggtctcgccgtgccgtgccgtgccgtgctcgcctgaccatctatcgcgttgccgaggccgccctgctaaatttggcagcgaattaatcagcagccagccattacttactgtctcactgcagttatattcctcaccggctgctggtggttggtcgtcaggctcggttcttgcaatgagcgacgtctccggccgcttcgtggtggccgcggccgtggtcgccgtgtcgctggcggcggcggcggcgtcagcggcgcacgactacggcgacgcgctgtccaagagcctgctctacttcgaggcgcagcggtcggggcggctgccgtacaaccagcgcgtgcggtggcgcggccactcggggctcaccgacgggctcgagcagggggtggacctcgtcggcgggtactacgacgccggcgaccacgtcaagttcggcctccccatggccttcaccgtcaccctcctctcctggggcgtcctcgagtacggcgccggcgtgtccgccgccggcgagctcgcgcacgcgctgcaggccatcaagtggggcaccgactacttcgtcaaggcgcacaccgcgcccaccgagctgtgggcgcaggtcggcgacggcgactccgaccactactgctggcagcggcccgaggacatgaccacctcgcgccgcgcctacaaggtggacgccgaccaccccggctccgaggtcgccgccgagaccgccgccgccatggccgccgcgtccctcgtgttccgccgcgccggcgacgcgcactacgcgcacctgctgctccaccacgcgcagcagctgttcgagttcgccgacaagttcagggggcgctacgacgagagcgtggaggtggtcaagagctactacccgtcgtccagcgggtaccaggacgagctgctgtgggcggcgctctggctgcaccgcgccaccggccgccgcgactacctcgactacgccctcgccaacgccgacgacttcggcggcaccggctgggccgtctccgagttcagctgggacatcaagtacgctggactccaggtcctggcatctgagctgctggtggaggcgaaggagcggcggctgcggctgagcccggagcagcgcgcggtggtggagcagctccgctccaaggcggagtactacgtgtgctcgtgcatgaaccagaaccccggcggcgccgagcacaacgccggccgcaccccggcggggctcctcttcatccgcccctggaacaacctccagtacgcctccggcgccgccttcctcctcaccgtctactccgac

SEQ ID NO: 37956 - protein, 370 aa, Panicum virgatum
  misc_feature: Ceres CLONE 1991923
  misc_feature (29)..(370): Pfam Name: Glyco_hydro_9 Pfam Description: Glycosyl hydrolase family 9
  misc_feature: SWISSPROT Homolog: EC 3.2.1.4 Cellulase
  misc_feature: Useful for making plants with altered carbohydrate content
  misc_feature: Useful for making plants with altered cell wall content and/or composition
  misc_feature: Useful for making plants with altered lignin content
MSDVSGRFVVAAAVVAVSLAAAAASAAHDYGDALSKSLLYFEAQRSGRLPYNQRVRWRGHSGLTDGLEQGVDLVGGYYDAGDHVKFGLPMAFTVTLLSWGVLEYGAGVSAAGELAHALQAIKWGTDYFVKAHTAPTELWAQVGDGDSDHYCWQRPEDMTTSRRAYKVDADHPGSEVAAETAAAMAAASLVFRRAGDAHYAHLLLHHAQQLFEFADKFRGRYDESVEVVKSYYPSSSGYQDELLWAALWLHRATGRRDYLDYALANADDFGGTGWAVSEFSWDIKYAGLQVLASELLVEAKERRLRLSPEQRAVVEQLRSKAEYYVCSCMNQNPGGAEHNAGRTPAGLLFIRPWNNLQYASGAAFLLTVYS

SEQ ID NO: 37957 - DNA, 587 bp, Panicum virgatum
  misc_feature: Ceres CLONE 1991923-R
  misc_feature: Encodes the peptide sequence at SEQ ID NO. 37958
cgacgtgctcgcgttcgccaagtcccaggccgactacatcctgggcagcaacccgatgcgcaccagctacctggtgggctacggcgcggcgtacccgcggcgggtgcaccaccgcgcggcgtcgagcgcgtcgttccggcacgaccgggacttcatcggctgcctccaggggttcgactcgtggtacagcgcgcggcgggagaacccgcacgacctcgtcggcgccgtcgtcggcgggcccaacggcgaggacgtcttcaccgaccaccgcggcaagtacatgcagacggaggcctgcacgtacaacacagcgcccatggtcggggtcttctccaagctcatgcagctggaggggcagcagccgcggcggcggcggccggaggaggccgggccggcgccggcggaggacctttgataggagaagggttcgattcctttcggaatttcgatggcatggcggaaaataaaaaaatcaaaagagcaaaaaaaaagtgatattgattaggatggatgtatacgagattcaattctttttgttgattcctagagaacagtgtttgtttcttgttttgcacagaaatggatcg

SEQ ID NO: 37958 - protein, 137 aa, Panicum virgatum
  misc_feature: Ceres CLONE 1991923-R
  misc_feature: SWISSPROT Homolog: EC 3.2.1.4 Cellulase
  misc_feature: Useful for making plants with altered cell wall content and/or composition
  misc_feature: Useful for making plants with altered lignin content
  misc_feature: Useful for making plants with altered carbohydrate content
DVLAFAKSQADYILGSNPMRTSYLVGYGAAYPRRVHHRAASSASFRHDRDFIGCLQGFDSWYSARRENPHDLVGAVVGGPNGEDVFTDHRGKYMQTEACTYNTAPMVGVFSKLMQLEGQQPRRRRPEEAGPAPAEDL

SEQ ID NO: 37959 - DNA, 658 bp, Panicum virgatum
  misc_feature: Ceres CLONE 1991934
  misc_feature: Encodes the peptide sequence at SEQ ID NO. 37960
acaaacgcaacaaactcgccccccgcagcacctcagctttgctctgctctcccctgctcctcttgccccatggcggcggacgcccccacccccaccctcacggcgctgctcaacaaggcggccgccgccttcccggcccgccgcgccgtctccgtcccgggcaagatcgagctcacccacgccgacctcgacgcgctcgtcgacgccgcggccgcgcgcctcgccgccgacgccggggtccgcccgggacacgtcgtcgcgctctccttccccaacaccatcgagctggtgatcatgttcctggcggtgatccgcgcccgcgccgtggcggcgccgctcaacccggcctacacccaggacgagttcgagttctacctctccgactccgagtcccgcctcctcatcaccaacgccgagggcaaccccgccgcgcaggccgccgccgccaagctcggcctgccccacgccgcagccaccctcaaggacgccgccggccccgtccacctcgccggcctgggctgcgcggccgccaacgggaacgggaacgcgaacggctcccactccaacaaacaagacgacaacaacgagccgtccgacgtggcccttttcctgcacacctccggcacgacgagccggcccaagggggtgccgctcacgc

SEQ ID NO: 37960 - protein, 196 aa, Panicum virgatum
  misc_feature: Ceres CLONE 1991934
  misc_feature: SWISSPROT Homolog: EC 5.1.1.11 Phenylalanine racemase (ATP-hydrolyzing)
MAADAPTPTLTALLNKAAAAFPARRAVSVPGKIELTHADLDALVDAAAARLAADAGVRPGHVVALSFPNTIELVIMFLAVIRARAVAAPLNPAYTQDEFEFYLSDSESRLLITNAEGNPAAQAAAAKLGLPHAAATLKDAAGPVHLAGLGCAAANGNGNANGSHSNKQDDNNEPSDVALFLHTSGTTSRPKGVPLT

SEQ ID NO: 37961 - DNA, 725 bp, Panicum virgatum
  misc_feature: Ceres CLONE 1991941
  misc_feature: Encodes the peptide sequence at SEQ ID NO. 37962
ggcgacagagcgcctccctctccctaccacccgctcggctcggcgctcgctcccaccacagaaatctcgccgctggtcactgatatctccctctccggcctccacgcccgccgcctgctcctccttgcctcctcttcctcgtcgcgaaaacaaaagggccgcgcctttgcctgcttctatagttcaggtagaagaggctcgtcctgtttatcatgtcaggaggatcaggggggtcttcaccaccatcaaggcggaccagctttaattctttatctcgagacctagaccttccttcagaacaagggtgtctctctattgttgtacttggggcttctggtgaccttgccaagaagaaaactttcccagcactctaccaccttttcgatcagggatttatacagtctggcgaagtgcatatatttggttatgctagatcaaatctttctgatgacgggttaagagaacgcattcgtggatatctcaaaggagccccggaagaagatctttcagaatttttgcaattgataaaatatgtcagtggttcttatgacaatggggagggatttgagaaattgaacaaggcaatatcagagtatgaggcgtcaagcaaatcagaaagctatcgcaggctcttttatttggcattgcctccatctgtctacccttcagtgtgcaaaatgatcagaacatactgcatgaatccatcttctcaccctggatggact

SEQ ID NO: 37962 - protein, 170 aa, Panicum virgatum
  misc_feature: Ceres CLONE 1991941
  misc_feature (36)..(166): Pfam Name: G6PD_N Pfam Description: Glucose-6-phosphate dehydrogenase, NAD binding domain
  misc_feature: SWISSPROT Homolog: EC 1.1.1.49 Glucose-6-phosphate 1-dehydrogenase
MSGGSGGSSPPSRRTSFNSLSRDLDLPSEQGCLSIVVLGASGDLAKKKTFPALYHLFDQGFIQSGEVHIFGYARSNLSDDGLRERIRGYLKGAPEEDLSEFLQLIKYVSGSYDNGEGFEKLNKAISEYEASSKSESYRRLFYLALPPSVYPSVCKMIRTYCMNPSSHPGW

SEQ ID NO: 37963 - DNA, 1744 bp, Panicum virgatum
  misc_feature: Ceres CLONE 1991965
  misc_feature: Encodes the peptide sequence at SEQ ID NO. 37964
acccagtcgatgggtcggacgggtgaccaccacgccgtcgacggccggctagaggcgctgctctccggcgccggcgagggcggctccgggccatgctggctccggcgcatggcggcggcggcggcgctggagctgcggctgctggcgcccctcgccgtgccggccgtggtggtctacatgctcatcatcgtcatgtcgtccaccacgcagatcgtctgcggccagctcggcaacgtccagctcgccgccgcctccctcggcaacaacggcatccaggtcttcgcctacggcctcatgctcgggatgggcagtgcggtggagacgctgtgcgggcaggcctacggcgccgagaagtacgagatgctgggcgtgtacctgcagcgctcgacggtgctgctcatggccaccgccgtgccgctcgccgccatgtacgcctcctcggagccgctgctcctgctgctcggccagtcgccggagatcgccggcgccgccgcggagttcgcctacggcctcatcccgcagatcttcgcgtacgccgccaacttccccatccagaagttcctgcaggcgcagagcatcgtggcgcccagcgcctacatcctggccgccagcttcgcgttccacgtgccgctcagctgggtcgccgtgtacgcgctgggcctgggcctgctcggggcctcgctcacgctcagcctcacgtggtgggtcctcgtcctggcccagttcgcgtacatcctgtggagcccgcggtgccgggacacgtgggccgggttcacatgggccgccttcgccgacctgccggggttcgccggcctgtccatcgcgtcggcggtgatgctggcgctcgaggtctggtacttccaggtgctcatcctcctcgccggcgtgctgccggacccgcaggtcgcgcttgacgcgctcactgtctgcacttcgatccagtcatgggtgttcatgatctctgtgggcttcaatgcagctgccagtgtgagagtagggaatgagctcggcgcgggcaaccccaggtctgccgcgttctctgcatggatggtcaccgctctgtcggccttcgtatcagcaatagctggtctcgtcactttcctgctgagggacaagctcagctacatcttcaccaccggcgaggtcgtctcgcgcgccgtagccgatctgtgccccttgctcgttgggaccatcgtgctctgcgggatccagcccgtgctgtcaggtgtggccgttggttgtgggtggcaagcaatggtagcgtacatcaacattggatgctactacttcatcggcatacccctcggtgtgcttcttggattcaagtttgactatggaatcaagggattgtggggaggcatgattgggggcaccctgatccaaacacttattctgatctggatcacgttgagaaccgactggaacaaggaggttgaggaagcgcggaaaagattagataagtgggacgacacaaggcagccccttctcgcaaacaaggagtgatgaactgatgatgtcacaagtcagctgtggatgaagaacccatatgctcaagttgatgcaaaatctttcagtcgacatcggcttctgccactgctatgatcgaccacgctgtccagagatgaactgatgtatagccttttcttcgagaacatgttctaattaggggctatttgtttcaagggactctttttagtccttgtgacatcaaaaggaatcttaatattttggagtatttgacagt

SEQ ID NO: 37964 - protein, 497 aa, Panicum virgatum
  misc_feature: Ceres CLONE 1991965
  misc_feature (51)..(211): Pfam Name: MatE Pfam Description: MatE
  misc_feature (272)..(435): Pfam Name: MatE Pfam Description: MatE
MGRTGDHHAVDGRLEALLSGAGEGGSGPCWLRRMAAAAALELRLLAPLAVPAVVVYMLIIVMSSTTQIVCGQLGNVQLAAASLGNNGIQVFAYGLMLGMGSAVETLCGQAYGAEKYEMLGVYLQRSTVLLMATAVPLAAMYASSEPLLLLLGQSPEIAGAAAEFAYGLIPQIFAYAANFPIQKFLQAQSIVAPSAYILAASFAFHVPLSWVAVYALGLGLLGASLTLSLTWWVLVLAQFAYILWSPRCRDTWAGFTWAAFADLPGFAGLSIASAVMLALEVWYFQVLILLAGVLPDPQVALDALTVCTSIQSWVFMISVGFNAAASVRVGNELGAGNPRSAAFSAWMVTALSAFVSAIAGLVTFLLRDKLSYIFTTGEVVSRAVADLCPLLVGTIVLCGIQPVLSGVAVGCGWQAMVAYINIGCYYFIGIPLGVLLGFKFDYGIKGLWGGMIGGTLIQTLILIWITLRTDWNKEVEEARKRLDKWDDTRQPLLANKE

SEQ ID NO: 37965 - DNA, 732 bp, Panicum virgatum
  misc_feature: Ceres CLONE 1991967
  misc_feature: Encodes the peptide sequence at SEQ ID NO. 37966
gaaaatccacacaaatggaagcatttcagaaaatggacagatttgctcagcttttctggccaacatcgatgaacacaaatatgtttcagtctggatttttggaaaatcttatagtctaccaccatggtctgtgagcatactaccagactgtgaaaatgtggcttttaatacagctagggttggtacacagacttcggtttttactgttgaatcagggtcccccagttattcaagtagacataagcctgggactctatcccttattggtggtccatatctctcaagtacttggtggacatctaaagagcctattggcaaatggggtgaaggcagctttgttgctcaggggatattagagcacttaaatgtgaccaaagacatctctgactacctttcatatactatgagtgtgaacatttctgacgaggatgttgcatattggaattccaaaggcgttcttccatcactaaccatagaccaaattcgtgatgtagcacgtgtatttgtaaatgggaagcttgcaggtagtatggttggtcactgggtctcgctgaatcaaccagttcatttggttcaaggacctaatgagttgatgttgttgtcagagattgttggcttgcagaactatggtgctttcttggagaaggatggagctggatttagaggtcaagtaaaacttactggcttatctaatggggatatcgacctcactaattcccctttggacatatc

SEQ ID NO: 37966 - protein, 243 aa, Panicum virgatum
  misc_feature: Ceres CLONE 1991967
  misc_feature: SWISSPROT Homolog: EC 3.2.1.23 Beta-galactosidase
  misc_feature: Useful for making plants with altered carbohydrate content
  misc_feature: Useful for making plants with altered cell wall content and/or composition
KIHTNGSISENGQICSAFLANIDEHKYVSVWIFGKSYSLPPWSVSILPDCENVAFNTARVGTQTSVFTVESGSPSYSSRHKPGTLSLIGGPYLSSTWWTSKEPIGKWGEGSFVAQGILEHLNVTKDISDYLSYTMSVNISDEDVAYWNSKGVLPSLTIDQIRDVARVFVNGKLAGSMVGHWVSLNQPVHLVQGPNELMLLSEIVGLQNYGAFLEKDGAGFRGQVKLTGLSNGDIDLTNSPLDI

SEQ ID NO: 37967 - DNA, 618 bp, Panicum virgatum
  misc_feature: Ceres CLONE 1991971
  misc_feature: Encodes the peptide sequence at SEQ ID NO. 37968
agggggacgcttgagaaaaaaaaaaaaaaactggccgaaggttacccaattccccaaaaaaaggggtctttggtctcccctctccgggtggcaagcttcctcccccctcccatttcccaccgcccccccccccccccccccctcccaacaacccctggaggaatggctctccatccacatccgcccggccgggatcccgggccgaaacccctggtgggaactggactggctccagcctgggattccacccgaagggccaaagccccgggaccagaccgttggaagaagggaagaagccttccaccccctcctccatgaaactggggccgggaaacctggcccccctggtggggtccttgatcttgaaccccctgggattgaagaagggaagactggcacctatcccccgctcctcccccccgaaccgctcctccatggcaaagaagaagccgcccaccaccttgcccgtggtccctaccccattgggaaggaaaatggtgacctggggcctgaccgccttaagaagcctggccaccactgcactggtctccagggcttcctcctcctccatggtggtggtggaagaaccggcttcgggcttggttccctcctccttga

SEQ ID NO: 37968 - protein, 205 aa, Panicum virgatum
  misc_feature: Ceres CLONE 1991971
  misc_feature: Useful for making plants with altered cell wall content and/or composition
GGRLRKKKKNWPKVTQFPKKRGLWSPLSGWQASSPLPFPTAPPPPPPSQQPLEEWLSIHIRPAGIPGRNPWWELDWLQPGIPPEGPKPRDQTVGRREEAFHPLLHETGAGKPGPPGGVLDLEPPGIEEGKTGTYPPLLPPEPLLHGKEEAAHHLARGPYPIGKENGDLGPDRLKKPGHHCTGLQGFLLLHGGGGRTGFGLGSLLL

SEQ ID NO: 37969 - DNA, 688 bp, Panicum virgatum
  misc_feature: Ceres CLONE 1991974
  misc_feature: Encodes the peptide sequence at SEQ ID NO. 37970
gccccgcagagacccctcgatcgagcccaagaagaatccagccggccgtgtcgcgccgagccaacaagcacacgcgcctcgccctccccagcgcacaccaaccacagcctcctcctcgccgccatgcagcagcagccgcgccgccgcgcctccccggccgcgtcgctctgacttgcggcgccgtcgtccgtcctctcgaccgtgctgccatctgtccgatcgatcgatccatgggggttcacctgcagctgctgaagaagcagccctcgtcggcgtcgctggagggctcgaggagcggggggtcgtcgccgccgatgccgcccaaggggtgcatggcggtgcgcgtggtggggcttggcggcggggaggaggaagaggaggagcggttcgtggtgccggtggggtacctgaagcacccgctgttcgtggcgctgctcaaggcggcggaggacgagtacggcttcgagcagaagggcgccatcaccatcccctgcggcgtcgaccacttccgccacgtccagggcatcatccaacaccagaagcaccaccaccacatctcatccggcttcgtctccggcgatggcggccaccatggccaccacaacaaccaccaccacttccacatagctgggtgcttccgcgcctgatgcgatgcgggtttcgagatctccagcggatgcatggatcc

SEQ ID NO: 37970 - protein, 138 aa, Panicum virgatum
  misc_feature: Ceres CLONE 1991974
  misc_feature (4)..(101): Pfam Name: Auxin_inducible Pfam Description: Auxin responsive protein
MGVHLQLLKKQPSSASLEGSRSGGSSPPMPPKGCMAVRVVGLGGGEEEEEERFVVPVGYLKHPLFVALLKAAEDEYGFEQKGAITIPCGVDHFRHVQGIIQHQKHHHHISSGFVSGDGGHHGHHNNHHHFHIAGCFRA

SEQ ID NO: 37971 - DNA, 652 bp, Panicum virgatum
  misc_feature: Ceres CLONE 1991999
  misc_feature: Encodes the peptide sequence at SEQ ID NO. 37972
aagaggagaggacaggaggtaggtagtttagtttgagaagccaaaggttgtctcactcccggaagaccacagaacaactctttggttactagaaatagaggcactgggactgaataccggtaaagctgccaaggatcccagcagtcaggaatgtgcagcctgcaagcagacatttcagtacaaaacaggaactgaacggatgatgtatcatcagcaacagctccacggtcataaccagcacctgtcctcaagatctggcttacctccggagaagcagtttctcctgcaaggaggaggagatgcaggtcttgtcctctccaccgacgctaaacctcggctgaaatggacacccgagctgcatgaacgttttgtggaggcagtacaaaagctaggagggccagacaaagctacgcctaaaacaatcatgaggatcatggggatccctggactcaccctgtaccatcttaagagccatctccagaaatacagacttagcaagaatctccagtcccaagctaatattggcaatgcaaagaatgtgttaggctgcagaacaggagcagacaaaccatgcgaagggaatggatcaccatctagtcatttgaacatggagccccagataataaacaggtcgatgcacataagccaagcc

SEQ ID NO: 37972 - protein, 150 aa, Panicum virgatum
  misc_feature: Ceres CLONE 1991999
  misc_feature (46)..(97): Pfam Name: Myb_DNA-binding Pfam Description: Myb-like DNA-binding domain
  misc_feature: Useful for making plants with modulated flowering time
  misc_feature: The sequence is a functional homolog of SEQ ID NO 1097 in the 11/479,226 US patent application
  misc_feature: The sequence is a functional homolog of SEQ ID NO 2402 in the 10/374,780 US patent application
  misc_feature: The sequence is a functional homolog of SEQ ID NO 548 in the 10/225,066 US patent application
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MMYHQQQLHGHNQHLSSRSGLPPEKQFLLQGGGDAGLVLSTDAKPRLKWTPELHERFVEAVQKLGGPDKATPKTIMRIMGIPGLTLYHLKSHLQKYRLSKNLQSQANIGNAKNVLGCRTGADKPCEGNGSPSSHLNMEPQIINRSMHISQ

SEQ ID NO: 37973 - DNA, 1468 bp, Panicum virgatum
  misc_feature: Ceres CLONE 1992003
  misc_feature: Encodes the peptide sequence at SEQ ID NO. 37974
gtaactcgatcccccagagtccagcttcttccccaagcccggccgctcgcgcgcgatccgaccgcgctcccgccgcgcctcgccgccggcgaccaaccccacaccccctcccgcgatgtcctcctccgtctctgtcgcggcggagtgggacctcctctccgaccgcttctaccgccgcctcacgctgtactcccctctcccctggtccgccccggcacccacctccaccgcctcctcctccggcgtcggcggtgcagtgatcggccgcctcgacctctccacccacatcgttgccgcagcgcccttcggcggtccgatcgccgccgtccgcgacgactctaagatcgtgcagctccactccgagccctcccggcgccgcctccttctcttctcctcctcgggctaccccatagcctccgccccctggccgcccatgctcccccgccttcactcgctctccttctccagctccctcagcctcatcgccctcctctcagatggctctctcctccgcttccgcctccccgatctgcagcccagccccagctccagccccgtgcccctactgccgccggcctctggaggcgtcgccgacgctgtattctggggcggcggtgtagccatcctcacagaggagaaccgcgttgtagtggccacggacatcgaagctgctgaccctcacccccgtgacctcgccgacccaggagttggtgatgaggagcatgttctatgcatggcagtggtggagccgcagtttgtcatgtcaggaagtccagaggtgctgcttgcggttggtgaccgggtgatcgcagtagatgaggatggtgtgcaggtgctcggggaggagcttgaaatcggacccgtgcagaagatggctgtgtcacccaacgggaagcttcttgcagcatttgcacatgatgggcgcctgctcgtaatccccaccgatttctccaggatcatattccagtatgagtgcgattcagcattgccaccggaacaaatagcttggtgtggactggacagtgtactcctctactggcctgaagtgcttttgatggttggtccgaatggagatcctgtgcagtacaattatgacgaacccataaaactcattcctgagtgcgatggtgtaagaatcctctcgaactcaagtatggaatttctacatcgagtcccggactgtactacattaatttttggcattggaagcatgtccccagcagcattattgtatgatgctcgagatcactacgacaggcaaagtgctaaggcttatgacaactatcagctaatatcatcttcattgccggaggcaattgaggcttgcattgatgctgctggccatgagtttgatgtttcacgccaacgcacgttgctaagagctgctacttatggcctagctttctgcagtcgatttccgcatgaacgctttcaagacatgtgcaaaatgttgcgagttctaaatgcc

SEQ ID NO: 37974 - protein, 344 aa, Panicum virgatum
  misc_feature: Ceres CLONE 1992003
  misc_feature (1)..(335): Pfam Name: Vps16_N Pfam Description: Vps16, N-terminal region
MLPRLHSLSFSSSLSLIALLSDGSLLRFRLPDLQPSPSSSPVPLLPPASGGVADAVFWGGGVAILTEENRVVVATDIEAADPHPRDLADPGVGDEEHVLCMAVVEPQFVMSGSPEVLLAVGDRVIAVDEDGVQVLGEELEIGPVQKMAVSPNGKLLAAFAHDGRLLVIPTDFSRIIFQYECDSALPPEQIAWCGLDSVLLYWPEVLLMVGPNGDPVQYNYDEPIKLIPECDGVRILSNSSMEFLHRVPDCTTLIFGIGSMSPAALLYDARDHYDRQSAKAYDNYQLISSSLPEAIEACIDAAGHEFDVSRQRTLLRAATYGLAFCSRFPHERFQDMCKMLRVLN

SEQ ID NO: 37975 - DNA, 697 bp, Panicum virgatum
  misc_feature: Ceres CLONE 1992003-R
  misc_feature: Encodes the peptide sequence at SEQ ID NO. 37976
tctgaagagcatgccaaattgctaagatcacagcatgaacttgaagtttccacaaagcaggcgatatttgtgggttctagtgttagtgataccataaaaacctgtattgcaatgggaaatgagcgagctgcactcaaagtgaagtcagaattcaaggttcctgataagaggtggtactggcttaaaacatgtgctttagctacagttggaaactgggatgcattggaaaagttttcaagagagaaacgaccaccaggaggctataaacctttcgtggaagcatgcattgacgctggtcaaaaaactgaagctctcaaatatattccaaagctaacagatcctcgtgaaagatctgaggcatatgcacggatgggcatggcaaaagaagctgccgatgcagcctcacaagctaaagatagtgacgagctcttcggccgcctgaagattacacttgcacagaacagtgctgccgcctccattttcgatacatttcgggatcggctttcttttcaaggagcatattgagctacgtgattgtgttgtaggtccaggctgcgcaccctgatgtttttaagaaggtcgagccttttgtttatccatttatttttcgcttttttttgtttacttgtgtatgaagaattaacctcggtgctaatacatgtgcagagattgcataacagaaattccccatagcgac

SEQ ID NO: 37976 - protein, 174 aa, Panicum virgatum
  misc_feature: Ceres CLONE 1992003-R
  misc_feature (1)..(167): Pfam Name: Vps16_C Pfam Description: Vps16, C-terminal region
SEEHAKLLRSQHELEVSTKQAIFVGSSVSDTIKTCIAMGNERAALKVKSEFKVPDKRWYWLKTCALATVGNWDALEKFSREKRPPGGYKPFVEACIDAGQKTEALKYIPKLTDPRERSEAYARMGMAKEAADAASQAKDSDELFGRLKITLAQNSAAASIFDTFRDRLSFQGAY

SEQ ID NO: 37977 - DNA, 683 bp, Panicum virgatum
  misc_feature: Ceres CLONE 1992008
  misc_feature: Encodes the peptide sequence at SEQ ID NO. 37978
tctatttttgcagaaaactaatataattagggactatttgtaagacataaatgagataccaaagtcccacatgttctggcctcgagagatatggagtaaatatgccaataaacttgaagatttcaaatatgatgaaaattcacaaaaggcagaacagtgcttgaacaatctaatgactaatgcattgattcacgctgaagactgcctcccgtacatgtcagccttgaacgatcatgccattttccgtttttgcgccatacctcacataatggcaattggaacatgtgctctttgctacaataatgtcaatgtctttaaaggagttctaaataagatacgtgagctcaccgcgcgagtgattgatgacaccaactctatgtcagacatctatactgctttctatgacttttcttcattgctggagacaaagattgacaacaatgatccaaatgctactctaacaccaaaacacctggattcaataaagaacacttgcaggtcatccggtttcctaacgagcacggagtaccatttggacaagtcaccttacaagcctattctgctcatgattgttcttctgctgatggctattatatttggggtactctatactaactgaatccttgctaattagcatttttcttcatgtggagactcaatagagcacctgctccagcatgatt

SEQ ID NO: 37978 - protein, 182 aa, Panicum virgatum
  misc_feature: Ceres CLONE 1992008
  misc_feature: SWISSPROT Homolog: EC 2.5.1.21 Squalene synthase
  misc_feature: Useful for making plants with altered sterol content
MFWPREIWSKYANKLEDFKYDENSQKAEQCLNNLMTNALIHAEDCLPYMSALNDHAIFRFCAIPHIMAIGTCALCYNNVNVFKGVLNKIRELTARVIDDTNSMSDIYTAFYDFSSLLETKIDNNDPNATLTPKHLDSIKNTCRSSGFLTSTEYHLDKSPYKPILLMIVLLLMAIIFGVLYTN

SEQ ID NO: 37979 - DNA, 1658 bp, Panicum virgatum
  misc_feature: Ceres CLONE 1992022
  misc_feature: Encodes the peptide sequence at SEQ ID NO. 37980
aaaacctcaagcaaaacagcaagccttctttctcgccaggcctcgcgtcgctggtttgggcgtttgcctggctgccactgcttcttcgaattgccttgtttctctctctgccccccccccccccccccggcctcctccctcgccaccgcaatgacgaagcacgccgccgaggacgcggccgtcgcggcgccggcgcagcccgggcgacggttcacgtcgtacccgccgtcgagctgcaggagggccgcggcgcaggggcgcatggacccccagggccacggggtcctggctcgacgccgtgccgcgccgcgccgagcacgacgacgactggatggagaagcacccgtcggcattggccgggttcgagtcggtgctggccgcggccaaggggaagcaggtcgtgatgttcctcgactacgacggcaccctgtcgcccatcgtcaaggaccccgacaccgccgtcatgaccgaggagatgcgcgacgcggtgcgaggcgtggcggagcacttcccgacggcgatcgtgagcgggaggtgcagagacaaggtgttcaacttcgtgaagctggcggagctgtactacgccgggagccacggcatggacatcaaggggcccacgccggagtccaagcacgccaaggcaaaggccgaagctgttctgtgccagccggcgagcgagttcctgcccgtcatcgacgaggtgtaccgcgcgctgacggccacgacggcagccatccccggcgcgacggtggagaacaacaagttctgcctctccgtccacttccgctgcgtccaggaggagaaatggagtgctttggaggagcaagtgcggtcggtgctcaaggagttcccggacctccggctcaccagaggcaggaaggtcttggagatccgaccctccatcaagtgggataaggggaacgcactccagttcttgctggaggctctcggctttgcggacagtaacaatgttttcccgatctatataggcgacgatcgcactgatgaggacgcgttcaaggtgctgcgtgacatgggacaagggatcggaatcctcgtgtccaagatccccaaggagaccagcgcatcctactccctgcgcgaaccttccgaggtgaaggagttcctgcacaagctggtcaagtccaagcagagcaccacgcagcgggactaaccatggttcaattcgcaggcgacaagctagagctaacggaggtccaatccatgcgctgatcgcccccaacgggcgagaagcttgcaatgacaatctcaggcttgatcggatcgtccatggccgcggtgacacggcttaattaacttatgaccagacattaaagtactcccagatttaactaccgcgattgccaggaaaggtttttttattaattttttgatgagaggagaatagagagaccatggccatgggtagaggaagtctagagtggagccgccagagccatgccaaagacagctcccggagatcggctattgggccacgtggcggcttctagccttctataggtgggatgctgggtctccaacgtcggtcggtgtgtgagtgcgggagcgcacgttttgggcccatgggcctgctttgttctttaaagggctgttggtccgcattcaattttagcccaatacatttctgctatctgttc

SEQ ID NO: 37980 - protein, 280 aa, Panicum virgatum
  misc_feature: Ceres CLONE 1992022
  misc_feature (26)..(260): Pfam Name: Trehalose_PPase Pfam Description: Trehalose-phosphatase
  misc_feature: SWISSPROT Homolog: EC 3.1.3.12 Trehalose-phosphatase
  misc_feature: Useful for making plants with modulated drought sensitivity
  misc_feature: Useful for making plants with modulated flowering time
  misc_feature: Useful for making plants with modulated low light sensitivity
  misc_feature: The sequence is a functional homolog of SEQ ID NO 16 in US patent 7214858
  misc_feature: Useful for making plants with modulated water use efficiency
MEKHPSALAGFESVLAAAKGKQVVMFLDYDGTLSPIVKDPDTAVMTEEMRDAVRGVAEHFPTAIVSGRCRDKVFNFVKLAELYYAGSHGMDIKGPTPESKHAKAKAEAVLCQPASEFLPVIDEVYRALTATTAAIPGATVENNKFCLSVHFRCVQEEKWSALEEQVRSVLKEFPDLRLTRGRKVLEIRPSIKWDKGNALQFLLEALGFADSNNVFPIYIGDDRTDEDAFKVLRDMGQGIGILVSKIPKETSASYSLREPSEVKEFLHKLVKSKQSTTQRD

SEQ ID NO: 37981 - DNA, 662 bp, Panicum virgatum
  misc_feature: Ceres CLONE 1992028
  misc_feature: Encodes the peptide sequence at SEQ ID NO. 37982
gagagcagtgtcgctctgccaactcgatctagctcgcgtctgccgcgggggatggccggcatcctgccgaggttcgggccgttcggccctctgccgccgtcgtacgatgagttcgggatcaaggagacgaggccccgcctcgccggcggccgggccggcgggtacgacctcgtggagcggatggagtacctgtacgtgcgcgtcgtcaaggcgcgggacctcaggtggggcgccggcgatctcgacccgttcgccgaggtgaagctcgggggccactcctgcgcgacgcggcacatcgataagacggcgagccccgagtggaacgacgtgttcgccttctcgcgggagcggatccaggcgtcgttcctggacgtggtggtccggggcaggggcttcgccaaggacgactacgtcgggcaccgccgcttcgacctgggcgacgcccccctgcgcgtgccccccgacagcgcgctcgcgccgcagtggtaccacgtcttcgacagcaagggcgagcgcgcaggggaggtgatgctggccgtgtggttcggcacgcaggccgacgagtgcttcccgctggccgtgcacgcggacgccgcgcttgccgtggacgccaagctcgccgcgcacacatccgctgcaagcagtacaccgtgccgcgcctg

SEQ ID NO: 37982 - protein, 203 aa, Panicum virgatum
  misc_feature: Ceres CLONE 1992028
  misc_feature (47)..(125): Pfam Name: C2 Pfam Description: C2 domain
MAGILPRFGPFGPLPPSYDEFGIKETRPRLAGGRAGGYDLVERMEYLYVRVVKARDLRWGAGDLDPFAEVKLGGHSCATRHIDKTASPEWNDVFAFSRERIQASFLDVVVRGRGFAKDDYVGHRRFDLGDAPLRVPPDSALAPQWYHVFDSKGERAGEVMLAVWFGTQADECFPLAVHADAALAVDAKLAAHTSAASSTPCRA

SEQ ID NO: 37983 - DNA, 1494 bp, Panicum virgatum
  misc_feature: Ceres CLONE 1992029
  misc_feature: Encodes the peptide sequence at SEQ ID NO. 37984
ctcctcgcacccacctccattggcggtggcggcgatgacaactcaaacccctcctcctcctcccgcctccaactattagccgccacggcccgcgctctcgagctcggctacgccgccgtcgctctcgaccacccccaccgcggtctcctcgccgactccaaccgctgccgcacccaacctttcccggccctctcctccctcccactcccgtcctccgccgctctccatcgccgccgcctcgcctcccctgcctctgagcccttccgccagtacacccgcatcaccctctccctcgactccgctgccgccgccgcttccgccctcgctccctctgctgcccgcctcctccgcacctacgacctcgtcgcagcccgtcccctcacccaggccgccttcgaccacctctgccaggcccccctctctgcccaacaccttgatctcatctccatcgacttctcctcccacagcaacctgcccttccgcatcaagctccccatgctcaagcttgcgctgcaaaaggggctgcattttgagattgcctactccccactcatttctactgacatcaatgccaagagaaacctcttagctcaagtcaagctcttggtggattggactaaaggaaagaatctcgtcatatcaagcgctgctcatactccttctcaactcagagggccctatgatgtcatcaatctatctgcttatttgcttggcgttcccatcaaccgagcaaaagctgcaatgtccacaaactgcaggtcacttgttttgaaggctctgaggaagaaacatttctacaaagaaacaattagagtcgacagattgttaccaaatgaacagttgagttcaacaaaattcaagcttgctgattggattgcttggaattctgtattatctgaaggaggggtaaatcacctggaaccttcttctaacattgatgaacgtcctggttcacccatatgtggtgtaatgggagggtcacatgaaaaacctcacagttctgatgtgtctgtattagccaaacagtcagaagaatctaatgatcaagcacaaatcccatctcaaacccaagaagaaacactacaaattgacagaactgaagttctaacagattgcagccagtatatcttgccaacatctttcaattatcaaaatgccgttcttgcgaaggctggaaatagtgaagttgttccggatccttccgtccagactggtccaggttgttctgctagtacaaaaggcgtagtgaagcatgtcaaatttgtgaaggatgcaatggaagtagatggaacagaatcatgcagtcttgttgtgggtgacaatattccttcaacttgcggtactagtatcaagttagcatgctctgctcttccccatggtgtagatctttctggctctaatctcgaggatcatggtccttgccaatctagtgaaatcctagccaatggtaaatcttataccaactatcgcactgattgcgccagtggtgagagg

SEQ ID NO: 37984 - protein, 497 aa, Panicum virgatum
  misc_feature: Ceres CLONE 1992029
  misc_feature (91)..(251): Pfam Name: RNase_P_p30 Pfam Description: RNase P subunit p30
  misc_feature: SWISSPROT Homolog: EC 3.1.26.5 Ribonuclease P
LLAPTSIGGGGDDNSNPSSSSRLQLLAATARALELGYAAVALDHPHRGLLADSNRCRTQPFPALSSLPLPSSAALHRRRLASPASEPFRQYTRITLSLDSAAAAASALAPSAARLLRTYDLVAARPLTQAAFDHLCQAPLSAQHLDLISIDFSSHSNLPFRIKLPMLKLALQKGLHFEIAYSPLISTDINAKRNLLAQVKLLVDWTKGKNLVISSAAHTPSQLRGPYDVINLSAYLLGVPINRAKAAMSTNCRSLVLKALRKKHFYKETIRVDRLLPNEQLSSTKFKLADWIAWNSVLSEGGVNHLEPSSNIDERPGSPICGVMGGSHEKPHSSDVSVLAKQSEESNDQAQIPSQTQEETLQIDRTEVLTDCSQYILPTSFNYQNAVLAKAGNSEVVPDPSVQTGPGCSASTKGVVKHVKFVKDAMEVDGTESCSLVVGDNIPSTCGTSIKLACSALPHGVDLSGSNLEDHGPCQSSEILANGKSYTNYRTDCASGE

SEQ ID NO: 37985 - DNA, 504 bp, Panicum virgatum
  misc_feature: Ceres CLONE 1992029-R
cggtccatggtcaggaaatcagcttaactagttatcaaagaagtactgatgcaagttgtgaaagtgacaagctgaaagaactaaagtctgaggaaacaaatgtttctttggagagaagtgttgctaaaacacatgagctactaccaaaatattctcatccaagtggtaaggttgagatgcccacaatcagatcagaaaagcgaagacataaactaaggccgtaccgtccagcttatcttcctttcttgggcttccttaggtctgtgcatttcaataagaaaatatgcaaagtaagagggctgatcaaacacccgtgaggttttatttcactttgataggaatgtggtgtcacttaccatccctgaatcattatgtaacaagggaaaattgaagaatttcccattgaaaaatttcagtttcaagtttcaacctcacatgaaactcttttaccatcagttgtattgttgttgtatctatggaaaatagtcatacctgagaggtggg

SEQ ID NO: 37986 - DNA, 684 bp, Panicum virgatum
  misc_feature: Ceres CLONE 1992030
  misc_feature: Encodes the peptide sequence at SEQ ID NO. 37987
accacccccacctccgccggctcctgccaccgcccgctggcatagcgcgtaggccgcgagaggagcaccggcgggccgcaggtaggggccaggggtgagggagaccaggggggcgcgggggatctcggtgcgcgcgcgtttgcggcgcaggcggcatgaagctcccgctgtggccggggctggcgcccgcggcggggccgcccgacgcggcgccggagccggccaagccgtcgctgccggccgcgtggctgctgctgcacgcgctcttctgcgccacctccatggccgtgggcttccgcttctcgcgcctcatcgtctacctcctcttcctgccgacgccgcccatcaacccggccgcgcacctcgtctcgctcgtgtccccgcccgtcatgctcgccgccggcaacgccacggccacggccacgatcaccaccaccaccaccaccaccaccaccaccgtcaccaccaccaccacggtcgccgccgagatcggggcccacccgcaccaccaccaccacggccccgtcttcgtggggcgccacccgatccgcgtccgcccgtggccgcacccggaccccaacgagctgctcaaggcccaccgcatcctcgccgccatccagaacgcgcagcgcaccagcaagcgccgcggcgccgagccgccgaggcccgtcattgccgtcaccc

SEQ ID NO: 37987 - protein, 176 aa, Panicum virgatum
  misc_feature: Ceres CLONE 1992030
  misc_feature: Useful for making plants with altered carbohydrate content
MKLPLWPGLAPAAGPPDAAPEPAKPSLPAAWLLLHALFCATSMAVGFRFSRLIVYLLFLPTPPINPAAHLVSLVSPPVMLAAGNATATATITTTTTTTTTTVTTTTTVAAEIGAHPHHHHHGPVFVGRHPIRVRPWPHPDPNELLKAHRILAAIQNAQRTSKRRGAEPPRPVIAVT

SEQ ID NO: 37988 - DNA, 1203 bp, Panicum virgatum
  misc_feature: Ceres CLONE 1992032
  misc_feature: Encodes the peptide sequence at SEQ ID NO. 37989
accacccgccgggtccgcattgcgccaagccctccggctccgtcgcgagtgcgtgccgagagaggagatggccactcaggcgcccgcgcccagcgcctgcatcgctgctcccggcggcgtcgacggccgcagcggcttctgcgaggccaccaggacgttccgcagcctgcggccgccggtgccgctgccgccgaaggacgccccgctctcgttcacggcgttcgccttctctctcctgccgtcgtccccgccccccgagcacccggccctcctcgacgccgccaccggcgaggccgtgccgttcccggcgttccagcgccaggtgcgcgcgctcgcgggggccctgcgctcgcggctcgggctccgccgcggcgacgttgcgttcgtgctcgcgccggcgcggctggacgtccccgtgctctacctggcgctgctctcgttcggcgccgtcgtgtcgccggccaacccggcgctcaccgccgccgaggtcgcccgcctcgtcgcgctgtccaaggcgtccgtcgccttcgccgtgtcgtcgaccgccgccaaggtgccggccggcctccccwyygtsctcctcgrttccgaccaattccgttccttcctgcgcccggaaggsggcggggaggggctgccgccggagacggtggcggtgcgccgatcggagacggccgcgatccagtactcatcatgcaccagcgggcgggtgaaggcggcggcgctgtcgcaccggaacttcatcgcgatggcggcggggtcccacgccctgtccccaaagccgaggcatggcggctgcgacaggatgctcctgaccgcgcccatgttccactcgctggggttctacttcgcgctcaaggccgtggcgctggggcagacgacggtgctggtgaccgacgccgtggcgcggcgcggcgtgaaacgggtggtggaggcggcggagaggtgggcggtcatcgagatgacggcgtcgccgccggtggtgatggccatggcgaacgagccgtgcgtcctgcaggccctggggcgggttggtgtgcggctgctcgccgctgccgacaacggcagcggacaggttccggcgactgttccccaacgtggatctctgcatgggctacggctcaagctgacgctggtggcatatcactgatgatcggtcgggaagagtgcaaccgcttcggctccgccggccgtgtctcgaag

SEQ ID NO: 37989 - protein, 360 aa, Panicum virgatum
  misc_feature: Ceres CLONE 1992032
  misc_feature: SWISSPROT Homolog: EC 6.2.1.12 4-coumarate--CoA ligase
  misc_feature (169)..(169): Xaa is any aa, unknown, or other
  misc_feature (173)..(173): Xaa is any aa, unknown, or other
MATQAPAPSACIAAPGGVDGRSGFCEATRTFRSLRPPVPLPPKDAPLSFTAFAFSLLPSSPPPEHPALLDAATGEAVPFPAFQRQVRALAGALRSRLGLRRGDVAFVLAPARLDVPVLYLALLSFGAVVSPANPALTAAEVARLVALSKASVAFAVSSTAAKVPAGLPXVLLXSDQFRSFLRPEGGGEGLPPETVAVRRSETAAIQYSSCTSGRVKAAALSHRNFIAMAAGSHALSPKPRHGGCDRMLLTAPMFHSLGFYFALKAVALGQTTVLVTDAVARRGVKRVVEAAERWAVIEMTASPPVVMAMANEPCVLQALGRVGVRLLAAADNGSGQVPATVPQRGSLHGLRLKLTLVAYH

SEQ ID NO: 37990 - DNA, 737 bp, Panicum virgatum
  misc_feature: Ceres CLONE 1992033
  misc_feature: Encodes the peptide sequence at SEQ ID NO. 37991
acctcggttctccccttcgctcaatttctctccctcccggtcctccacaccccgcgccccccctcccgccatttcactccccgctccccgacccaaaccccccctccgctcccaaaccctaaccctagccggcgccccgtcggaccgacgatgccgaaggccggcggcggcgcggcggacgaggaggagttccgcgccgaggtcgaggagcgcctcatcaacgaggagtacaagatctggaagaagaacacacccttcctctacgacctcgtcatcacgcacgcgctcgaatggccctccctcaccgtccagtggctccccgaccgcaccgagccgccggggaaggaccactccgtccagaagatgatcctggggacgcacacctccgacaacgagcccaactacctcatgctcgcgcaggtccagctgcccctcgacgacgctgaggccgacgcgcgccactacgacgacgaccacgccgacatcggagggttcggcgccgcatccggcaaggtgcaaattgttcagcagataaatcatgatggagaggtcaatcgagctcggtacatgccccaaaattcatttataattgctaccaagacagttagtgcagaagtatatgtgttcgactatagcaagcacccatcaaagcctccactagatggtgcatgcaaccctgatttacggctgaagggacataactctgaaggatatggcttatcctggagtattttaaa

SEQ ID NO: 37991 - protein, 195 aa, Panicum virgatum
  misc_feature: Ceres CLONE 1992033
  misc_feature: SWISSPROT Homolog: EC 2.3.1.48 Histone acetyltransferase
MPKAGGGAADEEEFRAEVEERLINEEYKIWKKNTPFLYDLVITHALEWPSLTVQWLPDRTEPPGKDHSVQKMILGTHTSDNEPNYLMLAQVQLPLDDAEADARHYDDDHADIGGFGAASGKVQIVQQINHDGEVNRARYMPQNSFIIATKTVSAEVYVFDYSKHPSKPPLDGACNPDLRLKGHNSEGYGLSWSIL

SEQ ID NO: 37992 - DNA, 718 bp, Panicum virgatum
  misc_feature: Ceres CLONE 1992047
  misc_feature: Encodes the peptide sequence at SEQ ID NO. 37993
aaagctttatactaatcaaagaaaataaggtcataaaatgggaagaagacccgctagatgctacagatactggggtggcaagcctttccccaagtctcgttataacagaggtgtccccgatgccagaatcagaatttatgatgccggtaaaaagaaggctgaagtcgaagaattccccttctgtgttcacctcgtttctctcgaaaaggaacaaatctcctccgaagccatggaagctgctcgtgttgctgccaacaagtacttgatcaagaagtgcggtaaggaaggtttccatcttagatgcagagttcacccttggcacgttctcagaatcaacaagatgctttcctgcgccggtgccgatagactccaaactggtatgagaggtgccttcggtaagcccgttggtaaagtcgccagagttaagattaaccaaatcctctactccgtcagacttaacgaaaagaacgttccccatgctgttgaagctttcagaagaggtaaattcaagttccccggtagacagaaggtcgtcgtctccggcaagtggggtttcaccaagcttgaccaagctgaatacaccagacttaaggaagaaggcttgctcagaaaggatggttccaacgttaaggtcatcaccaaccatggtcccctctccgccttgttgggcgtttaaaccgattaaagcatcgcttctctgtatcgggtgagtttctcc

SEQ ID NO: 37993 - protein, 212 aa, Panicum virgatum
  misc_feature: Ceres CLONE 1992047
  misc_feature (5)..(167): Pfam Name: Ribosomal_L16 Pfam Description: Ribosomal protein L16
MGRRPARCYRYWGGKPFPKSRYNRGVPDARIRIYDAGKKKAEVEEFPFCVHLVSLEKEQISSEAMEAARVAANKYLIKKCGKEGFHLRCRVHPWHVLRINKMLSCAGADRLQTGMRGAFGKPVGKVARVKINQILYSVRLNEKNVPHAVEAFRRGKFKFPGRQKVVVSGKWGFTKLDQAEYTRLKEEGLLRKDGSNVKVITNHGPLSALLGV

SEQ ID NO: 37994 - DNA, 730 bp, Panicum virgatum
  misc_feature: Ceres CLONE 1992055
  misc_feature: Encodes the peptide sequence at SEQ ID NO. 37995
atcaaactcacccaactcaaattcattcaaacaacattatattatcctcccattcaaataagctaagaagcgcgtttgtaacaaaataaataagcgatttcattagtagttgtagcataacataacataagatgggtattgaaagaggaggactaaagagttttcgaagcggctggagtgtgccacctaagctatgtgattcttgcaagcttactcccgccgcgcttttttgccgttctgattctgcatttctatgcatcaactgtgattccaccattcactctgctaacaaactctcttcccgccacgagcgcgtctggatgtgtgaagtttgtgaacaagcaccagcttccgtcacgtgcaaagctgacgcagctgctctatgcgtcacgtgcgattccgacatccactccgccaatccactcgctcgtcgtcacgaacgtgttcccgtcgagcctttctttgactccgctgaatccgtcgtcaaatcctccaccgccgctgctgcagcagccgcgtctttcaatttcgttgttcctactgacgacggttacggtcaagatgatgctgaagcagctgcgtggctgattccgaatcctaatttcggatccaaactcaatgaaactcaagatatcaaaactagagagatgttcttctctgatatggatccatttcttgattttgattactcaaacaatttccagaacaatattaactgcagcaacgccat

SEQ ID NO: 37995 - protein, 199 aa, Panicum virgatum
  misc_feature: Ceres CLONE 1992055
  misc_feature (65)..(107): Pfam Name: zf-B_box Pfam Description: B-box zinc finger
  misc_feature (17)..(64): Pfam Name: zf-B_box Pfam Description: B-box zinc finger
  misc_feature: Useful for making plants with altered lignin content
  misc_feature: Useful for making plants with modulated cold sensitivity
MGIERGGLKSFRSGWSVPPKLCDSCKLTPAALFCRSDSAFLCINCDSTIHSANKLSSRHERVWMCEVCEQAPASVTCKADAAALCVTCDSDIHSANPLARRHERVPVEPFFDSAESVVKSSTAAAAAAASFNFVVPTDDGYGQDDAEAAAWLIPNPNFGSKLNETQDIKTREMFFSDMDPFLDFDYSNNFQNNINCSNA

SEQ ID NO: 37996 - DNA, 728 bp, Panicum virgatum
  misc_feature: Ceres CLONE 1992077
  misc_feature: Encodes the peptide sequence at SEQ ID NO. 37997
acggtacagggggacgggaggggagaggactagggggcaagtgaggagtcgccaggaagcaaccgcgaggaaggaggcagcagcagcaacgagcaccggcagcactgcagcagcgcggagagagagagaaaaaaaattcctgttggctccgtgagctttgggtgctcgcgtgcccgagcttcgcctccgatcgccgcgctacgggggtgcgccggatggagccgtacgcggctgcgaaggagggaggcaggggcggcgacgccagcaccggcttggaagagccgatgcggaggctggggctcggcggggacggggaggcgggggacgcgaagctgccggagcggccgggcgaggcggactgcgcctactacctccgcaccggcgcctgcggctacggggagcgctgccgctacaaccacccccgcgaccgcgatcgggccaccccggttaatggagttggaaggaccgcaggtgcggttgagtaccctgagcgaccgggacagccactgtgtgagtactatgcaaagaatgggacctgtaaatttggttccaattgcaagtttgatcatcccagggaaggtggttttgcacctgtggcattaaacagcagtgggttccctcttcgtcagggtgaaaaggaatgttcctattacatgaaaactgggcattgcaagtttggaggtacatgtaaattccctcacccagaacttgggtattctctcagagac

SEQ ID NO: 37997 - protein, 170 aa, Panicum virgatum
  misc_feature: Ceres CLONE 1992077
  misc_feature (94)..(120): Pfam Name: zf-CCCH Pfam Description: Zinc finger C-x8-C-x5-C-x3-H type (and similar)
  misc_feature (44)..(70): Pfam Name: zf-CCCH Pfam Description: Zinc finger C-x8-C-x5-C-x3-H type (and similar)
  misc_feature (138)..(164): Pfam Name: zf-CCCH Pfam Description: Zinc finger C-x8-C-x5-C-x3-H type (and similar)
  misc_feature: Useful for making plants with modulated nitrogen use efficiency
  misc_feature: Useful for making plants with modulated low light sensitivity
MEPYAAAKEGGRGGDASTGLEEPMRRLGLGGDGEAGDAKLPERPGEADCAYYLRTGACGYGERCRYNHPRDRDRATPVNGVGRTAGAVEYPERPGQPLCEYYAKNGTCKFGSNCKFDHPREGGFAPVALNSSGFPLRQGEKECSYYMKTGHCKFGGTCKFPHPELGYSLR

SEQ ID NO: 37998 - DNA, 556 bp, Panicum virgatum
  misc_feature: Ceres CLONE 1992084
  misc_feature: Encodes the peptide sequence at SEQ ID NO. 37999
cttccgtttttattctctgcttggcgctggcctcgcgccgccagggtgcgggcctagcctaccaggagctgcacgagaagaaaagggagaggaaaccagagcgagttcttctcgggtcggggctcgggcatcgccattggctggggctcgtccctcgctccgggcttttgcgtcctcccgctagctagctactccaggaagacgcgtcagccccgagcttcttgggagagaataaaccacgctggacggcagcatgactggcggcggcacgcgcgacaaggccgggaggggcggcggaaagctgcagccgccgctgcgcctggagtcgcatcaggtcacgccgctgtccatcgtcgtcggctgcttcgtcatctgcctcgccttcctcctctcctcccgcccctacgccaccgccttccacaccgtgagccccagggcgtcgctggagggcgcgcgcccgccaccggccgccttcaagaccctccgaacctcctccaccgcctgcggcggtggggatttctatgtggacattcggtcgcagcagaagcaggggggg

SEQ ID NO: 37999 - protein, 100 aa, Panicum virgatum
  misc_feature: Ceres CLONE 1992084
  misc_feature: Useful for making plants with altered carbohydrate content
MTGGGTRDKAGRGGGKLQPPLRLESHQVTPLSIVVGCFVICLAFLLSSRPYATAFHTVSPRASLEGARPPPAAFKTLRTSSTACGGGDFYVDIRSQQKQG

SEQ ID NO: 38000 - DNA, 670 bp, Panicum virgatum
  misc_feature: Ceres CLONE 1992090
  misc_feature: Encodes the peptide sequence at SEQ ID NO. 38001
ctctctcttcccagtccgctcggccaccagctttgaccgcctcctccgctcccccccgctcctgctcctccctatcccactcccccgcaggagcggcggcgcggcggcggcggctaggcgtatccctcacctcggagaagagtggcaccagcggcggcaagatgttcggacgcgcgccgaagaagagcgacaacaccaagtactacgagatcctcggggtgcccaagaccgcgtcccaggacgacctcaagaaggcataccgcaaggccgccatcaagaaccaccccgacaagggcggagatcccgagaagttcaaggagcttgcacaagcttatgaggttttgagtgatccagagaagcgtgagatttatgatcaatatggtgaagatgccctcaaggaaggaatgggtggaggaggatcccatgctgatccatttgacatcttctcatcattctttgggccctcttttggaggtggtggtggcagcagcagaggcagaaggcaaaggaggggagaagatgtagtgcatccacttaaagtttctctggaagatctttacaatggtacctcaaagaagctctccctttcgcgcaatgtcatctgctcgaagtgcaagggcaagggctccaaatctggtgcttcaatgaggtgcccaggttgccagggttc

SEQ ID NO: 38001 - protein, 169 aa, Panicum virgatum
  misc_feature: Ceres CLONE 1992090
  misc_feature (13)..(71): Pfam Name: DnaJ Pfam Description: DnaJ domain
MFGRAPKKSDNTKYYEILGVPKTASQDDLKKAYRKAAIKNHPDKGGDPEKFKELAQAYEVLSDPEKREIYDQYGEDALKEGMGGGGSHADPFDIFSSFFGPSFGGGGGSSRGRRQRRGEDVVHPLKVSLEDLYNGTSKKLSLSRNVICSKCKGKGSKSGASMRCPGCQG

SEQ ID NO: 38002 - DNA, 1338 bp, Panicum virgatum
  misc_feature: Ceres CLONE 1992097-R
  misc_feature: Encodes the peptide sequence at SEQ ID NO. 38003
acgccaagaccaacaaataaagaaacgaaatcaccggagtcttcttcttctactactatttctagccattttattatctggatgtatgcacagatgcatgtagataggtagaagaaagaagattatagctagagaggtactcgctgcttggctgctgggcaggcgagctacagcaaagaagaagattgggagtgaggagccgcgggcatggaggatctgtacagcatccacccggggatctcgcgcgccgggggcggaggcgccgccgccgcggccagcgaggcgtcaggtgtcgccggcggagcgggctcgcccccaccgcccccgccgcagccttccccgccggcggcggatctgacggagcttgtcaaggcgcagatcgccgggcatccgcgctacccatccctactctccgcctacatcgagtgccgcaaggtgggcgcgccgccggaggtggccacgctgctggaggagatcggccgggagcggtgcgccgccgcggccgccggcggggaggtcggcctggaccccgagctcgacgagttcatggaggcctactgcggcgtgctggagcgctacaaggaggagctgtcgcggccgttggacgaggcggcgtccttcctcagcagcatccggacgcagctcagcaccctctgcggcggcgccgcctcgctctccggtagccccccggccgctcgcttgcatctcccctcccttcctcctcctgcaggtgggcaaggcagcaagtacgagctgccatcgccattgcggacatggcatgcatctgtgcagtgcattgtagggggccgtgggtagaggagtgtggctagctagctatgatgaatgcgtagctatgatgaatgcgtgtgcgtgtgcgtgtgcgtgtgcgtgtgtggtcaaatcgtgtccatgcaaatggggtgcaggggtgtcagacgccggggtcggatgagtaaagttctgggcgtgtgccagctcgctcgtgttgtgtactcgtagggtttttgtccaaggttcctgtaacgaagcaccatggctttgcctttgcatctctctcatgtagtcatgtgcagagagagagcgagcgagcgagcgcgcatggaggtagctggtgcttgtaggcctttgtaggctggctctgatgagtgatggaacttgagagggtgctgcgcgctgatgggtagtgacactgcttggatggctttggggaaagagaatcttgctcgtgttgctggatagttaccagtggtgaaaatttcttgtcgtggggcagctcaagtttttgctctggatactggcttggctttccttgaaaatatatcgtatgatttctgatgc

SEQ ID NO: 38003 - protein, 202 aa, Panicum virgatum
  misc_feature: Ceres CLONE 1992097-R
  misc_feature (100)..(151): Pfam Name: KNOX2 Pfam Description: KNOX2 domain
  misc_feature (52)..(96): Pfam Name: KNOX1 Pfam Description: KNOX1 domain
MEDLYSIHPGISRAGGGGAAAAASEASGVAGGAGSPPPPPPQPSPPAADLTELVKAQIAGHPRYPSLLSAYIECRKVGAPPEVATLLEEIGRERCAAAAAGGEVGLDPELDEFMEAYCGVLERYKEELSRPLDEAASFLSSIRTQLSTLCGGAASLSGSPPAARLHLPSLPPPAGGQGSKYELPSPLRTWHASVQCIVGGRG

SEQ ID NO: 38004 - DNA, 645 bp, Panicum virgatum
  misc_feature: Ceres CLONE 1992097
atggaggtagctggtgcttgtaggcctttgtaggctggctctgatgagtgatggaacttgagagggtgctgcgcgctgatgggtagtgacactgcttggatggctttggggaaagagaatcttgctcgtgttgctggatagttaccagtggtgaaaatttcttgtcgtggggcagctcaagtttttgctctggatactggcttggctttccttgaaaatatatcgtatgatttctgatgcaaaaaaaaaaaaaaaatcttcttttgcttctccctggcaggcactgcctcctccatcatcctcccagagcagcctgcagccagagagccagttcacccccatgtatcccgctgctgcagagatcacgcccagcttctgcgcctgcagctccaacagcagctgcagcaggagctgcagtgcgaacggctactgctagttctccttccccttccttccttgcccggcccctttcttcttctgccgctgccgctgcctcctcgtcttcctggagcttcccgtatccacacataccccaagaaccaaacaaataaagaaacgaaatcaccggagtcttcttcttctactactatttctagccattttattatctggatgtatgcacagatgcatgtagataggtagaag

SEQ ID NO: 38005 - DNA, 543 bp, Panicum virgatum
  misc_feature: Ceres CLONE 1992100
  misc_feature: Encodes the peptide sequence at SEQ ID NO. 38006
gcagcctgcggcagagcgtcgagcagagcgccggcgacaagacggcaacagaatgggtcagagacacggtgatcgtggaggagaggagcgacgccgaggccagcgaagctgcggcggagccggaggaggccgccgagcgcgacggcgacggcaattccgcggccgccgagtccaaccccgacgaccagccagcaccaggtacgcgctcacgcgggaacgagccaggtgccgaggagaagaaggtccgagacgacgccaccgtggtaaccacggccgccgcgcaacccgccgcggagaccacggcgaccgcgcccgaccggccagaggggaagccgcgagctgccggcggcggtcagagcaagctccaggagcagccagctcggcagccgcaagaggagcgccacgacgagccagcacgatctggcggcggggaccaccaccggaagcagctgccgccgctgtgcgacttctccgacttccgcagcgacatctgcaacacggccggcgacatccgcatggacgccaacgcgtcccgtgtttttg

SEQ ID NO: 38006 - protein, 180 aa, Panicum virgatum
  misc_feature: Ceres CLONE 1992100
  misc_feature: Useful for making plants with altered carbohydrate content
SLRQSVEQSAGDKTATEWVRDTVIVEERSDAEASEAAAEPEEAAERDGDGNSAAAESNPDDQPAPGTRSRGNEPGAEEKKVRDDATVVTTAAAQPAAETTATAPDRPEGKPRAAGGGQSKLQEQPARQPQEERHDEPARSGGGDHHRKQLPPLCDFSDFRSDICNTAGDIRMDANASRVF

SEQ ID NO: 38007 - DNA, 662 bp, Panicum virgatum
  misc_feature: Ceres CLONE 1992114
  misc_feature: Encodes the peptide sequence at SEQ ID NO. 38008
gtagatgaatcgattcagaagctcaaacatgctggtgccaacttccatgccagggttgccaaagatattgattgcttaatttcatgtggtgagctcgacaatgagaatgctgaagtcaggaaagcaaggaggctgaagataccgattgtaagagagcaatacataggagaatgcattagaaaaaatagaaagcttccagttgatttgtataaagtagagaacaccttagagtcctcgaaaggtggtactgtcactgttaaagtgaagggcagaagtgcagttcatgaatcctctggtttgcaagatacagctcatattcttgaagatggaaaaagcatttacaatacaaccttaaacatgtctaacttggcacgaggtgtgaacagctactatatactccagatcattgaagaggataatgggtctgaatgctatgtatttcgaaagtggggaagggttgggaatgaacaaattggaagccaaaagctggaggagatgtcaaaagctgatgcaatccaggaattcaaaagattatttcttgagaagactgggaacccatgggaagcttgggagcgaaaaactaattttcagaagcagcctgggaaattttaccctcttgatattgattatggtgttaagcaggcgcccaaactgaaagatat

SEQ ID NO: 38008 - protein, 220 aa, Panicum virgatum
  misc_feature: Ceres CLONE 1992114
  misc_feature (109)..(197): Pfam Name: WGR Pfam Description: WGR domain
  misc_feature: SWISSPROT Homolog: EC 2.4.2.30 NAD(+) ADP-ribosyltransferase
  misc_feature: Useful for making plants with modulated abiotic stress sensitivity
VDESIQKLKHAGANFHARVAKDIDCLISCGELDNENAEVRKARRLKIPIVREQYIGECIRKNRKLPVDLYKVENTLESSKGGTVTVKVKGRSAVHESSGLQDTAHILEDGKSIYNTTLNMSNLARGVNSYYILQIIEEDNGSECYVFRKWGRVGNEQIGSQKLEEMSKADAIQEFKRLFLEKTGNPWEAWERKTNFQKQPGKFYPLDIDYGVKQAPKLKD

SEQ ID NO: 38009 - DNA, 693 bp, Panicum virgatum
  misc_feature: Ceres CLONE 1992124
  misc_feature: Encodes the peptide sequence at SEQ ID NO. 38010
gggacggagaaggctatgttggccgggcgacggttgtcccggtttaagcgtgaaggtgaagccgagcaacgcagagaaaggcgtcttcgtactcgcctctctccgcgactcgaagctttccccccaacccccattccccaccgccgccgccccacccttccgtcgacaccatgagggagtgcatctcgatccacatcggtcaggccggtatccaggtcggaaacgcgtgctgggagctctactgcctcgagcatggcattcaggctgatggccagatgcctggtgacaagaccattggaggaggtgatgatgctttcaacaccttcttcagtgagactggcgctgggaagcacgtcccccgtgctgtatttgttgaccttgagcccactgtgattgatgaagtgaggactggcacttaccgccagctcttccaccctgagcagctcatcagtggcaaggaggatgctgccaacaacttcgcccgtggtcactacaccattggcaaggagattgttgacctgtgccttgaccgcatcaggaagcttgccgacaactgtactggtctccagggcttccttgtcttcaacgctgttggtggaggaacaggctctggtcttggttccctcctccttgagcgcctgtctgttgactatggcaaaaagtccaagctcgggttcactgtgtacccatctc

SEQ ID NO: 38010 - protein, 174 aa, Panicum virgatum
  misc_feature: Ceres CLONE 1992124
  misc_feature (49)..(174): Pfam Name: Tubulin Pfam Description: Tubulin/FtsZ family, GTPase domain
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPS

SEQ ID NO: 38011 - DNA, 667 bp, Panicum virgatum
  misc_feature: Ceres CLONE 1992134
  misc_feature: Encodes the peptide sequence at SEQ ID NO. 38012
attgctgccattcgaggggaatgaattaagaaaacaaataaataaaattgcctcttaattttgtcgccgaccatgcagagcaggggcggcgtcacaaagtagcagaagcatcgccatgcactgcttccggttcccgagctgggagcggggggagcgggagggcgacgagcggcgggggccggcggcggcgacgacggggcggtcgctgtcggcgcggtccaacagcagcacgacgtcgacggaccccgacgtgcggcggtcggcgtccgagtgctgctcccttaacgcgtcggagctgagcagcgccggctccctggggcggtgccggcagctgtcgctgtcgcagcggccgcccaacgcgctccgcgtcttcaccttccaggagctcaggtccgccacccgcgggttcagccgctcgctcatgctcggcgagggcggcttcggctgcgtctaccggggcaccatccggagcgcgctcgagccgcgccggagcctcgacgtcgccatcaagcagctcggccgcaagggcctgcaggggcacaaggagtggatgacggaggtgaacgtgctcggggtcgtcgaccacgccaacctcgtcaagctcatcggctactgcgccgaggacgaagagcgcgggatgcagctgctgctcgtctacgagttcatg

SEQ ID NO: 38012 - protein, 183 aa, Panicum virgatum
  misc_feature: Ceres CLONE 1992134
  misc_feature: SWISSPROT Homolog: EC 2.7.11.1 Non-specific serine/threonine protein kinase
MHCFRFPSWERGEREGDERRGPAAATTGRSLSARSNSSTTSTDPDVRRSASECCSLNASELSSAGSLGRCRQLSLSQRPPNALRVFTFQELRSATRGFSRSLMLGEGGFGCVYRGTIRSALEPRRSLDVAIKQLGRKGLQGHKEWMTEVNVLGVVDHANLVKLIGYCAEDEERGMQLLLVYEF

SEQ ID NO: 38013 - DNA, 727 bp, Panicum virgatum
  misc_feature: Ceres CLONE 1992135
  misc_feature: Encodes the peptide sequence at SEQ ID NO. 38014
gatgaggccaatggccagcaatggcatggcgtcctccccctcgcccttcttccctccaaacttcctcctccaaatgcagcagacacctccagatcatgacccccaagaacaccaccaccaccatgagcaccacctccctcctccccttcatcctcaccacaacccattcctcccctcctcccaatgcccatccctccaagacttccgaggtatggcgccaatgctggggaagcggcctatgtacggcgcagaggtcggaggcgtcgacgaggcgaacggcggcggcggcgcaaacgaggacgagctgtcggacgacggctcgcaggctggggagaagaagcggcggctgaacgtggagcaggtgcggacgctggagaagaacttcgagctcgggaacaagctggagccggagcgcaagctgcagctggcgcgcgcgctgggcctgcagccgcggcaggtggccatctggttccagaaccgccgcgcgcggtggaagacgaagcagctggagaaggactacgacgtgctgaagcgccagctcgacgccgtcaaggccgacaacgacgtcctcctctcccacaacaagaagctccaggctgagatactggcgctgaagggcagggaggcagggtcggagctgatcaacctcaacaaggagacggaggcgtcctgcagcaaccgcagcgagaacagctccgagatcaacctcgacatatcgcgcacgccg

SEQ ID NO: 38014 - protein, 171 aa, Panicum virgatum
  misc_feature: Ceres CLONE 1992135
  misc_feature (42)..(96): Pfam Name: Homeobox Pfam Description: Homeobox domain
  misc_feature (97)..(141): Pfam Name: HALZ Pfam Description: Homeobox associated leucine zipper
  misc_feature: Useful for making plants with altered lignin content
  misc_feature: The sequence is a functional homolog of SEQ ID NO 1869 in the 11/479,226 US patent application
  misc_feature: The sequence is a functional homolog of SEQ ID NO 577 in the 11/479,226 US patent application
  misc_feature: The sequence is a functional homolog of SEQ ID NO 260 in the 10/412,699 US patent application
  misc_feature: The sequence is a functional homolog of SEQ ID NO 571 in the 11/479,226 US patent application
  misc_feature: The sequence is a functional homolog of SEQ ID NO 1075 in the 11/479,226 US patent application
  misc_feature: The sequence is a functional homolog of SEQ ID NO 470 in the 10/412,699 US patent application
  misc_feature: Useful for making plants with modulated flowering time
MAPMLGKRPMYGAEVGGVDEANGGGGANEDELSDDGSQAGEKKRRLNVEQVRTLEKNFELGNKLEPERKLQLARALGLQPRQVAIWFQNRRARWKTKQLEKDYDVLKRQLDAVKADNDVLLSHNKKLQAEILALKGREAGSELINLNKETEASCSNRSENSSEINLDISRT

SEQ ID NO: 38015 - DNA, 690 bp, Panicum virgatum
  misc_feature: Ceres CLONE 1992142
  misc_feature: Encodes the peptide sequence at SEQ ID NO. 38016
gcagaaccagccagagcagccggctggtgaccggccacgcttcgccttcctccgccttcgtcgccttcccctatcccttcccggagcagcagttcccactccccactccacctccttctacaacgcccaccaccaccgtccaccggtcccccactcccctccgtcgcgcttcccgacccccctcgcgccgtacggagctccccttccggaaggaacgccgacgacatgggggccttcgcgaagaaggagcaccagttcctcaacgagctcggcctcgcgccgcgcaacccgggatccttcgcctgcggggcctggggcggctcgggccccgtcgtcaccaccaccagcccgaccaacaaccaggttatcgcggaggtggtggaggcgtccgtgaacgactacgaggagggcatgcgcgcctgcttcgatgccgctaggacatggatggcgattccagctccgaagcggggagagattgttcggcaaattggcgacgcactgagagcaaagctccatcaccttggcaggcttgtgtcacttgagatggggaaaattcttccggaagggatcggggaggttcaggaaatcatcgacatgtgtgattatgctgtggggctaagtcgccaattaaatgggtccattataccatccgaacgtccaaaccatatgatgatggaggtgtggaatcct

SEQ ID NO: 38016 - protein, 154 aa, Panicum virgatum
  misc_feature: Ceres CLONE 1992142
  misc_feature: SWISSPROT Homolog: EC 1.2.1.3 Aldehyde dehydrogenase (NAD(+))
MGAFAKKEHQFLNELGLAPRNPGSFACGAWGGSGPVVTTTSPTNNQVIAEVVEASVNDYEEGMRACFDAARTWMAIPAPKRGEIVRQIGDALRAKLHHLGRLVSLEMGKILPEGIGEVQEIIDMCDYAVGLSRQLNGSIIPSERPNHMMMEVWN

SEQ ID NO: 38017 - DNA, 1291 bp, Panicum virgatum
  misc_feature: Ceres CLONE 1992173
  misc_feature: Encodes the peptide sequence at SEQ ID NO. 38018
attgcccactctccctccgaccctccctccctccctctctcctcttccggtcacaggtggtaagtggtaacgcgcccactcactccctcgcatcacactctcctcggctcctccataactgccccgcgcgcatgggcgatccgcgggcccgcccgtccgccgtggccgccggcgagctgcggccgccggagccgccgctggacccgctcgagttcctgtcgcggtcctggagcgcgtccgggcgcgcgttcgcgcccccgccgccgacgccgccccccgccgcgctcgtcagccccatcgccgaggacgccgcgtgcgagctcgaggactgcggggtcgccgccgccgcgaccgggagctccttctccttcgcgtccgcggccacgtcgcagctcatcatggaacggatcctcgcgcagtcccaggaagtggcgccgctcacctccggccgtctctcgcacagcagcggccccctcaacggcggcggctccctctccgacagcccgccggtctcgccggagatcgatgacgcaaagtactgcagagcagtgagcacgccgaagcctcaggcataccggccaggcaacaagacggtgggccggtggctcaaggatcggaaggagaagaagaaagaggagacgcgggcgcacaacgcgcaggtccacgccgccgtctcggtcgcggcggtggcagctgcggtggcggccgtagctgctgcgaccgctgcggcgtcagggtccggcaaggacgatcatgccgctcgcactgacatggccgttgcctcggcggctacgctcgttgcagcacagtgcgtcgaggccgcggaggccatgggtgccgagcgcgagcacctggaggccgttgttgggtccgctgtgaacgtccggacgcctggggacatcatcacagtcacggctgccgctgccaccgcgttaagaggcgcggcgacgttgaaggcgagggctctgaaggaggtgtggaacatcgcggcggtgatcccggtggagaagggaacggtgggcggcggagggcaccaccagaagcacggcgcgccgaagcagcagcaccgcaagctggagagcaacggcagcagcatcagcgacgacgtctccctcgaggaggagaacaacttcctgggcatctgcagccaggagctgctcgctcgcggcaccgagctgctcaaacgcacccggaaaggcgccctgcactggaaggttgcgtcggtgtacatcaaccggatgggcctggtgatgctgaaaatgaagagccggcatgtcgcggggacgatcac

SEQ ID NO: 38018 - protein, 386 aa, Panicum virgatum
  misc_feature: Ceres CLONE 1992173
  misc_feature: The sequence is a functional homolog of SEQ ID NO 224 in the 10/225,066 US patent application
  misc_feature: The sequence is a functional homolog of SEQ ID NO 2372 in the 10/374,780 US patent application
  misc_feature: The sequence is a functional homolog of SEQ ID NO 929 in the 11/479,226 US patent application
MGDPRARPSAVAAGELRPPEPPLDPLEFLSRSWSASGRAFAPPPPTPPPAALVSPIAEDAACELEDCGVAAAATGSSFSFASAATSQLIMERILAQSQEVAPLTSGRLSHSSGPLNGGGSLSDSPPVSPEIDDAKYCRAVSTPKPQAYRPGNKTVGRWLKDRKEKKKEETRAHNAQVHAAVSVAAVAAAVAAVAAATAAASGSGKDDHAARTDMAVASAATLVAAQCVEAAEAMGAEREHLEAVVGSAVNVRTPGDIITVTAAAATALRGAATLKARALKEVWNIAAVIPVEKGTVGGGGHHQKHGAPKQQHRKLESNGSSISDDVSLEEENNFLGICSQELLARGTELLKRTRKGALHWKVASVYINRMGLVMLKMKSRHVAGTI

SEQ ID NO: 38019 - DNA, 596 bp, Panicum virgatum
  misc_feature: Ceres CLONE 1992173-R
ccggcgagcggaagcgcctcgcgtgacgacgccgacgacctagacctaccccgcgcgacccgtgccggctgtcgccgtcgtcgccaacctgccgacgcggtggcctgggcgcctccgatccaggggcctcccatcatcaccgccccgtttgttgtttgctaggctgtagatgccgcgaggccggcgaaggcagcagcgcgacatgggcgcacagggatcatgtagctaggtagggggatcctgttgctgtgttagggcacaggattgggtgagtgagtcgatcgatggcggtgtggtttctggggaatgcgacgccggtgcgtggggtgccatccctcagtgattcagcggcgaggttaagggcagcagcgcttgcagatctctctctgcctgtgctcttccctcttgctctgcctctcttgtaagttttgctgctgctgctgctgctttttttttcttcttcttctctggtttggggtgtggccatactggaactgtagctggcaaaagataagtgctttgttctggtagtagtagtagtaactctgtagttaccgtagtaaacaccgggaaattaagcacatgttcattccatc

SEQ ID NO: 38020 - DNA, 1360 bp, Panicum virgatum
  misc_feature: Ceres CLONE 1992198
  misc_feature: Encodes the peptide sequence at SEQ ID NO. 38021
agttgtgagtcgagttgggtttctagtttcttcccctcctccggcggtccggccgccctccggccacaacggcgcgagatccgcccgcccgcccatctccggggcgccccagaggccagagcaggatcaggatgttcggcctccaggcaaccggcgctgccgcctcgtgggtcgtcggccggatgggcacggatgcgcacctctacgatgaccccgacgacgcctccatccccgcgctcctcgactcccgcttcgacgccgacaaggtcgacgccctcaagcgactcctcgccctcatcgcgcagggagtcgacgtcgccaacctcttcccgcaggtcgtcaagaacgtcgcctcgcagtcgctcgaggtcaagaagctcgtctacctctacctcctccactacgccgacaagcgccaaaacgaagcccttctctccatcaacattttccagaaggacttgtcagatataaacccactagtcagggcttgggcgctgcgcaccatggctggcattaggctacatgtcgttgctccgctcgtcctggttgctgtcaagaaatgctccagggatccatccgcatatgttagaaaatgtgctgcctatgcactctgtaagctgtacgacttgcttccggatcaagctatggctttagaggagattgtagacaccttgttcaacgacagctcacctggagtagtgggagctgccgctgttgcatttaagtctgtctgtccaaattgtttagcattgctgtcaaagcatttccggaggctatgtgagacactccctgatattgaggaatgggcacagattattcttattgagatcctcttgcggtatgtagtagctagacatggcttggtcaaggattctttactttctacggagattcagggtatcataggttcggactctattactagcatggccacccaacctactgattctattgccaatggggtttctgctggcactatgtcaaacatcatgctgttccggcactacatcgaagaatattcaggttttgctgataaagaaggcaatagctcaagattttcatccgtcaccactaacagcaacgatgatgttgcaattcttttgaagtgtacgtcgcctcttctatggagtcgaaatagtggagtaatacttgcagcagcaagtgtgcattggatcatggctccagtcggggatgtcaagagagtcgttggcccgattttgtttactctgcggtcatctcctgatgcagcatatgtgatgcttggcaacgtactagtttttgccaagacgatgccatcattgtttgccccgttttacgaggacttctttataaatgcttcagacccataccagactaaggc

SEQ ID NO: 38021 - protein, 409 aa, Panicum virgatum
  misc_feature: Ceres CLONE 1992198
  misc_feature (29)..(403): Pfam Name: Adaptin_N Pfam Description: Adaptin N terminal region
MFGLQATGAAASWVVGRMGTDAHLYDDPDDASIPALLDSRFDADKVDALKRLLALIAQGVDVANLFPQVVKNVASQSLEVKKLVYLYLLHYADKRQNEALLSINIFQKDLSDINPLVRAWALRTMAGIRLHVVAPLVLVAVKKCSRDPSAYVRKCAAYALCKLYDLLPDQAMALEEIVDTLFNDSSPGVVGAAAVAFKSVCPNCLALLSKHFRRLCETLPDIEEWAQIILIEILLRYVVARHGLVKDSLLSTEIQGIIGSDSITSMATQPTDSIANGVSAGTMSNIMLFRHYIEEYSGFADKEGNSSRFSSVTTNSNDDVAILLKCTSPLLWSRNSGVILAAASVHWIMAPVGDVKRVVGPILFTLRSSPDAAYVMLGNVLVFAKTMPSLFAPFYEDFFINASDPYQTK

SEQ ID NO: 38022 - DNA, 714 bp, Panicum virgatum
  misc_feature: Ceres CLONE 1992200
  misc_feature: Encodes the peptide sequence at SEQ ID NO. 38023
  misc_feature (624)..(624): n is a, c, t, g, unknown, or other
aattccatcactcctcagtactcactctccagctctcttagcaaacactgcaagcgagagctagctaccacagacaaggacacaatgccacccttacccaagagacccgggcctctcctcgtcctcctcgttgtcgcattcgcggcggcgacggcggccgcctcctccgacgccgccggcactgtccccttctaccccaccgcggaggccgccgcggccgcgcactgcgacggcacgctctaccctgacgtctgcctgtccacgctggccgacatcccggacctgcacaagaagaccctcccggatgtcatctgcgccgccgtgaaccgcaccgaggacgtcgtgacggccaccgcctccaactgctcctcgtacctccgggagaggtccctgagcgcgcgcgaccgcctcgccatcagcgactgcctggagctcctgtccaccaccatggacgacctccaggccaccgtggcggacctggagtcccccgccgcccgcgacagcggctcatcggcgtcgtcgtccgccgcgggggccaggcgcgtgacgatggaccacgtgatgacggtgctctcggcggccatcacgaaccagtacacctgcctggacgggttcgcgtaccangacggcgggcgcgtgcggcgctacatcgagccgacgctccaccacgtctcccgcatggtgagcaactcgctggccatggcgaagaagctg

SEQ ID NO: 38023 - protein, 209 aa, Panicum virgatum
  misc_feature: Ceres CLONE 1992200
  misc_feature (38)..(206): Pfam Name: PMEI Pfam Description: Plant invertase/pectin methylesterase inhibitor
  misc_feature: SWISSPROT Homolog: EC 3.1.1.11 Pectinesterase
  misc_feature: Useful for making plants with altered carbohydrate content
  misc_feature (180)..(180): Xaa is any aa, unknown, or other
MPPLPKRPGPLLVLLVVAFAAATAAASSDAAGTVPFYPTAEAAAAAHCDGTLYPDVCLSTLADIPDLHKKTLPDVICAAVNRTEDVVTATASNCSSYLRERSLSARDRLAISDCLELLSTTMDDLQATVADLESPAARDSGSSASSSAAGARRVTMDHVMTVLSAAITNQYTCLDGFAYXDGGRVRRYIEPTLHHVSRMVSNSLAMAKK

SEQ ID NO: 38024 - DNA, 646 bp, Panicum virgatum
  misc_feature: Ceres CLONE 1992204
  misc_feature: Encodes the peptide sequence at SEQ ID NO. 38025
atcctccaaatccaacgagccgccgccgccccgattgcgccgccgaggcggcgtatccccgccaacctgtggctccgctcgcctcccggctgaacacacaagagtgctgggaatggagatccaatcgtcaggccggtccatcgacgtgctgatggagaaggtgctgtccgtgaacatcctctcctcggactacttcaaggagctctacaagttcaagacctaccacgaggtcgtcgatgagatctatcaccaggtcgaccacgtcgagccctggatgaccggcaactgccgcgggccctcctccgccttctgcctcctctacaagttcttcaccatgaagctcaccgtcaagcagatgcacggcctgctcaagcacccggactccccatacatcagagctattggatttctctacctgcgatatgttgcagaaccaaaaacactgtggacttggtacgaaccctacatcaaggatgacgaggagttttcccctggatcaaatggtaaaatgactacaatgggcgtttacatgcgtgatctcctccttggccaggtatatctcttgaacttatttgacatttctgccatacaacaaaacggtattctaagctgctatcacagtgtcctttagtgttacccatttaca

SEQ ID NO: 38025 - protein, 172 aa, Panicum virgatum
  misc_feature: Ceres CLONE 1992204
  misc_feature (1)..(171): Pfam Name: PRP38 Pfam Description: PRP38 family
MEIQSSGRSIDVLMEKVLSVNILSSDYFKELYKFKTYHEVVDEIYHQVDHVEPWMTGNCRGPSSAFCLLYKFFTMKLTVKQMHGLLKHPDSPYIRAIGFLYLRYVAEPKTLWTWYEPYIKDDEEFSPGSNGKMTTMGVYMRDLLLGQVYLLNLFDISAIQQNGILSCYHSVL

SEQ ID NO: 38026 - DNA, 692 bp, Panicum virgatum
  misc_feature: Ceres CLONE 1992212
  misc_feature: Encodes the peptide sequence at SEQ ID NO. 38027
accccctgcgccgcttccccgggaatcccgccggcccggcttccggtctccgcttctccactccgcaccctccactggtggccatggacccctcgatctcctccgcgtcctcgcctcttatccggctctccgggacccccgccgccgccagcccgcggcccggcctcgtcgcggccgcccgccagcccgccgcctcctcctcctcctccacgcgcctccgcgccgtctcgccgtccccgtccccgccgtcccccgtggagtcgttcggcttcggcgcgctcaaggagaccttctccgtggacgtggcggcggccgaggcgcgcccgctcgacgtgcccctcgccgcgcccttcaccatcgcgacctcgcgcctcgaggccgtctccaacgtcgccgtgcgcgtcgagctccgcagcggcgccgtcggctggggggaggcgcccgtgctgccctccgtcacggccgaggaccagccggccgcgctcgccgccgcgggccgggcctgcgacgcgctcgcgggcgcgcccgcggcaccgctcggtgcgatgctgcaggaagtcgccggtgtcctcccgggacacgccttcgcctcggctagagcaggagtggagatggcactgattgacgcagttgctaatagcattcgcatccctctgtggagattatttgggaggggcatcagatactgtgac

SEQ ID NO: 38027 - protein, 202 aa, Panicum virgatum
  misc_feature: Ceres CLONE 1992212
  misc_feature (76)..(196): Pfam Name: MR_MLE_N Pfam Description: Mandelate racemase / muconate lactonizing enzyme, N-terminal domain
  misc_feature: SWISSPROT Homolog: EC 5.5.1.1 Muconate cycloisomerase
MDPSISSASSPLIRLSGTPAAASPRPGLVAAARQPAASSSSSTRLRAVSPSPSPPSPVESFGFGALKETFSVDVAAAEARPLDVPLAAPFTIATSRLEAVSNVAVRVELRSGAVGWGEAPVLPSVTAEDQPAALAAAGRACDALAGAPAAPLGAMLQEVAGVLPGHAFASARAGVEMALIDAVANSIRIPLWRLFGRGIRYC

SEQ ID NO: 38028 - DNA, 724 bp, Panicum virgatum
  misc_feature: Ceres CLONE 1992212-R
  misc_feature: Encodes the peptide sequence at SEQ ID NO. 38029
tccagagatgattgggaaggtctcccgtgatgttagtattgctgccatggagaaatacaaagtcgctgtcgctgctgatgaaagttgccggagtttacttgatgctcagaaaataatacatgggaatctggcccatgttattaacatcaagctcgcaaaattaggggttcttggagcccttgaaataattgatgctgcaagaaaagccaatgttgctttgatgattggcggcatggtcgagactagaatcgccatgggctttgctggtcacctagctgctgggcttggttgtttcagttttattgatctggacacgccccttttattgtctgaagatccagtttatggtggctacgaagcctttggacccctgtacaagtttacaaatgcccgtggccatggtggtttccttcacttggacaacaatggctcgaaatgaagatgattagtggatttgtctgtccgtctggagcttcatgcggagcattgcagtgcactccacacatgcattgttcaaacgggcaaccaccgttgtaactgaaaacagatgagcgataggaagcatgtagccttctgtttactgtagtccaatcagaatcagggttataaatctataacatttgatcaaggtgtagatagtagtatgtatactcataaggctgtatcagctggcattgttgttttatcgaaatattacaataaatatattgttatattgtgatcc

SEQ ID NO: 38029 - protein, 145 aa, Panicum virgatum
  misc_feature: Ceres CLONE 1992212-R
  misc_feature: SWISSPROT Homolog: EC 4.2.1.113
PEMIGKVSRDVSIAAMEKYKVAVAADESCRSLLDAQKIIHGNLAHVINIKLAKLGVLGALEIIDAARKANVALMIGGMVETRIAMGFAGHLAAGLGCFSFIDLDTPLLLSEDPVYGGYEAFGPLYKFTNARGHGGFLHLDNNGSK

SEQ ID NO: 38030 - DNA, 1476 bp, Panicum virgatum
  misc_feature: Ceres CLONE 1992222
  misc_feature: Encodes the peptide sequence at SEQ ID NO. 38031
aactactagctcccacatttgggaagcagatccttaattagacagcaacccaaccacctactagggccctgttcgcttgtcttttcccgacttatttcggcttgttttaacttatttcatctcacaagatactattaaatcagccgaaatctgccggcttttccaccagccgaacagctgtgatccaagttcgctcactttgatctgcagattgcagaaatctgcagggtgcagaatggagagaacactgatcacctcctctaacatctccacggctgcgcatccttcaggatcgtccaggagagttggctacatttcccctgctgcctctgctgcggcacaaaactccagctacaggaagaagaagagcaccccgtcggccgccgcaaccgccgccaccgtcgtcacctcccctccggccaccgacaatgtccagtccactgctccgaagcaggacgagcaacaggacaagggagagcgcgtggcggccacgactaacacttcaagaattggcactgcaagtgcaagaacaagaagggcgccggcgccgagccaggctcgggctcagccccgccgccgccccgccccggctgccgcgtccctgccgatggcgctctgcagcgcgctggaggaggcgatcaacacgttcgtcgacccgccggcgctgcggccgtcggtggacccgcggcacgtgctgtcggccaacttcgcgcccgtggacgagctgccgcccacgccctgccccgtcgtgcgcggcggcatcccgcgctgcctcgccggaggcgcctacatccgcaacgggcccaacccgcagcacctcccgcgcggcccgcaccacctcttcgacggcgacggcatgctgcactcgctgctcctcccggcggtggagtccgagtcgccgccgtccgaccccgtcctgtgctcgcggtacgtgcagacgtacaagtacctcgtggagcgcgacgcgggcgcgccagtcatgccgagcgtcttctccggcttccacggcctgggcgggctggcgcgcggcgccgtcgtggcggcgagggtgctcacggggcagatgaacccggccgagggcgtggggctcgccaacaccagcctcgtcttcttcggcgggcgcctctacgcgctcggcgagtccgacctgccgtacgccgtgcgcgtcgacccggccaccggcgaggtgaccacgcacgggcggtgcgacttcggcggccgcctcttcatgggcatgaccgcgcaccccaagaaagaccccgtcaccggcgaggtgttcgcgttccggtacggccccgtgccgccgttcgtcacctacttccggttcgacccggccgggaacaagggccccgacgtgcccatcttctccgtgcagcagccgtcgttcctgcacgacttcgccgtcaccgagcggtacgccatcttcccggagatccagatcgtgatgcagcccatgggcatggtggccggcggcgc

SEQ ID NO: 38031 - protein, 289 aa, Panicum virgatum
  misc_feature: Ceres CLONE 1992222
  misc_feature (11)..(289): Pfam Name: RPE65 Pfam Description: Retinal pigment epithelial membrane protein
  misc_feature: SWISSPROT Homolog: EC 1.13.11.51 9-cis-epoxycarotenoid dioxygenase
MALCSALEEAINTFVDPPALRPSVDPRHVLSANFAPVDELPPTPCPVVRGGIPRCLAGGAYIRNGPNPQHLPRGPHHLFDGDGMLHSLLLPAVESESPPSDPVLCSRYVQTYKYLVERDAGAPVMPSVFSGFHGLGGLARGAVVAARVLTGQMNPAEGVGLANTSLVFFGGRLYALGESDLPYAVRVDPATGEVTTHGRCDFGGRLFMGMTAHPKKDPVTGEVFAFRYGPVPPFVTYFRFDPAGNKGPDVPIFSVQQPSFLHDFAVTERYAIFPEIQIVMQPMGMVAGG

SEQ ID NO: 38032 - DNA, 629 bp, Panicum virgatum
  misc_feature: Ceres CLONE 1992222-R
  misc_feature: Encodes the peptide sequence at SEQ ID NO. 38033
tgcgtcgagaaggtgcgcgtcaacctccgcaccggcgccgtgtcgcgcaccccgctctcggcggggaacctcgacttcggcgtgatccacccgggctacctcggccggcgcaaccgctacgggtacctgggcatcggcgaccccatgcccaagatcggcggcgtggccaagctggacctcgaccttgccggcacgggcgactgcaccgtggcgcggcgggacttcgggcccgggtgcttcgccggggagcccttcttcgtccccgacgacgtggagggggacggcaacgaggacgacggctacgtggtgtgctacgtccacaacgagcgcaccggcgagaaccggttcgtggtcatgaacgcgaggtcgccgcagctggacatcgtcgccgaggtgcagctgcccgcccgcgtcccctacggcttccacggcctctttgtcaccaaggccgagctccaggcgcagcagcaatgacaagaacatgattccaagagaacacacacaaactggatactgaatagtaggtcatagtatgaacaaaactctaggtctcgtatagcattcgagtgtacgaattgttgtattgtaaatggagcagaacccatacaagagtttcgtgatttgagttg

SEQ ID NO: 38033 - protein, 157 aa, Panicum virgatum
  misc_feature: Ceres CLONE 1992222-R
  misc_feature: SWISSPROT Homolog: EC 1.13.11.51 9-cis-epoxycarotenoid dioxygenase
CVEKVRVNLRTGAVSRTPLSAGNLDFGVIHPGYLGRRNRYGYLGIGDPMPKIGGVAKLDLDLAGTGDCTVARRDFGPGCFAGEPFFVPDDVEGDGNEDDGYVVCYVHNERTGENRFVVMNARSPQLDIVAEVQLPARVPYGFHGLFVTKAELQAQQQ

SEQ ID NO: 38034 - DNA, 643 bp, Panicum virgatum
  misc_feature: Ceres CLONE 1992228
  misc_feature: Encodes the peptide sequence at SEQ ID NO. 38035
ggacgacaaatcgagcagccacgccctcggccaggtcttcgtcggcggccgcccttggcctggtcttcgtcgagcgccggcgacgagcattcggaaggatgatacgagtacaagctcaagggtcctcttaattctgaccaaatccgacaggtgttggactgccaggggccaggatgtccaatgtgactgtgtgtgtgcggttcagaccgctgagtcacaaagagaggaaggctaatggtgacaatgtctgcttcaggaaactggactccgagtcttttgttttcaaggatgagagggaagaagatgttatattcagctttgacaaggtgttctatgaagatgcacaacagtctgatgtctacgacttccttgcagtgcccattgtttcagatgccatcaacggaataaatgggactataattacttatggtcagactggggctggaaagacatatagcatggagggaccaagcatcttgcactgcaatgagcagaaaactggactggtacagcgagttgtggacgagctatttgtatgtttaagatcatcagcaggcacatggactgtgaagttgtcaatggtggagatatatttggaaaaagtgagggaccttctcgacttgtccaaagacaacctacagat

SEQ ID NO: 38035 - protein, 156 aa, Panicum virgatum
  misc_feature: Ceres CLONE 1992228
  misc_feature (9)..(156): Pfam Name: Kinesin Pfam Description: Kinesin motor domain
MSNVTVCVRFRPLSHKERKANGDNVCFRKLDSESFVFKDEREEDVIFSFDKVFYEDAQQSDVYDFLAVPIVSDAINGINGTIITYGQTGAGKTYSMEGPSILHCNEQKTGLVQRVVDELFVCLRSSAGTWTVKLSMVEIYLEKVRDLLDLSKDNLQ

SEQ ID NO: 38036 - DNA, 1422 bp, Panicum virgatum
  misc_feature: Ceres CLONE 1992241
  misc_feature: Encodes the peptide sequence at SEQ ID NO. 38037
acctcttctctgctcctgctctcccccctccccttgccgattgcctttgctccccaaacccaacaatctcccaagaaaagggcctgccgccgccggagatgctctgccttcctccgcgcccgccgcggcatacgctggcggctagcgcgaccgccatgccgtacatggcagccgtggggcccgtcccctggcagccttccccggcactggcggctgcggggctcctcgccgcgacctccccatacggcaatcccgagccccaaaccctacccttcttgccgccgccgccgcctgcgatccttcctccccgggccccgatcgtcctccagctccacccccaccccggcttcctcgccgaggtggatcgccgccgcagctgttcccttttgcagctcttgaaggatgagggggccgccccgtcgccagaggatgaaaagaggagggagcaggtcatccgagagctcaagaagatagtgatgcattgggccaaggcggtggcgtgtgagcagagtgtgccccagaggctagccacggctacggtcttgacatatggttcttactcgttaggggctcacggacctgaatctgacattgacgcactttgtgttgggccttgtatcgcaacactgcagtaccatttctttgttgttctgagacaaattcttgagggcagaccggaaatatcaggagtgccaactattgagagtgctaagattccgttgatgcggtttagattctctggtgttgcaattgatttcacatatgctcagcttcctgcttttgatgcattaaaggctataaatatgttttgccctcggttactacagaaaattgatgaacggagctggaggagtctatctggagttcgtgttaatgagaaaattgttcagctagtaccaaattctgagaagtttcaggttctgttgcgatgtgtcaaactatgggctaggaagagaggacttcattgtcatcatcttggattctttgccgggattcatttagcgatccttgcggcttacatctgtcagagatatccaaacgccagtgtcaatggtttgttcgtaatgttctttcagactttcgctcactggccttggcaagttccagtaagtctgcatgatgagccaactgattgcctgcacccagaggggcgtctcatgcccatagtgatgccttgtaccccgccagagttttgtgtgtcaaatgtgacaaaaagcaccttcaagaaaataagagaggaacttacacgtggttatgctttcaccaaggatccattgaggcatgattttgagtggacttggctttttgaatccttcccatatgctgagaaacatcaacaatttctctggattgctttatgtgcgccaacatttgaagagctgcatgactgggctggatgggtgaaatctcgcctccgtttct

SEQ ID NO: 38037 - protein, 422 aa, Panicum virgatum
  misc_feature: Ceres CLONE 1992241
  misc_feature (63)..(387): Pfam Name: PAP_central Pfam Description: Poly(A) polymerase central domain
  misc_feature: SWISSPROT Homolog: EC 2.7.7.19 Polynucleotide adenylyltransferase
MPYMAAVGPVPWQPSPALAAAGLLAATSPYGNPEPQTLPFLPPPPPAILPPRAPIVLQLHPHPGFLAEVDRRRSCSLLQLLKDEGAAPSPEDEKRREQVIRELKKIVMHWAKAVACEQSVPQRLATATVLTYGSYSLGAHGPESDIDALCVGPCIATLQYHFFVVLRQILEGRPEISGVPTIESAKIPLMRFRFSGVAIDFTYAQLPAFDALKAINMFCPRLLQKIDERSWRSLSGVRVNEKIVQLVPNSEKFQVLLRCVKLWARKRGLHCHHLGFFAGIHLAILAAYICQRYPNASVNGLFVMFFQTFAHWPWQVPVSLHDEPTDCLHPEGRLMPIVMPCTPPEFCVSNVTKSTFKKIREELTRGYAFTKDPLRHDFEWTWLFESFPYAEKHQQFLWIALCAPTFEELHDWAGWVKSRLRF

SEQ ID NO: 38038 - DNA, 682 bp, Panicum virgatum
  misc_feature: Ceres CLONE 1992241-R
atcatacagtcaaggagccaaacatggtcttctactggggcctcatccctgaaaaaatcattcatgtggacactagcgctctgaaagaaaatttcatgaaagatgtcaccaatgatgtctacggcaaggtgaaatgcacgcgttcggttttgacaatatctgtggttggtctgtcacagctgccaaacagtatgtgcacccattctgttcactggcaatacttgcagcactgcatgctgggctaccaggctaggagtgaagaccagagtgcaggttggctaggacttgcttaggtcatctcatctgggaggggcatgttcatgtctttcgcggcaactgtgtatacaaaattgttgaggtgttttctgcccctagcacagggattcaggatccttggctgggtattcttttgactgagcgttgcatgagtgcttgtgtgctcatgaatcggaccactgacccgtagaagaacaaagagtagatagtattagcggcatgtatataaaaacataggtttggtgtggtcgtcgccaaaagtgtaaaattcttgtgttcttatcgtaactgctgttgcaccctgattcatatcaaattttgtaatggccaaaagtgtatataactggttctctttgactcggtggatgtaaaaaattttgagtagcatgttgttagctgtgaccag

SEQ ID NO: 38039 - DNA, 726 bp, Panicum virgatum
  misc_feature: Ceres CLONE 1992245
  misc_feature: Encodes the peptide sequence at SEQ ID NO. 38040
acgtacccagccaatgagccaagcatcgccgcccagacttgactcccaatggatgcagcttggagccttggatcgtacaatcgtactctagccccgttttataggccatagtctcgatccagagctctcgacttctcggagcacgctcgtgtaccagcagcaagggggttcggaattctgatcgagtcgtcgagagatgacgaagaggagcgtggttctgtacccaggcctcggcgtcggccacctcacgccgatgatcgagctggccaaggtgttcctccaccacggcgccgccgtcaccgtcgcgctcgtcgagccgcccaccaagtcccccgacttctccgcggtggtcgcccgtgccgcggcctccaacccgtccgtcaccttccacgtcctcccgccgccagctccggctgaccctcccggctccgacggcggcacgtcatcagcgcaccacatcgtcgtcatgttcgaccacctcaaggccatggtcccgccgctccgcgacttcctccgctcgctgcccgccgtcgacgcgctcgtcctcgacatgttctgcggcgacgccctcgacgtcgccgccgagctcaagctgcccgtcttctacttctacgcctcgggcgccggcgacctggccgtcttcctcaacctgggtcgcatggccacgagcacgggtttcgcggagcacggcgactccatcgtctcgtttcccggcgcgcctccgct

SEQ ID NO: 38040 - protein, 176 aa, Panicum virgatum
  misc_feature: Ceres CLONE 1992245
  misc_feature: SWISSPROT Homolog: EC 2.4.1.218 Hydroquinone glucosyltransferase
  misc_feature: Useful for making plants with altered carbohydrate content
MTKRSVVLYPGLGVGHLTPMIELAKVFLHHGAAVTVALVEPPTKSPDFSAVVARAAASNPSVTFHVLPPPAPADPPGSDGGTSSAHHIVVMFDHLKAMVPPLRDFLRSLPAVDALVLDMFCGDALDVAAELKLPVFYFYASGAGDLAVFLNLGRMATSTGFAEHGDSIVSFPGAPP

SEQ ID NO: 38041 - DNA, 634 bp, Panicum virgatum
  misc_feature: Ceres CLONE 1992245-R
  misc_feature: Encodes the peptide sequence at SEQ ID NO. 38042
gacgcccttctgccggagggattcttggggaggaccaaggacaccgggctcgtgctcaagtcttgggcgccacaggtggatgtgctacgtcacagagccaccggtgcgtttgttacacactgcgggtggaactcgacactggaaggcatcacagcggggctgcccttgctgtgctggccattgtatgcagagcagagaacgaacaaggtgttcatcgtggaggagatgaagcttggggtggtgatgaagggctacgatgaggagttggtgaaggcggaggaggtggagacgaaggttaggtgggtgatggagtctgaaggtgggcaagcgctcaaaaagagggtggcagaggcgaaaggtagagcgatcgaagcaatcgaagaagggggctcatctcatgctgcttttgttgaattcttgaaggatctcgataacgtgagcttgccttagcattagcacacaacgcacttaattattcaaaggtttcgagttccacataggcatcgttaattcttgcttttgagaccatgttaacacggctgtggatttactcttgagtactcacggaggtgcttctgagtactcgagcttctttgtgtgcttcgccgttgttccaagaacatcaattcttcat

SEQ ID NO: 38042 - protein, 149 aa, Panicum virgatum
  misc_feature: Ceres CLONE 1992245-R
  misc_feature: SWISSPROT Homolog: EC 2.4.1.115 Anthocyanidin 3-O-glucosyltransferase
  misc_feature: Useful for making plants with altered carbohydrate content
DALLPEGFLGRTKDTGLVLKSWAPQVDVLRHRATGAFVTHCGWNSTLEGITAGLPLLCWPLYAEQRTNKVFIVEEMKLGVVMKGYDEELVKAEEVETKVRWVMESEGGQALKKRVAEAKGRAIEAIEEGGSSHAAFVEFLKDLDNVSLP

SEQ ID NO: 38043 - DNA, 1485 bp, Panicum virgatum
  misc_feature: Ceres CLONE 1992265
  misc_feature: Encodes the peptide sequence at SEQ ID NO. 38044
aatcctccgagtctcccttcccacctcttccggcctcctcggtcaaaccgcctttctctctcctactattctccccctccctccctctccggctctccctctccctctctaaaaaaaaagtagcgcccggagaaccagaggctgcagaaagaggcggaaagaggcagcaaaatctcactttgttgagaattctttcctctgttcttttagggttcttggttggtggaatggaagctcggcatccccatttgtgcccccgagatcttcgtcgttcccctcgtgtgtagcctttaggaaggttggtgaaagtgcgaagaacatcgataaagggaacccacagagtttggttccaatttttagttcctcgtgttcttgcaggaggaatttcgtttcacatgatccgtttctgttcctgacggcgttgtcgcgctctgctccagtccgcgcaccctgctactgcttcgctttttggggagagaagaggaagcaaatcattggtctttggagacgttgtccagcccagttcagttgacatatattactggcaagcatgaccggcactggcaaccatggatccctcatggaggaatggttcccgcccctcacaccaagcccaagaacactcatgccaagtttcctgaatgaagaattcagctctggtccattctctaatcttttcagtgaacatggcactaacaagcctcatgatcaatgcgaaaagagcagagaacttgtgagtatgggcgaggaggtgcctgctcaagctgtcaaagacagatttcataagggtttttccctggagccgaatttgttcagtgctactcagaaatcaaactcacatggtggtttggcggagcgcagggctgcaagagcaggtttcagtgtttcaaaaattgatacttctcgagttggttcatctgcagttattcggtcacccgtgtcaattccacctggtcttagtccaactacacttcttgagtcacctgtttttctttacaataagatggcacagccttctccaactactggcacattgccatttttgatggcaacgaatgataagtcaacaatgccactagctgctaagataactgaagattctacatttgataatgatgttttttctttccaaccacacttgggttctaaacaaccaagcttatctactgcagaaatggactacggtgtttatcatcaaaaccagtccgtgtcaagctttcctgtagttaaggataacagcaatgcaacaattgttaaagcaaaggcatctgactccatttttagcaatagtcccaattcaactgaccaaaagcaagattatgagacaaaccaaaatgcacaaggcgaaggtgttgaggctagaacagctgcttgcttccctgtatcaactcatggtgatgcgtctctaatgggctctcaagatgcagttgatgtctcatcaacgctgtctaacgaggaggatgagagggcaacacatggcaccgt

SEQ ID NO: 38044 - protein, 311 aa, Panicum virgatum
  misc_feature: Ceres CLONE 1992265
  misc_feature: The sequence is a functional homolog of SEQ ID NO 1390 in the 10/412,699 US patent application
  misc_feature: The sequence is a functional homolog of SEQ ID NO 514 in the 10/374,780 US patent application
  misc_feature: The sequence is a functional homolog of SEQ ID NO 1389 in the 10/412,699 US patent application
  misc_feature: The sequence is a functional homolog of SEQ ID NO 513 in the 10/374,780 US patent application
MTGTGNHGSLMEEWFPPLTPSPRTLMPSFLNEEFSSGPFSNLFSEHGTNKPHDQCEKSRELVSMGEEVPAQAVKDRFHKGFSLEPNLFSATQKSNSHGGLAERRAARAGFSVSKIDTSRVGSSAVIRSPVSIPPGLSPTTLLESPVFLYNKMAQPSPTTGTLPFLMATNDKSTMPLAAKITEDSTFDNDVFSFQPHLGSKQPSLSTAEMDYGVYHQNQSVSSFPVVKDNSNATIVKAKASDSIFSNSPNSTDQKQDYETNQNAQGEGVEARTAACFPVSTHGDASLMGSQDAVDVSSTLSNEEDERATHGT

SEQ ID NO: 38045 - DNA, 667 bp, Panicum virgatum
  misc_feature: Ceres CLONE 1992265-R
  misc_feature: Encodes the peptide sequence at SEQ ID NO. 38046
agcatctcatgatctgaaatccgtcatcactacatatgaaggaaagcacaaccatgaagttccggcagccagaaacagtgggcaagccggttctagttctgccaacgctccatctgcctcacaaggtagtagttctcaccgtaggcatgaaccagcacaagccagttttgctcattttggtgctagccctcctttcggctcctttggccatttgggaccagcaacaggcaatttccgcttcgggatggttccaccgggcatggcgattccgatgccctctctaggatctcttgctccaacaaagattgttggaaattcatcagctatgcagggatacccaggcctcattatgccagtggaaccgaaggcggagccagtatcgcaaccgggcttcccaacaacaaatgcagccccatcagcctaccaacagatgatgagcaggcctccttttggtcatcagatgtaaataataggaaagaggaaaagggatagatttgcttcagcttgtatacatgatagtgacgctgcaacattgctttgttctactagttttttttccccatccctttgcgcatttctttgaagcaaagaatgctgaagatggtgccttatcgtcatgtaatcgtctatggaaattggaaatcaatcaatcaaaccttctggttgt

SEQ ID NO: 38046 - protein, 154 aa, Panicum virgatum
  misc_feature: Ceres CLONE 1992265-R
  misc_feature: The sequence is a functional homolog of SEQ ID NO 1389 in the 10/412,699 US patent application
  misc_feature: The sequence is a functional homolog of SEQ ID NO 513 in the 10/374,780 US patent application
  misc_feature: The sequence is a functional homolog of SEQ ID NO 1390 in the 10/412,699 US patent application
  misc_feature: The sequence is a functional homolog of SEQ ID NO 514 in the 10/374,780 US patent application
ASHDLKSVITTYEGKHNHEVPAARNSGQAGSSSANAPSASQGSSSHRRHEPAQASFAHFGASPPFGSFGHLGPATGNFRFGMVPPGMAIPMPSLGSLAPTKIVGNSSAMQGYPGLIMPVEPKAEPVSQPGFPTTNAAPSAYQQMMSRPPFGHQM

SEQ ID NO: 38047 - DNA, 1093 bp, Panicum virgatum
  misc_feature: Ceres CLONE 1992266-R
  misc_feature: Encodes the peptide sequence at SEQ ID NO. 38048
tgaggaaaaatgcctggaaacaaatttgcaacaactgttttctcaaaacttgatatgaacaaagcagcaactgttattgatccttcagaacttgaaagtctcttctctgtcgctgaagtcgctccaaaagctgaaacctcagaaaagaaggttgttgatcagaaacattcttgtcttgatccaaagaaaatccaaaacgttgcgatttttttgaagactataaaattaccactgaaagagattcctgatactattcttacaacttgtggtgtaagtactgattttctaaatgaagaaatgactacaaaattaatagaaaactctgcaacagatgaagaaatggctgcaattaaagcatggctagcagaacccggaaactctgaagagaaactgaatgacgttgatagattctttttatctctcagcaatatccctcaatgtaaacaaagacttgagacttggatttacgcaattcagtttcaagatcgttatgaagctgttaaacaatctttactgaagattaaatcagctgttagttgtatgaaagaaaatggaaaattatttttggaacttattgaattgattttggctctcggaaattttataaactccggaggaagaaatggagctgctcctggatttttcttattaagaactcttgataaacttaaagatatcagaggttctgacgcaaacaagacaactttattaacttaccttgttcaactcacccaaaagaagaaaccagctgtttgtggctggcttacgccttttgaacccctgaagtatgctaagactactgatctagttgatacccaaacagatttacaagggcttagaggagatttcaagagagagaatgcaaagattgcatcaattcaaaaatcaaattcaaaatgggatgtttatgatgtagcaatgccggcaaaatattctgattttagtgaaaaattagatgcacttgaattaatgtcagctgatgttgatagtgcattccttcaattacttaatgactacggagaagataagaaaacaaaaaccaaagaattcttcactgccatcactgatttcatggacagttggcagaaaaccg

SEQ ID NO: 38048 - protein, 361 aa, Panicum virgatum
  misc_feature: Ceres CLONE 1992266-R
  misc_feature (1)..(359): Pfam Name: FH2 Pfam Description: Formin Homology 2 Domain
MPGNKFATTVFSKLDMNKAATVIDPSELESLFSVAEVAPKAETSEKKVVDQKHSCLDPKKIQNVAIFLKTIKLPLKEIPDTILTTCGVSTDFLNEEMTTKLIENSATDEEMAAIKAWLAEPGNSEEKLNDVDRFFLSLSNIPQCKQRLETWIYAIQFQDRYEAVKQSLLKIKSAVSCMKENGKLFLELIELILALGNFINSGGRNGAAPGFFLLRTLDKLKDIRGSDANKTTLLTYLVQLTQKKKPAVCGWLTPFEPLKYAKTTDLVDTQTDLQGLRGDFKRENAKIASIQKSNSKWDVYDVAMPAKYSDFSEKLDALELMSADVDSAFLQLLNDYGEDKKTKTKEFFTAITDFMDSWQKT

SEQ ID NO: 38049 - DNA, 663 bp, Panicum virgatum
  misc_feature: Ceres CLONE 1992266
caacaaaaagaattaagtgacatgaagataaaacaactccaaggtgaggttgacaaatcaaagactctgtctgaacagcttcaaacgaagactactgaggctaaggatttgtctcaggagttggctagggttaaggctgatcttaatggggcattgaagactgctgaagctgctcaggatgctttacataaagtttcaagtggacaacctgctgcggctgttactgctgctcctgttgttagttctggaggagatggagcaagtaagaaggatcttgatcttgcacaaggcaaggttgcagaacttgaaggagtaattagggatttaagagctcagcttgcttcaaggcctgctggggatgcttctgttgctccaggggatgctccaatgcaaaggggtgggcctccacctccaggaggagagcctatggcaagaggtgggcctcctgctccaggggatgctccaatgcaaagagggggacctcctcctccaggaatgcaaagaggaggaccaggaggacctccaccacctccaggatcaggaggacctccacctccacctggatcgggtggtcctccgcctccaccaggagcaaccggacctcctccagctccaggaggaagaggaggacctccaccacctccaggaagaggaggaccacca

SEQ ID NO: 38050 - DNA, 704 bp, Panicum virgatum
  misc_feature: Ceres CLONE 1992271
  misc_feature: Encodes the peptide sequence at SEQ ID NO. 38051
ttcacactggtgaacatgagttcaaataggtggctagctattcgtctggaaacattgggcggcatcatgatatggttcacagcaacttttgctgttatgcaaaatcaacgagcagagaatcagaaggcttttgcatctacaatgggtctacttcttacttacactctcaatattaccaatttgctcacagctgtccttcgtcttgctagtcttgctgaaaatagtttaaatgctgttgaacgagtcggaacatatattgagttgccgtctgaagctcctcctgtcattgaggaccatagaccaccccctggctggccatcatcaggtgtcatcaagtttgaagatgtcgttcttcgataccgaccagaacttcccgctgttcttcatggcatatctttcattattaatggaagtgagaaggtgggaattgttggcagaacaggtgctggtaaatctagcatgcttaatgctttgttccgtatcgtggagcttgaacgagggaggatattgattgatgattgtgacacttccaagtttggaatttgggacctgcgcaaagttctaggaataataccacaaacaccagttctattttcaggttctgttcgatttaatctggatccttttaatgagcacaatgatgcggatctctgggaggctctggaaagagctcatctaaaggatgttatcaggaggaatgcctt

SEQ ID NO: 38051 - protein, 234 aa, Panicum virgatum
  misc_feature: Ceres CLONE 1992271
  misc_feature: SWISSPROT Homolog: EC 3.6.3.44 Xenobiotic-transporting ATPase
FTLVNMSSNRWLAIRLETLGGIMIWFTATFAVMQNQRAENQKAFASTMGLLLTYTLNITNLLTAVLRLASLAENSLNAVERVGTYIELPSEAPPVIEDHRPPPGWPSSGVIKFEDVVLRYRPELPAVLHGISFIINGSEKVGIVGRTGAGKSSMLNALFRIVELERGRILIDDCDTSKFGIWDLRKVLGIIPQTPVLFSGSVRFNLDPFNEHNDADLWEALERAHLKDVIRRNA

SEQ ID NO: 38052 - DNA, 615 bp, Panicum virgatum
  misc_feature: Ceres CLONE 1992278-R
  misc_feature: Encodes the peptide sequence at SEQ ID NO. 38053
ctccaccggctgctgaagctggcggtgctggacctgagctcaacaagatcacgacggccaaggcgctgggccagctggtggccaactaccactccctcctggcgctcaacctggtgggcaacccggtgcaggccaacgtcggcgacgacgcgctgcgccgtgccgtgacgggcctcctcccaaacctggcctacctgaacaagcagcctgtgaagccgcagcgcagcgcgcgggaggtggccacggacagcgtcgcgcgcgccgcgctcgggggctccggcagccggaatcaggggaaaagggcgtcgcggcggctcacccagagcccccggtcgtcgtcgctgaccaggggacgtagcggcggcggggacggcagcgtgaggagcaggtccaagggaaggcaccacggctgaggcagggcgagagaaatgaaaatgaattcctgcgtgtgacaatttgtgcgtgcatgcctgcccggatctcacagagctgcgatgggacaatcgatgtgaatactcattagtgagagattgagagattttggttagattactacgggcttgatggattgtttgtagatgcaaaagtgtaatttaagatgatgatgatgttacc

SEQ ID NO: 38053 - protein, 136 aa, Panicum virgatum
  misc_feature: Ceres CLONE 1992278-R
  misc_feature: Useful for making plants with altered protein content
PPAAEAGGAGPELNKITTAKALGQLVANYHSLLALNLVGNPVQANVGDDALRRAVTGLLPNLAYLNKQPVKPQRSAREVATDSVARAALGGSGSRNQGKRASRRLTQSPRSSSLTRGRSGGGDGSVRSRSKGRHHG

SEQ ID NO: 38054 - DNA, 1455 bp, Panicum virgatum
  misc_feature: Ceres CLONE 1992278
agttccagtcaccccctccccggccttcgctctctgcctcgagctggcctcccacccatctttagccgcaagagcaactcgatccaccggcgccccgtaacgaaccaaacaggaggcccctcgaccttctcgctcccctccggccgttgacgaagctgccaggcgaagcgaagggctaactgccaagacggcacctctccggcttcaagcgcctccggctctcccccgttcactctggccttccccgtgccgccgccgcctcgcagcttgagcgaggagcatgcgagttcgccctcttctgtcttcgccgtcgtcgtcctcgcgatcgccgcgtcgctgctgcggagggcgtcgcccgtagataacggctaagtcctcctgctgctgattccgtccttgaacgcccgcgcacgtgcgcaacaagggatgaccaagatgagctgcttccccactctgctcgccgccggcaggaagaagaagaaccacaaggtcgccgcagccaaggaggtcagcggcaacgagcgccccaaggtgaagccggtcgagttcatcgatgccccagttggtcccggcgccggggaattcgagaacaaggtcgcgccgcgcgacgtcaagttcgccgccgctgccgcggccatggtccccgtggcgtcccacgaaggaggtggtcaattcgtcgccgccaaggcatcggctaagggggccgatctgctagatttcgaattcgacttccacctgaaccctacggagcccaacaagccagacggcgacggcgacggcgcggagaagcgagccaccgacacggcagcgaacgccgcgagggcggctccggcggacccgtcgcccaagctgaagcggtcttgctccaacatcgagaccaagcgtcccggcccacgtgaagcgccggagatgccggcgcggtcgcgctcctacggcgatctggggaatctgatcggtggcctcgccctggacacgtcggcgactccgcagggcgcgccggaggcgagcccggcgtcggtcaagacgtcgcacactgccgactgcgtcatgctcaagaagcggtcgtccagccaggtgctgccgtcgcgtagccggaagctctggtggcggctcttcctctggagccaccgcaacctgcaccggccggggtcggcgcgcccggcagaggcgtgctctccggctcgccacggaggatacacctcggacacgctcgaggagggcccggccgcggaccgcaagaacaagaaggtcatggttgacgactcgccgtcgccgccgccgtttgcctcgaaccagtgggtcgccttctgcgccgagaactccctccacgaccgcgtcagcgcctgggtgtgcagcatcgagaacgagcctccgttccacatcgccgaggaggacgaagactatgacggaggggacaacatggatgacgacgagtgcgcggcgcggcctcggcgt

SEQ ID NO: 38055 - DNA, 708 bp, Panicum virgatum
  misc_feature: Ceres CLONE 1992286
  misc_feature: Encodes the peptide sequence at SEQ ID NO. 38056
agttttatatcctcctaaccagtgacggagaaggttagtttatagtaaaggagaaccgtactccaatcccgcccgagtttcacacggagcgcattggcacctgtttgaagtacagagcaaaaacactccatatcaaagatgagcttcagatctatcgaacagctacttaggaggaacagcaagaccaaaattgctcgcaatattattgatggtgtccatgaccagaaggaagagcagtgtgtgcaatccttgcgggagttacttcttgcaagcaaccagctaccggagaagtttgatgactactatctcctcctacgctttctgagaatgagaggcttcaacatcttaaaggcaaaagaaatgttcttaaatatgttaaaatggcgtgaagattgttctgttgatgccattgcaaatgaatttaaatttgaggagtatgatgctgtgaaaagatgctatcctcatggatttcatggagttgataaatttggcaggcctctatatatcgaacggattggcttggtggatctcagcaagctcatgcaggtgacaagtattgatcgatacgtaaaatatcatatatcagaacaagagaaaactatgtctttgagatatcctgcttgctcaattgcgactaaaaagcacattgcctctacaacagccatattggatgtgaaaggattggggatgaataattttttcaaatct

SEQ ID NO: 38056 - protein, 189 aa, Panicum virgatum
  misc_feature: Ceres CLONE 1992286
  misc_feature (21)..(91): Pfam Name: CRAL_TRIO_N Pfam Description: CRAL/TRIO, N-terminus
MSFRSIEQLLRRNSKTKIARNIIDGVHDQKEEQCVQSLRELLLASNQLPEKFDDYYLLLRFLRMRGFNILKAKEMFLNMLKWREDCSVDAIANEFKFEEYDAVKRCYPHGFHGVDKFGRPLYIERIGLVDLSKLMQVTSIDRYVKYHISEQEKTMSLRYPACSIATKKHIASTTAILDVKGLGMNNFFK

SEQ ID NO: 38057 - DNA, 723 bp, Panicum virgatum
  misc_feature: Ceres CLONE 1992312
  misc_feature: Encodes the peptide sequence at SEQ ID NO. 38058
acgcccagcacatatcacccccgtccccctccgtgccacccgcccccaaaccctcgccgccgcctccgagacagccgccgccaccatggccacgaccaccgccgccaccgcggccgccgcgctgactggcgccaccaccgccgccgcgccgagacctaggcgcagcgcgcacctcccgtccgcccggcgcgccgcgcccatccggtgctccgcgccggcgctggcctcggccgcccccgccaccccgctccggccgtggggccccaccgagccccgcaagggcgccgacatcctcgtcgaggccctcgagcgctgcggcgtccgcgacgtcttcgcctaccccggcggcgcgtccatggagatccaccaggcgctcacccgctcccccgtcatcgccaaccacctcttccgccacgagcagggggagtccttcgccgcctccgggttcgcgcgctcctccggtcgcgtcggcgtctgcgtcgccacctcgggccccggcgccaccaacctcgtctccgcgctcgccgacgcgctgctcgactccgtccccatggtcgccatcacgggccaggtgccccgccgcatgatcggcaccgacgccttccaggagacgcccatcgtggaggtcacccgctccatcaccaagcacaactacctggtcctcgacatcgacgacatcccgcgcgtcgtgcaggaggccttcttcctcgcctcctctggacg

SEQ ID NO: 38058 - protein, 212 aa, Panicum virgatum
  misc_feature: Ceres CLONE 1992312
  misc_feature (64)..(212): Pfam Name: TPP_enzyme_N Pfam Description: Thiamine pyrophosphate enzyme, N-terminal TPP binding domain
  misc_feature: SWISSPROT Homolog: EC 2.2.1.6 Acetolactate synthase
  misc_feature: Useful for making plants with modulated herbicide sensitivity
MATTTAATAAAALTGATTAAAPRPRRSAHLPSARRAAPIRCSAPALASAAPATPLRPWGPTEPRKGADILVEALERCGVRDVFAYPGGASMEIHQALTRSPVIANHLFRHEQGESFAASGFARSSGRVGVCVATSGPGATNLVSALADALLDSVPMVAITGQVPRRMIGTDAFQETPIVEVTRSITKHNYLVLDIDDIPRVVQEAFFLASSG

SEQ ID NO: 38059 - DNA, 682 bp, Panicum virgatum
  misc_feature: Ceres CLONE 1992325
  misc_feature: Encodes the peptide sequence at SEQ ID NO. 38060
tagccacactcgctcgtcacagacaagcagtccaccaccaccgtccacgctccggccagcctgagagtggagaggggtggagtggcacgcggggagctcgctttctccgcatgtcaacgcagacaaaaagagtagactcctcctcgcccagtctccgcctgcccgtcgccttcgccggcggcgctcggatataaacccaagctgccgcaccacgcagacgcaggtttctccggggcacatatcgaagggcagcaagaacagtcgccgccacctctcctcctccaaccaacaactccaccaagagatctcgcagccagcgccgccagatggagctcgtcgccatggaggcgctggcgccgtcgtcggccaacggcaggaagcgcaagtcctccccgccctcctccggcctgggagacctccacgacgacatgctcgagcgcgtcctcgcgcgcctcccgccggcgagctacttccgcctccgcgcggtctgccgccggtggcgcgccgccgcggcgtccccgacgttcctcgacgcctgcgcccgcgtgccatcccgggacccgtggttcctcatgctctccgactccgacggtccccgccgcccggccgtcgccttcgacgccgccgagcgcggctggaaccgctgccgcgccgcgccggggtccgtgcccgtcgccgcgtc

SEQ ID NO: 38060 - protein, 118 aa, Panicum virgatum
  misc_feature: Ceres CLONE 1992325
  misc_feature (26)..(73): Pfam Name: F-box Pfam Description: F-box domain
MELVAMEALAPSSANGRKRKSSPPSSGLGDLHDDMLERVLARLPPASYFRLRAVCRRWRAAAASPTFLDACARVPSRDPWFLMLSDSDGPRRPAVAFDAAERGWNRCRAAPGSVPVAA

SEQ ID NO: 38061 - DNA, 621 bp, Panicum virgatum
  misc_feature: Ceres CLONE 1992327
  misc_feature: Encodes the peptide sequence at SEQ ID NO. 38062
agaaacgcgtcacactttgccttttgatcggacgccggtgcaagaggcagagagagaagaggaagaggaggaggaggaggtgaggtcaggggctgagacggagccagctgccatgcggccagccatggcggtcagggccgggttcttgctcgccgccgcggcgtgggtgtggctatcggctgtgtccgcctccgccctcgacgacgtgccgaccgccgacttcgaccagcggttctcgccgctgttcggcgacggcaacctcgtccgctcctccgatgaccggagcgtccgcctcctgctcgaccgccgctccggttccgggttcatgtcctcggactactacctccacggcttcttcagcgcctccatcaagctgcccaaggactactcggccggcgtcgtcgtcgccttctacctgtcgaacggggacctgtaccagacgacgcccgaccagctggacttcgagttcctgggcagccggtggggcgggcagtggcgcgcgcagaccaacgtctacagcaacagcagcacctgccacgggcgcgaggagcgctacctcctccccttcgaccccactctccaggcccaccgctactccgtcccctgggctcccacccgcat

SEQ ID NO: 38062 - protein, 165 aa, Panicum virgatum
  misc_feature: Ceres CLONE 1992327
  misc_feature (33)..(165): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MAVRAGFLLAAAAWVWLSAVSASALDDVPTADFDQRFSPLFGDGNLVRSSDDRSVRLLLDRRSGSGFMSSDYYLHGFFSASIKLPKDYSAGVVVAFYLSNGDLYQTTPDQLDFEFLGSRWGGQWRAQTNVYSNSSTCHGREERYLLPFDPTLQAHRYSVPWAPTR

SEQ ID NO: 38063 - DNA, 597 bp, Panicum virgatum
  misc_feature: Ceres CLONE 1992329
  misc_feature: Encodes the peptide sequence at SEQ ID NO. 38064
gttgtctgattccaaccaaggtagaccgtcttcccgaacccagacttccaaaatggttaactttacaatcgatcaaatcagagccatcatggacaagaaagaaaacatccgtaacatgtgcgttatcgctcatgtcgatcacggtaaatccaccttgactgactctctcattgctgctgctggaattatttcaggagctaaagctggagaagctcgtttcactgatactcgtcaagacgaacaagacagatgcatcaccatcaaatcaactggtgtctccctttattacgaacttccagattccaaacttccagctggatccaatggaaatggattcttgatcaatcttattgattcccctggacacgttgatttctcatcagaagtcactgctgctcttcgtgtcactgatggagctcttgttgttgttgattgtgttgaaggagtttgtgtccaaactgaaactgtcttacgtcaagctcttggagaaagaattaaacctgttctcatggtcaacaaaatggacagaacatttttggaattacaacttgctccagaagaagcataccaaggatttgcaagaactatcgaaaccgt

SEQ ID NO: 38064 - protein, 181 aa, Panicum virgatum
  misc_feature: Ceres CLONE 1992329
  misc_feature (17)..(181): Pfam Name: GTP_EFTU Pfam Description: Elongation factor Tu GTP binding domain
MVNFTIDQIRAIMDKKENIRNMCVIAHVDHGKSTLTDSLIAAAGIISGAKAGEARFTDTRQDEQDRCITIKSTGVSLYYELPDSKLPAGSNGNGFLINLIDSPGHVDFSSEVTAALRVTDGALVVVDCVEGVCVQTETVLRQALGERIKPVLMVNKMDRTFLELQLAPEEAYQGFARTIET

SEQ ID NO: 38065 - DNA, 723 bp, Panicum virgatum
  misc_feature: Ceres CLONE 1992335
  misc_feature: Encodes the peptide sequence at SEQ ID NO. 38066
aaacatcatcatccagccatctcctccatttccgatacacacctgcagagctagagaacatggcgaacaagggattctttctagtggctctgttcatcgcccttattggcctgtcgtccaactcggcggccgggcaagtcctgtttcagggcttcaactgggagtcgtggaagcagaacggaggatggtacaacttcctgatgggcaaggtggaggacatcgccgaggccggcatcacccacgtctggctccctccggcgtcgcactctctggccgagcaaggctacctgccgggtcgcctgtacgatcttgacgcctccaagtacggcaacgaggcgcagctcaagtccctgatcgaggcgttccatgacaagggcgtcaaggtcatcgccgacatcgtcatcaatcaccgcacggcggagcaccaggacagccgcggcatctactgcatgttcgagggcggcacgccggactcccgcctcgactggggcccccacatgatctgcagcgacgaccggacctactccgacggcacgggcaaccccgacactggcgcggacttcggcggtgccccggacatcgaccacctcaacacgcgtgtccagcaggagctcatcggctggctcaactggctcaagacggacatcggcttcgacgcctggcgcctcgacttcgccaagggctactccgccgacgtcgccaagatctacatcgacaacaccg

SEQ ID NO: 38066 - protein, 221 aa, Panicum virgatum
  misc_feature: Ceres CLONE 1992335
  misc_feature (26)..(221): Pfam Name: Alpha-amylase Pfam Description: Alpha amylase, catalytic domain
  misc_feature: SWISSPROT Homolog: EC 3.2.1.1 Alpha-amylase
MANKGFFLVALFIALIGLSSNSAAGQVLFQGFNWESWKQNGGWYNFLMGKVEDIAEAGITHVWLPPASHSLAEQGYLPGRLYDLDASKYGNEAQLKSLIEAFHDKGVKVIADIVINHRTAEHQDSRGIYCMFEGGTPDSRLDWGPHMICSDDRTYSDGTGNPDTGADFGGAPDIDHLNTRVQQELIGWLNWLKTDIGFDAWRLDFAKGYSADVAKIYIDNT

SEQ ID NO: 38067 - DNA, 701 bp, Panicum virgatum
  misc_feature: Ceres CLONE 1992338
  misc_feature: Encodes the peptide sequence at SEQ ID NO. 38068
aacaaacgctaaaaaagtaacagtttctgtactttattggttttcaactcggaaccatgcgcgaggtgatctcgatccacatcggccaggctggcgtgcaggttggcaacgcgtgctgggagctgttctgcttggaacacggcatccagcctgacggcgcgatgccgtcggacaagacgatcggcgtggaggacgacgcgttcaacacgttcttcagcgagactggcgccggcaagcacgtgccgcgcgcggtcttcctcgacctcgagccgaccgtcgtcgacgaggtgcgcacgggcacgtaccgccagctgttccacccggagcagctgatctccggcaaggaggatgcggcaaacaactacgcgcgtggccattacacgatcggcaaggagatcgttgacctgtgcctggaccgcatccgcaagctggcggacaactgcactggtctccagggcttctgcgtgttccacgccgtcggcggtggcacgggctccggcctcagcgcgctcctgctggagcgcctgtccgttgactacggcaagaagtcgaagctcggctacacggtctacccgtcgccgcaggtgtcgactgccgtcgtcgagccgtacaacagcgtgctctcgacgcactcgctgctcgagcacaccgacgtcgccgcgatgctcgacaacgaggccatctacgacctgtgccgccgc

SEQ ID NO: 38068 - protein, 214 aa, Panicum virgatum
  misc_feature: Ceres CLONE 1992338
  misc_feature (49)..(214): Pfam Name: Tubulin Pfam Description: Tubulin/FtsZ family, GTPase domain
  misc_feature: Useful for making plants with altered cell wall content and/or composition
MREVISIHIGQAGVQVGNACWELFCLEHGIQPDGAMPSDKTIGVEDDAFNTFFSETGAGKHVPRAVFLDLEPTVVDEVRTGTYRQLFHPEQLISGKEDAANNYARGHYTIGKEIVDLCLDRIRKLADNCTGLQGFCVFHAVGGGTGSGLSALLLERLSVDYGKKSKLGYTVYPSPQVSTAVVEPYNSVLSTHSLLEHTDVAAMLDNEAIYDLCR

SEQ ID NO: 38069 - DNA, 667 bp, Panicum virgatum
  misc_feature: Ceres CLONE 1992346-R
  misc_feature: Encodes the peptide sequence at SEQ ID NO. 38070
gtcatcaaggatacagaaaaacctctgcacccacagtatattttaggcatgacagttacccgccttgctattccactgtatatatttggttgccctagtaacttcatgcgcattgagcctgacaagaaatggtgcatagctgttacggcattcatgggtatccaagcagcagtgcttttgcttcagcactatcttggttctcgctgctttattcctcgccagatcctgcctgagaaatactgctaccacaggaaggttgaggatagcacgaatcagcccattgattgtgttatttgcatgactacaatcgatcttacccaaagaacaagtgaatacatggtggcaccttgtgagcatatattccactcaggctgtttacaacgatggatggacatcaagatggagtgcccaacttgcaggcgctccctaccgccagcttagatgagggctttgtaccatatagttaacaagaagtaggtagctcagcttatacaaggtggaaactgaggtacaataaggcgaggctgcaactgcatgaaagctatcgacataactgtagagaagttttatgctattgattttaagtggtgttgtgttgtacgaactattgtatcaagtgtcccacggagaaatcgtcctcagctgcccttgcggttttcactgtcgc

SEQ ID NO: 38070 - protein, 146 aa, Panicum virgatum
  misc_feature: Ceres CLONE 1992346-R
  misc_feature (96)..(139): Pfam Name: zf-C3HC4 Pfam Description: Zinc finger, C3HC4 type (RING finger)
  misc_feature: SWISSPROT Homolog: EC 6.3.2.19 Ubiquitin--protein ligase
VIKDTEKPLHPQYILGMTVTRLAIPLYIFGCPSNFMRIEPDKKWCIAVTAFMGIQAAVLLLQHYLGSRCFIPRQILPEKYCYHRKVEDSTNQPIDCVICMTTIDLTQRTSEYMVAPCEHIFHSGCLQRWMDIKMECPTCRRSLPPA

SEQ ID NO: 38071 - DNA, 1393 bp, Panicum virgatum
  misc_feature: Ceres CLONE 1992346
accaaagtcgccgccctcccttcccttccccctccccctccccctccccctccgccgtcacctaccttccctccacctctccacccgcccgtttgaccccgtcccctgctcgctttccccttccgttcccctcccccacctgctcctccgccagccgccccgtcctaggtttagcgcgctccccagaacccaaccgcctccctccgggccgcccggagagagcagttgcctggccgcacgccgcgggcccccgcatggtcgcctccgcgacggcgtgagggctgcgcgcgctcgtggtgtgcatcggggagatagagagatagatagatgagaccctccgccgctgccggccgcagcggcgctgtgatgagggccgctgctgtggggctcgtgctggtcggcgtcgccctagccccgccgctggccgcggcgctgcggccgctccgggagcgcgtcgcgtccgccggagcctcctcctccgccggttcgtggggcgatgagcacgccttcttcaaaagggatgataatgatataggcccctattcatggaatattacgggaacgtataaagggagctgggcctttgctggtgccacaaatggttcatctaggtttcttgagtttgtgaaatctaaaggtgattcggttctggaattgttgagcactccaacaaagataagcggggtgcattatgttcagggatcaattacattccatgatgtcattgacaatgcccacgatcatggagtggctcaaataaggttggaaggagtgtacatatggccttttagacaacttcggatggtagcaaacaatggtgcagatggtgagccacttcaagaagaggattactttttgtcaaatccataccatttgctccggattttctcctctcaagtattccaagaatcttctgaagagaagaaccgaaggaagaattctctcacatatgacatggagaaacactgtaacacagaaattgctgctaaggtggttcgcgtgtcatctaacccaaatgatggcgagcatgagaagtaccggttggagggtttgatggagagcccagccgtcgatgatgatggagagtgcttctcacctatcttactaaatgcgacttctttgaatgttgaagtctattacaacaaagcagtcaactacacactgatggtcacttttatctctttccttcaagttttgctgttgattagacaaatggagcatagcaacactcaatctggagctgctaaggtttctattttaatgattggccaacaagctattatggatgcatatctctgtctgctccacctgactgctgggatattggttgagtcgctgtttaacgccttcgcaacggctgcattcttcaaatttgttgtattttctatttttg

SEQ ID NO: 38072 - DNA, 1425 bp, Panicum virgatum
  misc_feature: Ceres CLONE 1992350
  misc_feature: Encodes the peptide sequence at SEQ ID NO. 38073
cccttctttctcctagcctcctcgaccggccggcctcatccgctcccgctcgctctcgtctcgcccgcgcgcgcacctttgcgtgctcgctccttcctttccccgcgtgctctggcgcgcgcaaggatcaaaaggcaccccgcccgccactagcggcgactggcatgtaacgcgcgctgcccggcagccgtgatcttaaaaggggcgcgcggcgggagacaagaaggctagcaggtcttggccggcagcaatctttgcgaatccgcaagagattctgtctgctttcctgcgcggttgattcgcggaggggttgactgtgttggcagctgcggggggccatggacgaggcggaggagatgcaggtggagaggctgcacgagggggccgacgcggggggcgccgacacggacaagctcagctacgagattttctccatcctcgagagcaagttcctgttcggctacaccgacccgcaccagctctggctgcccaaggcgccgccgccggcgcaggcgtcggcggcggctgcggcggcggcggtcgcgccagggaaggcggcgcagcgggggaaggtctgcgtgctctgcgtagacggcggcgggggcgggctgcgggcgctgctggccggccgcgcgctggcgcacctggaggcggcgctccgccgcgcgtcgggggaccctgacgcccgcgtcgccgactacttcgacctcgccgccggcaccggcgcggggggcgtgttcgcggcgatgctcttctccacgcactcgcgcggcgcgccgctgttccacgccgacgacacgtggcggctcgtggcggaccacgcgccgcggatgttccgcaggcccgcgggctcctcggcctccctgttctgccgcgggaagaagcgtccgctggcagcgcccacggcggcgctggaggcggccatgaggtccgcgttcggcgaggagctcaccctgcgggacaccatcaagcccgtgctcatctcctgctacgacctcaagacgtccgcgccgctggttttctcgcgcgccgacgccctggagaacgagagctacgacttccgcctctgcgaggtcggccgcgccgcgtggtccgaggccggccgcttcgagcccgccgaggtgtcctcggtggacggcgccacgtcctgcgccgccgtggacggcgggcccaccatgggcagcccggcggccgccgccatcacgcacgtgctccacaacaagcacgagttcccgttcgtgcgcggcgtcgaggacctgctcgtgctctccatcggcggctgctccggcggaggccccggcgccgccgccgacgcggacctcccgcgtatgcaccggtggggtcccaaggagtgggcgcgccccatcgcccgcattgcggccgacggcgccgccgacctggtcgaccacgccgtggcgcgcgcct

SEQ ID NO: 38073 - protein, 362 aa, Panicum virgatum
  misc_feature: Ceres CLONE 1992350
  misc_feature (87)..(288): Pfam Name: Patatin Pfam Description: Patatin-like phospholipase
MDEAEEMQVERLHEGADAGGADTDKLSYEIFSILESKFLFGYTDPHQLWLPKAPPPAQASAAAAAAAVAPGKAAQRGKVCVLCVDGGGGGLRALLAGRALAHLEAALRRASGDPDARVADYFDLAAGTGAGGVFAAMLFSTHSRGAPLFHADDTWRLVADHAPRMFRRPAGSSASLFCRGKKRPLAAPTAALEAAMRSAFGEELTLRDTIKPVLISCYDLKTSAPLVFSRADALENESYDFRLCEVGRAAWSEAGRFEPAEVSSVDGATSCAAVDGGPTMGSPAAAAITHVLHNKHEFPFVRGVEDLLVLSIGGCSGGGPGAAADADLPRMHRWGPKEWARPIARIAADGAADLVDHAVARA

SEQ ID NO: 38074 - DNA, 640 bp, Panicum virgatum
  misc_feature: Ceres CLONE 1992350-R
ccgtgcggcccggacggggagtacgagccgacgccagcgaacgtgcgcgctctgctggcggcggcggacgagatgctgaagcagcggaacgtggagtcggtgctgttcgaggggcggcgggttggggagcagacgaacgcggagaagctggaccgcttcgcggccgagctcgtcgccgagcaccgcagcaggggatcccggatcgcgcccaccgtcgcgttcaagcaggcgccgcagaagccgtcggcgctgggctgagctggtgacgccgtggacctgtggcgtcgagggcatgtaggcctcgaactccctttctccttgggctcgcggctggaatcctgctgcatattttttacgcggcagcgtggcatggcgatgcggcattgctcccggatgcattcgccgctgtcaactttgacgaagaggggaaaatatcaaaggaatatttgcaatatatgtttgattttcagttgaacttaggagacaatgtagttttgtacatgcataatttactgtcccttctactgccgaaatttatttttcgctcggggctttcgacttttaagtgtcggtagagcttgctgtataccattccgtgcaaaattacacctaagatacatcccagacatcttttcagcct

SEQ ID NO: 38075 - DNA, 1431 bp, Panicum virgatum
  misc_feature: Ceres CLONE 1992379
  misc_feature: Encodes the peptide sequence at SEQ ID NO. 38076
attttttctttttaggtttctcccgttcatttcgcccttgcccttccactgtgcttgccaccacttcccacggggaaccaacctcctcgatcccgtcccgaacccaccgccggcggcagcggaggcggaggcgagtggcggcggagaacgcccccgaggtcacacctactcggatcggatttgcctccgcggttcctgattgattggtcgctcggagcgatgggaggaggggcgtggtggtctccatagggaactctcgattgcgtcctagttgtgatggcttcgactgcggcccctgaggtcgtcgcggagaagaaatgcgacaaaaccgtcgcgggtaagcgtaacgccgcaccattgacttgccaagggcagtccaaggactcggctgagaacgccagcaaactggggcctgcttcgccgagtgaaatcacgaccagcgatgagcctacatccagtggggtcaaagaaagcagcaattctgctgatggttctgtgaagctggatgacagtgaagatgccgagaagagctccctacggggaagtgctaaggatagctctgtgtctgctaaatgcagtgacagggcaagcagcctgtccaaagcgagtgggagcgccaaggtcagcgaccaagctgctgatatgattgagagtggcaagagtagcctctatcgggcgagtggtggcagtgatgtgagtgatgagagcacctgcagcagtatatgcagcagtgtcagcaagcctcacaagtccaatgactcaaagtgggaagcgattcaggtggtccgagcgaaggaaggctcagtaggtctaagtcatttcaggctgctcaagaggcttggctgtggtgacattggcagcgtgtatttgtcggagcttagtggcacaaaatgctactttgctatgaaaattatggacaaggcatctctagcaaaccgcaaaaagctgctgagggcacaaactgaaagggagatattgcagtgcctggaccatccttttcttccaacattgtacactcactttgaaacggataagttctcatgcttggtgatggagttctgccctggaggtgacctgcataccctaaggcaaaagcagcctggcaagtatttccccgaacaagctgccaagttttatgtagcagaggttcttctggctcttgaatacctgcacatgcttggtatcatatatcgtgatttgaagccagagaatgttcttgtgagagaagatggccatatcatgttgtcagattttgatttatccctccgatgtgctgtgagccctactcttctcagatcttctaacctcagtgcagataaccaaaagagcaatccagcttactgtgtgcagcctgtgtgcattgagcctgcctgcatccagccatcttgtgtcacgacaaccacatgcttctctcctcgctttttctcctcc

SEQ ID NO: 38076 - protein, 384 aa, Panicum virgatum
  misc_feature: Ceres CLONE 1992379
  misc_feature (182)..(383): Pfam Name: Pkinase Pfam Description: Protein kinase domain
  misc_feature: SWISSPROT Homolog: EC 2.7.11.1 Non-specific serine/threonine protein kinase
MASTAAPEVVAEKKCDKTVAGKRNAAPLTCQGQSKDSAENASKLGPASPSEITTSDEPTSSGVKESSNSADGSVKLDDSEDAEKSSLRGSAKDSSVSAKCSDRASSLSKASGSAKVSDQAADMIESGKSSLYRASGGSDVSDESTCSSICSSVSKPHKSNDSKWEAIQVVRAKEGSVGLSHFRLLKRLGCGDIGSVYLSELSGTKCYFAMKIMDKASLANRKKLLRAQTEREILQCLDHPFLPTLYTHFETDKFSCLVMEFCPGGDLHTLRQKQPGKYFPEQAAKFYVAEVLLALEYLHMLGIIYRDLKPENVLVREDGHIMLSDFDLSLRCAVSPTLLRSSNLSADNQKSNPAYCVQPVCIEPACIQPSCVTTTTCFSPRFFS

SEQ ID NO: 38077 - DNA, 678 bp, Panicum virgatum
  misc_feature: Ceres CLONE 1992379-R
  misc_feature: Encodes the peptide sequence at SEQ ID NO. 38078
tgccaccagagattataaagggcgaggggcatggaagtgctgtggactggtggacatttgggatattcttgtatgaacttctttttggcaagaccccattcaaaggttctggcaatagggcgactttgttcaatgtagttggacagcccttaaggttcccagaatcaccagtagtgagtttcgccgcaagggatcttattagggggttgctcatcaaggaaccgcagcatcgattagcttataagcgtggagccacagaaataaaacagcatcccgtcttcgaaggtgttaactgggcattgataaggtgtgctacaccaccagatatccccaagccagtcgagatccctcgttcagtagcctcgtcaagccagaaggctacatcaacagctgagaaaggttcagactatcttgagttggagttcttttagtggagtcatctatgatcccccatgtgcaagttgtaaagtttatcttttttccccttagacttatttttcatcttctctggattctaataactttatatgtagatgcatatggtcctagtgtcgttctctttcagtttggttctcagtccatttcattagatgggaaccccaaccaggtggagtttgtaatctgtcattggttaccctgcactaggttctgccaataacatggaaacatttttcgttc

SEQ ID NO: 38078 - protein, 142 aa, Panicum virgatum
  misc_feature: Ceres CLONE 1992379-R
  misc_feature: SWISSPROT Homolog: EC 2.7.11.1 Non-specific serine/threonine protein kinase
  misc_feature: Useful for making plants with modulated light quality sensitivity
PPEIIKGEGHGSAVDWWTFGIFLYELLFGKTPFKGSGNRATLFNVVGQPLRFPESPVVSFAARDLIRGLLIKEPQHRLAYKRGATEIKQHPVFEGVNWALIRCATPPDIPKPVEIPRSVASSSQKATSTAEKGSDYLELEFF

SEQ ID NO: 38079 - DNA, 1592 bp, Panicum virgatum
  misc_feature: Ceres CLONE 1992389
  misc_feature: Encodes the peptide sequence at SEQ ID NO. 38080
acgccgaaacacaccgacttcggctcacatatccgcgccgggccgccggcacggcggtgcagcaccgcgccaccgcctctcggagaatcgaagccgtctgggcggggcgcgatggatctgctgaagcgggagctggagaagaagcggaaggcggcgtcggccgacttcggcgggaagagcttcgtgcggcggtcggagctggagcagaagcagctccagaagcgccgcgacgagcaacgccagctcctcgccaaggccggcgcatctgcgccgccccccgattccgccgcaggcgcagcgggctccgaccccagcaaccccgacgccgcggcccaggcgacggcggggaaccctaaccctagctcctccacctccgcggcggcggcctccatcccgcccgccctcgcgccgaagaagaccacgcaggaggaggcgctgctatccgaggagcgccgcatcgacgagctcgacctcccgcggcacgaggtggtgcggcgcctccgcgtgctgcgcgagcccgtcacgctcttcggggaggacgacgacgcccgcctcgcgcgcttcaagctcattctcaagtccggcgtcatagatgacatcgatgacatcgacatgaccgaggggcagaccaacgacttcctccgcgacatgatcgagatgcgcaagcggcaaaagtcagggagggatacctacgccaagggcaaggggaagcgggtcggtggcggtgatggtggtgacggaggacctgctggggacagtgcagatgatggggacggcaagggtagcggggatgatgccgaagcagacaaggactccaagaggatgaggaccaagtttgaggagctttgcaacgaagacaagattttggtgttcttcaagaagctgcttaacgagtggaaccaggagctggatgagatgtcagagctggagaagcggactgcaaaagggaagtcaatggttgcaacatttaagcagtgtgcgcggtatctcagccccctgttcgagttctgcaggaagaaggttcttcctgatgacatccgtcaagcattgctcgttattgttgaatgctgtatgaagcgtgactatttagcagcaatggaccaatacatcaagctggccattgggaacgcaccatggcccattggagtcactatggttggtatccatgagcgttctgcccgtgaaaagatctacacaaacagtgttgcccatatcatgaatgacgagaccactcgcaagtaccttcagtcgatcaaaaggctaatgaccctttgccagcggcgttatcctgcgctaccctcgaaatcagtggagttcaacagcctggcaaatggaagtgacctgcaggtgcttttatcggaggagaatggttcgggaaaagcttctgaggaaaggctccggttgatgcctgcatcgaaagagtgatgctttggtacgctagcttggatcaaaaatatagttagagatgtttgtgtaatatcaacctcagttttcccctgccatttctttttctgtattgttccaatgaagggaacagcagctgaattatggatgttaatgaagttacttaaaaatatatcatgtttaccact

SEQ ID NO: 38080 - protein, 437 aa, Panicum virgatum
  misc_feature: Ceres CLONE 1992389
  misc_feature (251)..(395): Pfam Name: Prp18 Pfam Description: Prp18 domain
  misc_feature (126)..(155): Pfam Name: PRP4 Pfam Description: pre-mRNA processing factor 4 (PRP4) like
MDLLKRELEKKRKAASADFGGKSFVRRSELEQKQLQKRRDEQRQLLAKAGASAPPPDSAAGAAGSDPSNPDAAAQATAGNPNPSSSTSAAAASIPPALAPKKTTQEEALLSEERRIDELDLPRHEVVRRLRVLREPVTLFGEDDDARLARFKLILKSGVIDDIDDIDMTEGQTNDFLRDMIEMRKRQKSGRDTYAKGKGKRVGGGDGGDGGPAGDSADDGDGKGSGDDAEADKDSKRMRTKFEELCNEDKILVFFKKLLNEWNQELDEMSELEKRTAKGKSMVATFKQCARYLSPLFEFCRKKVLPDDIRQALLVIVECCMKRDYLAAMDQYIKLAIGNAPWPIGVTMVGIHERSAREKIYTNSVAHIMNDETTRKYLQSIKRLMTLCQRRYPALPSKSVEFNSLANGSDLQVLLSEENGSGKASEERLRLMPASKE

SEQ ID NO: 38081 - DNA, 696 bp, Panicum virgatum
  misc_feature: Ceres CLONE 1992410
  misc_feature: Encodes the peptide sequence at SEQ ID NO. 38082
agagacatgtggacaaaccccgtggtaagcacaagcacccctggcaattacagcacggccgcgtgcaccagtgttggctgctgccagacgcccatccccatcggccgcccttcctacacggtaaaattcaagatccttgatgtcgagtacactgaaattctacccaatgcggtgcgcatcgccgagaggggttggtttgataccgttgcctcgaagatgctgaacaagtcagcgactgccgaagaagagaaccgggctccggttccggtggtgctggagtgggcggtgaagtccaacctggtggtaccaccgatatcctccggcgatgccaccaactcatcctgccccacggatgctgttgggactgcctgccgcagcagccacagcacctgccacagcgtcaccaacaactaccgaactggctacgtgtgccagtgccagcacgggtacgctggcaacccgtacctcgctggcggatgccgagatatcgatgagtgcgcattgccagggaaatgcttcggcgtgtgtacgaacacggctggatcgtatgaatgtcggtgtccgcgcggtgctcgtggtaacccgcacatagcagatgcctgtgtcaaatcttctctagggttaagcattggcctcggacttggcagtggtgctggtcttttggtcctggtacttggtgctgcgtttgcgagtctt

SEQ ID NO: 38082 - protein, 231 aa, Panicum virgatum
  misc_feature: Ceres CLONE 1992410
  misc_feature (162)..(201): Pfam Name: EGF_CA Pfam Description: Calcium binding EGF domain
RDMWTNPVVSTSTPGNYSTAACTSVGCCQTPIPIGRPSYTVKFKILDVEYTEILPNAVRIAERGWFDTVASKMLNKSATAEEENRAPVPVVLEWAVKSNLVVPPISSGDATNSSCPTDAVGTACRSSHSTCHSVTNNYRTGYVCQCQHGYAGNPYLAGGCRDIDECALPGKCFGVCTNTAGSYECRCPRGARGNPHIADACVKSSLGLSIGLGLGSGAGLLVLVLGAAFAS

SEQ ID NO: 38083 - DNA, 670 bp, Panicum virgatum
  misc_feature: Ceres CLONE 1992411
  misc_feature: Encodes the peptide sequence at SEQ ID NO. 38084
ggagcagccacacaacactcgtgtccataacacgatcgatctcctggactgcgagccgcttcagcacacccatggccatgatcttggcaacaacaaccttgttcaggtgtggtggctacccgccctgtaaaccaaatcttcctgctggtagaaacaggccaccaacaaaagcagcagcagctgctggtgctggcaatggcgtccgagtgatcaaccgccgcagctggaggtgcaggagtacggctgcagctacagcgagtagagatgatactacggccggacgccgccggcaagagaagaagaagaacatcgtggacgaggaggaggaatggcgtagctacctggcgccggagaggctggaggtgctgagggagattgagccgtgggtggagaagcacgtgctgccgctactcaagccggtggaggcatcctggcagccgtccgacctgctgccggaccctgcgacactgggcagcgacggcttccacgccgcgtgccttgagctccgggagcgggcggcgggtgtgcccgacgagctcctcgtgtgcctcgtggccaacatggtcacggaggaggcgctgcccacgtacccgagcgggctgaaccgcttcgaggtcgtgcgtgacgccacgggcgccgacgccaccgcgtgggcgcgctggatccccgg

SEQ ID NO: 38084 - protein, 199 aa, Panicum virgatum
  misc_feature: Ceres CLONE 1992411
  misc_feature: SWISSPROT Homolog: EC 1.14.19.2 Acyl-[acyl-carrier-protein] desaturase
MAMILATTTLFRCGGYPPCKPNLPAGRNRPPTKAAAAAGAGNGVRVINRRSWRCRSTAAATASRDDTTAGRRRQEKKKNIVDEEEEWRSYLAPERLEVLREIEPWVEKHVLPLLKPVEASWQPSDLLPDPATLGSDGFHAACLELRERAAGVPDELLVCLVANMVTEEALPTYPSGLNRFEVVRDATGADATAWARWIP

SEQ ID NO: 38085 - DNA, 407 bp, Panicum virgatum
  misc_feature: Ceres CLONE 1992411-R
  misc_feature: Encodes the peptide sequence at SEQ ID NO. 38086
gtacccggtgtccgaataccgcagcatcctcgagcacgttatgcggcagtggcgcgtgtgggacctcacggcagggctctccagcgacgggaggcgagcacaggattacctgggcgcgctgccccacaagatcaagagaatggaggagaaggcccacgatagggcggtcaaggcaaaaaagaagaccacactcatccggatcaactggatctttgataggcccatcagcgttgttgtaccctaatattcctgcgatgcgcggtagtattttttcttcttgggtatcgtacccttcttattagttcgttagtagtatttgctttatagattcacgtgagtttttctcatcgcagtgtttaggtaactgttgtatgttgtcctatatatctaaatgacatgatacgtgt

SEQ ID NO: 38086 - protein, 80 aa, Panicum virgatum
  misc_feature: Ceres CLONE 1992411-R
  misc_feature: SWISSPROT Homolog: EC 1.14.19.2 Acyl-[acyl-carrier-protein] desaturase
YPVSEYRSILEHVMRQWRVWDLTAGLSSDGRRAQDYLGALPHKIKRMEEKAHDRAVKAKKKTTLIRINWIFDRPISVVVP

SEQ ID NO: 38087 - DNA, 598 bp, Panicum virgatum
  misc_feature: Ceres CLONE 1992412
  misc_feature: Encodes the peptide sequence at SEQ ID NO. 38088
atcgaagcgcggcaacaccagtaaatcaaaccacaggagatgggcgccatgaagaggtcaccgctggtgctggtgctcctgctcttcctgtgctcctccctcgcgctcgcgtcctactcgtacggggaggacggctccggctccggctccgggcggccgtaccactacggcgaggagagcttccggcactggacgcgctcccggcaggggcggttccgggtgctggagcggttcacgcacgagctgctcgaggacgccgtcggcaactaccgcgtcgccgagctggaggccgcgccgcgcgcgttcctgcaacccagccactacgacgccgacgaggtcatgttcgtcaaggagggcgagggcgtggtcgcgctgctctacagggggaggagggagtcgttctgcgtcagggagggcgacgtcctcgtcatcccggccggcgccgtcgtctactccgccaacacgcacgcctcccgctggttccgcgtcgtcatgctcctcaaccccgtctccaccacgggacgcttcgaggaattcttccccatcggaggcgagagcccggagtccttcttcagcgtcttcagcgacgacgttctcc

SEQ ID NO: 38088 - protein, 186 aa, Panicum virgatum
  misc_feature: Ceres CLONE 1992412
  misc_feature (48)..(174): Pfam Name: Cupin_1 Pfam Description: Cupin
MGAMKRSPLVLVLLLFLCSSLALASYSYGEDGSGSGSGRPYHYGEESFRHWTRSRQGRFRVLERFTHELLEDAVGNYRVAELEAAPRAFLQPSHYDADEVMFVKEGEGVVALLYRGRRESFCVREGDVLVIPAGAVVYSANTHASRWFRVVMLLNPVSTTGRFEEFFPIGGESPESFFSVFSDDVL

SEQ ID NO: 38089 - DNA, 653 bp, Panicum virgatum
  misc_feature: Ceres CLONE 1992432
  misc_feature: Encodes the peptide sequence at SEQ ID NO. 38090
atcttcagcgtcaaagggagagggaggcgagcctcagccctcaggaaggagcaatggcggcggagtcgctgtccggtttcttggacatccgcgcggcggcgccgttcctggtggcggcggtggccttctacttcctggtggagcagctgtcgtaccaccgcaagaagggccccctgccgggcccgccgctcgtcgtgccgttcctcgggagcgtcgcccccatgatccgcgacccgacggggtactgggacgcgcaggcggcgcgcgccaagaagtccggcgcggggctcgccgccgacttcctggtcgggcggttcatcgtcttcatccgcgactcggagctgtcgcagcgcgtgttcgccaacgtccgccccgacgcgttccacctcatcggccaccccttcggcaagaagctcttcggggagcacaacctcatctacatgttcggcgaggagcacaaggacctgcgccgccggatcgcgcccaacttcacgccgcgcgcgctctccacctacgccgccctccagcagcgcgtcatcctggcgcacctccggcggtggctggaccggagcgccgccgagggcgggcgggccttccccatacgggtgccctgccgcgacatgaacctggagacctcgcagacggtgttcgcg

SEQ ID NO: 38090 - protein, 199 aa, Panicum virgatum
  misc_feature: Ceres CLONE 1992432
  misc_feature: SWISSPROT Homolog: EC 1.14.13.79 Ent-kaurenoic acid oxidase
  misc_feature: Useful for making plants with altered sterol content
MAAESLSGFLDIRAAAPFLVAAVAFYFLVEQLSYHRKKGPLPGPPLVVPFLGSVAPMIRDPTGYWDAQAARAKKSGAGLAADFLVGRFIVFIRDSELSQRVFANVRPDAFHLIGHPFGKKLFGEHNLIYMFGEEHKDLRRRIAPNFTPRALSTYAALQQRVILAHLRRWLDRSAAEGGRAFPIRVPCRDMNLETSQTVF

SEQ ID NO: 38091 - DNA, 1463 bp, Panicum virgatum
  misc_feature: Ceres CLONE 1992450
  misc_feature: Encodes the peptide sequence at SEQ ID NO. 38092
agcaaccaaggcacgcctgcacttgcagctcctcatcgtccccgagagtgcgtgtcctggttcggtcgtgccgtgtacaccacctcgatctgctccgccgctaccggccatggcgtcgccgttctccgtgccttccctgatcatggaggaggaagggcggttcgaggcggaggtggcggaggtggagtcgtggtggggcacggagcgcttccggctcaccaagcgcccctacgccgcccgcgacgtcgtcctcctccgcggcacgctccgccagagctacgcctcgggggagatggccaggaagctgtggcgcacgctccgggcgcaccaggccgccggcaccgcctcccgcaccttcggcgccctcgaccccgtccaggtcaccatgatggccaagcacctcgacaccatctacgtctccggctggcagtgctcctccacccacacctccaccaacgagcccggcccggacctcgccgactacccctacgacaccgtgcccaacaaggtggagcacctcttcttcgcccagctctaccacgaccgcaagcagcgggaggcgcgcatgtcgctgccccgcgccgaccgggcccgcacgccctacgtcgactacctcaagcccatcatcgccgacggcgacaccggcttcggcggcgccaccgccaccgtcaagctctgcaagctcttcatcgagcgcggggcggccggggtccacctcgaggaccagtccttcgtcaccaagaagtgcggccacatggcgggcaaggtgctcgtcgccgtctccgagcacgtcaaccgcctcgtcgccgcgcgcctccagttcgacgtcatgggcgtcgagaccgtcctcgtcgcgcgcaccgacgccgtcgccgccacgctcatccagaacaacgtcgacgcgcgcgaccaccagttcatcctcggcgccaccaacccgcgcctcaggggccggagcctcgccgccgtgctctccgacggcatggcggcaggtaagagcggccgggagctccaggccatcgaggacgagtgactcgccgcggcgcagctcaagaccttctccgactgcgtcagggactccatcgcggggctcagcgccaccgaccaggagaagcagcgcaggctccaggagtgggacagcgccaccagctacgacaagtgcgtgcccaacgaggaggcgcgcgacatcgcggcgcgcctcggcgtcgcgttcgtgttctgggactgggacctgccgcggaccagggaggggttctaccgcttccggggctccgtggcggcggccgtcgtccgcggccgcgccttcgcgccgcacgccgacgtgctctggatggagacgtcgagccccaacgtggccgagtgcacggccttcgccgagggcgtcaaggcggcgcacccggaggcgattctggcctacaacctctcgccgtccttcaactgggacgcctccgggatgacggacg

SEQ ID NO: 38092 - protein, 307 aa, Panicum virgatum
  misc_feature: Ceres CLONE 1992450
  misc_feature (21)..(307): Pfam Name: ICL Pfam Description: Isocitrate lyase family
  misc_feature: SWISSPROT Homolog: EC 4.1.3.1 Isocitrate lyase
MASPFSVPSLIMEEEGRFEAEVAEVESWWGTERFRLTKRPYAARDVVLLRGTLRQSYASGEMARKLWRTLRAHQAAGTASRTFGALDPVQVTMMAKHLDTIYVSGWQCSSTHTSTNEPGPDLADYPYDTVPNKVEHLFFAQLYHDRKQREARMSLPRADRARTPYVDYLKPIIADGDTGFGGATATVKLCKLFIERGAAGVHLEDQSFVTKKCGHMAGKVLVAVSEHVNRLVAARLQFDVMGVETVLVARTDAVAATLIQNNVDARDHQFILGATNPRLRGRSLAAVLSDGMAAGKSGRELQAIEDE

SEQ ID NO: 38093 - DNA, 631 bp, Panicum virgatum
  misc_feature: Ceres CLONE 1992450-R
  misc_feature: Encodes the peptide sequence at SEQ ID NO. 38094
gctacgtctggcagttcatcacgctcgccggcttccacgccgacgcgctcgtcaccgacacgttcgcccgggacttcgcgcggcgcggcatgctggcgtacgtggagaggatccagagggaggagaggatcaacggggtggagacgctggagcaccagaagtggtcgggcgccaacttctacgacagggtgctcaagaccgtgcagggcggcatctcctccaccgctgccatgggcaaaggagtaactgaagagcagttcaaggactcttatcctgcaactggaactggtggtggtaccagtcttcaagttgtcgccaaatccaggatttgatgaggactgatgagaaagaacaatgattcagagccagaggaggctctaaataaatgaaaataataaaggagcctcagatcatcagccacggggggatgctatatatatatacagattgcactatgatgatgggcttgcacgaaccaaccaatcgcctagctgcatagatacatatatggatcgaattatatgacttgtgacaccttgtggaacagtcacttgggttgaaagtattgaaatgtcaaccttcacgattatttataaatcgaaattgaataaatcatacgatttccggtacc

SEQ ID NO: 38094 - protein, 109 aa, Panicum virgatum
  misc_feature: Ceres CLONE 1992450-R
  misc_feature: SWISSPROT Homolog: EC 4.1.3.1 Isocitrate lyase
YVWQFITLAGFHADALVTDTFARDFARRGMLAYVERIQREERINGVETLEHQKWSGANFYDRVLKTVQGGISSTAAMGKGVTEEQFKDSYPATGTGGGTSLQVVAKSRI

SEQ ID NO: 38095 - DNA, 596 bp, Panicum virgatum
  misc_feature: Ceres CLONE 1992456
  misc_feature: Encodes the peptide sequence at SEQ ID NO. 38096
ataggctgccctgccctcccgccgaatgcggctcccggccgccgccgccggaagatagacccacatcgtcttctgtcttcgtccgcggggcgggtgcccgctctcgccgagcgacatctcgctgctggttctcgacatctgcttacccatctggatgtgcacatggtgaagatttgctgtgtccgcgctgggtatgtcggcggcccaatcatggccgtccttgccctcaagtgccctgacattgaggtcctcgtctttgacatctcctacccccgcattgaagcctggaacactgacaccctccccatctacgagcctggactccatgatgttgtgaatcagtgtctgggctagaacctcttcttcatcactgatgttgataagcacgtcactgacgctgacatcatctttgtctcggtgaacacccccaccaatacccgtggtcttggagctggcaaggctgcccacctctcctactgggagagcgctgctcgcatgatcgctgatgtctccgattctgacaagatcgttgttgagaagtccactgtcgctgtcaacactgctgacgctattgagaagatcttgacccacaacag

SEQ ID NO: 38096 - protein, 63 aa, Panicum virgatum
  misc_feature: Ceres CLONE 1992456
  misc_feature: SWISSPROT Homolog: EC 1.1.1.22 UDP-glucose 6-dehydrogenase
  misc_feature: Useful for making plants with altered carbohydrate content
  misc_feature: Useful for making plants with altered cell wall content and/or composition
MVKICCVRAGYVGGPIMAVLALKCPDIEVLVFDISYPRIEAWNTDTLPIYEPGLHDVVNQCLG

SEQ ID NO: 38097 - DNA, 1520 bp, Panicum virgatum
  misc_feature: Ceres CLONE 1992467
  misc_feature: Encodes the peptide sequence at SEQ ID NO. 38098
aacgaacgctaaaaaagtaacagtttctgtactttattgaaccttcctacgatcaacatgcgtcgtgttgcgaccgtcgccgcgatgtgcctcctggcaagcgccgccagcgcgaaggtgtacttccacgagtccttcgacgacggcgcggacaagtgggtccagtcggagagcaaggccgactacggcaagctcgccgcgacgagcggcgatttcttcggcgacgctcagatcaacaagggcctcaaaacgacccaggacgccaagttctacgcgttttccgtggcgctgcccgaggccgtgtcgaacgaagggaagaacctcgtcgtgtcgctgagcgtgaagcacgagcagggcctcgactgcggcggtggctacatcaaggtgatgcccgagatggaccagaagaagttcaacggcgacagcgagtactacctcatgttcggccccgaccagtgcggctacaacaagaaggtgcacgtcatcttcggctacaacggcaagaacctcctctggaagaaggagccccgctaccccgacgacaagctcacgcacgtctacacgctcgtcgtgaccccggagaacacctacgagttctacatcgacaaggagaagaaggagtccggctccctcgaggccgactgggccttcctcgagcccaaggagatcgacgacgtcaccgacaagaagccgtcggactggatcgatgacgcgatgatggacgatgcggaggacaagaagcccgaggactgggacgcggaggcggagaagatcgtcgacccggacgcgaagcagccggaggactgggacgaggaggaggacggcaagtgggaggcgccgatggtcccgaaccccaagttcaagggcgagtggcgcgcgaagcgcatcccgaaccccgcctacaagggtgcgtggaagccgaagcaggttgcgaacccggcgtacaaggaggacgacaagctgtacatgacacgcaagccactgtcggtggtcggtatcgatgtgtggcaggtcaagtcgggctctgtgttcgacaacatcatcatcggtgacaacctcgatgaagtgttcgagatcgtcgacaagacgtggggcgcgaccaaggacgccgagaaggcggcgctcgacgcgcaggacaagaaggacgcgcccgcggaagccccccaggccgaggaggacgcgaaggaagacggcgaggccgacgaggagaccgacaaggaggacctgtagtcgttcaatgcaggatgaaatccgcagcgcgtgtatgtgcggaggcatctcgcgttcttattaccactggttaaccatcgttcggaaggcaacggcgtcgcacgcccttcctgcgcctgctgtgtgcgatcgtgggcattggaagcgatttgtgcgccgtgattcggatcgtgatcgttctgcgctcgctggggcccttattggcctcattagttcaacccgattcggtgctcgctgcgttgagtacacgcacgggtgagtgtaatctcgctctgcactcggggaggtcg

SEQ ID NO: 38098 - protein, 390 aa, Panicum virgatum
  misc_feature: Ceres CLONE 1992467
  misc_feature (21)..(330): Pfam Name: Calreticulin Pfam Description: Calreticulin family
MRRVATVAAMCLLASAASAKVYFHESFDDGADKWVQSESKADYGKLAATSGDFFGDAQINKGLKTTQDAKFYAFSVALPEAVSNEGKNLVVSLSVKHEQGLDCGGGYIKVMPEMDQKKFNGDSEYYLMFGPDQCGYNKKVHVIFGYNGKNLLWKKEPRYPDDKLTHVYTLVVTPENTYEFYIDKEKKESGSLEADWAFLEPKEIDDVTDKKPSDWIDDAMMDDAEDKKPEDWDAEAEKIVDPDAKQPEDWDEEEDGKWEAPMVPNPKFKGEWRAKRIPNPAYKGAWKPKQVANPAYKEDDKLYMTRKPLSVVGIDVWQVKSGSVFDNIIIGDNLDEVFEIVDKTWGATKDAEKAALDAQDKKDAPAEAPQAEEDAKEDGEADEETDKEDL

SEQ ID NO: 38099 - DNA, 1882 bp, Panicum virgatum
  misc_feature: Ceres CLONE 1992470
  misc_feature: Encodes the peptide sequence at SEQ ID NO. 38100
aagcaaacgatacagtggtcagagggtccctgcgagcggacaagcaaagctctcttccatccttggagcagagttgcttgtgctgcaggaaggatcgatggccgatccggtggccaccgtggagaagatcgtcaaaatcgggctcaagatcaaggaggccgtgaacagggttcgccacaacgaggaggattgccgcgagatcacgaggcgcgtgctgaggttcagcgccatcctgttgcagctgcagcagacggggacggtggccgacagcccggcgctggccggtgcgctggaggacctggaggagaccctgcagcgtgccctcgagctcgtcacggcctgccaggagaggaccaccatccgccgcctcgtcgcggccggggacctgtccaagcagctgcgccgggtacaggatgacatcttgaacaaagtgatgctggcgtccttcgccatcaacgcccacaccaccatcttgttgcttacgattcaggctggtggtcagcctccgccccggcagcagcaagcagatgcaggactgacggatgtatcgaacaacattcattcaactgaagatgctaggtctcatttgaacggtgaggaaaacattgtaccaacagaaaacgatgccccctttgctcctttagaagccttaaaaaacttcagtttatctgagttaaaggatgctataaatggcggaaacatcataggagcatgtggattctggatggtctacaagggtgtattaatggatgggaatgtggtcgctatcaagacgtttgaagaaccacacctattaggctgtgggcgtgcacatgatcaactgctcctagcttcaaagcttcaacaccaaaacatagttaaagttctaggatatggccatgaagttgaaacacaaaaatcttcagtgataatgcggctgttgaaacacaaaaatcgtccagctaaaggaagaggctatttctgggttgaagaatatgtgccgaatggaaccttgtactcgaaaatccatgagtccttgcttgattggcattccgtctcccggatacttgagcaggtagcccagggcatacattacctacatgaacagcacgttgtccatagggatctgaaaccaagaaacatcctcttggattctgatatgaatcctaagattactgattttgacttatctatggtgttgaatgatgatgagatcagtgagattgatctcatagaaggcacttttggatatatggctccagaatacgctatgtatggtattgtgtcaatgaagaacgatgtatttgcttttggcgtcatcctcctggagatcgttggcctcagtatgtgcagatctaaacctcctgaacaccaccaccctaagtatgaatgggcttgggaggcttgggaagcaggactaacagaggagttgtttgatccatcaaagtatgaggagtctcagggaatggagatcattagaaggtgggtgcaggtaggactgctgtgtgttgaggaaaacagggaagaccggccctccattgcggatgttcttgagatgctgaatggcaaggaagagttgccgaccccaaagaaaccagcgtatttgatatcaaaaaaagggcgtacccagtgccgtaggcttcccgcactgtgcggggtctgggaaagggttgtgcgtatttgatatcagacgaagggaaatcagatgaagagggatctgcctagtgcctagtcagacgggtcgttgagcctcgtgtgtcctcgctagttagcttgtactacgccattgctttaggcattacgacaatgtgtgtctcatcattcgaggaagtgttgatcaacagattccagtgcgatgtcatgattttgtcaatgcaactcagttgatacactgagcttcacc

SEQ ID NO: 38100 - protein, 521 aa, Panicum virgatum
  misc_feature: Ceres CLONE 1992470
  misc_feature (197)..(481): Pfam Name: Pkinase Pfam Description: Protein kinase domain
  misc_feature: SWISSPROT Homolog: EC 2.7.11.1 Non-specific serine/threonine protein kinase
MADPVATVEKIVKIGLKIKEAVNRVRHNEEDCREITRRVLRFSAILLQLQQTGTVADSPALAGALEDLEETLQRALELVTACQERTTIRRLVAAGDLSKQLRRVQDDILNKVMLASFAINAHTTILLLTIQAGGQPPPRQQQADAGLTDVSNNIHSTEDARSHLNGEENIVPTENDAPFAPLEALKNFSLSELKDAINGGNIIGACGFWMVYKGVLMDGNVVAIKTFEEPHLLGCGRAHDQLLLASKLQHQNIVKVLGYGHEVETQKSSVIMRLLKHKNRPAKGRGYFWVEEYVPNGTLYSKIHESLLDWHSVSRILEQVAQGIHYLHEQHVVHRDLKPRNILLDSDMNPKITDFDLSMVLNDDEISEIDLIEGTFGYMAPEYAMYGIVSMKNDVFAFGVILLEIVGLSMCRSKPPEHHHPKYEWAWEAWEAGLTEELFDPSKYEESQGMEIIRRWVQVGLLCVEENREDRPSIADVLEMLNGKEELPTPKKPAYLISKKGRTQCRRLPALCGVWERVVRI

SEQ ID NO: 38101 - DNA, 520 bp, Panicum virgatum
  misc_feature: Ceres CLONE 1992472
  misc_feature: Encodes the peptide sequence at SEQ ID NO. 38102
gaatcaatatgcaactatgttctcaagcatcgtgtcaagagcggcgacgctggaggtgctgtccaccggcgtggcgggaaactacaacggcgcattgcaagtgatgttagtggaatttcaggtgccgtcgccactggtgccgaccagggagagctacttcgtgaggtactgcaagcagaacgctgatgggacatgggccgacgtggacgtctcattggacagcctgctccctggatctgtcctcaagtgccggcgcctgccgtctggctgcctgatccacgaaatgcccaatggctactcaaaggtgacatggatggagcacgttgaggtggacgacaggtcggtgcacaacatctacaagctgctggtgaactcaggccttgccttcagtgcacgcagatgggtcgggacgcttgatcgccaatgcgagccccttgccagcgttatggcaagtaacatccccgacaagttacattggtgttatcactagcactgaggggaggaagagcatgctgaaact

SEQ ID NO: 38102 - protein, 162 aa, Panicum virgatum
  misc_feature: Ceres CLONE 1992472
  misc_feature (1)..(144): Pfam Name: START Pfam Description: START domain
  misc_feature: The sequence is a functional homolog of SEQ ID NO 2670 in the 10/374,780 US patent application
  misc_feature: The sequence is a functional homolog of SEQ ID NO 334 in the 10/225,066 US patent application
  misc_feature: The sequence is a functional homolog of SEQ ID NO 666 in the 11/435,388 US patent application
  misc_feature: The sequence is a functional homolog of SEQ ID NO 244 in the 10/412,699 US patent application
  misc_feature: The sequence is a functional homolog of SEQ ID NO 424 in the 11/435,388 US patent application
  misc_feature: The sequence is a functional homolog of SEQ ID NO 519 in the 11/479,226 US patent application
  misc_feature: The sequence is a functional homolog of SEQ ID NO 58 in the 10/286,264 US patent application
  misc_feature: The sequence is a functional homolog of SEQ ID NO 2324 in the 10/374,780 US patent application
  misc_feature: The sequence is a functional homolog of SEQ ID NO 246 in the 10/412,699 US patent application
  misc_feature: The sequence is a functional homolog of SEQ ID NO 522 in the 11/479,226 US patent application
  misc_feature: The sequence is a functional homolog of SEQ ID NO 596 in the 11/435,388 US patent application
  misc_feature: The sequence is a functional homolog of SEQ ID NO 716 in the 10/225,066 US patent application
  misc_feature: The sequence is a functional homolog of SEQ ID NO 80 in the 10/286,264 US patent application
  misc_feature: The sequence is a functional homolog of SEQ ID NO 2656 in the 10/374,780 US patent application
  misc_feature: The sequence is a functional homolog of SEQ ID NO 326 in the 10/225,066 US patent application
  misc_feature: The sequence is a functional homolog of SEQ ID NO 70 in the 10/286,264 US patent application
  misc_feature: The sequence is a functional homolog of SEQ ID NO 130 in the 10/666,642 US patent application
  misc_feature: The sequence is a functional homolog of SEQ ID NO 92 in the 10/666,642 US patent application
  misc_feature: The sequence is a functional homolog of SEQ ID NO 244 in the 10/666,642 US patent application
  misc_feature: The sequence is a functional homolog of SEQ ID NO 540 in the 11/435,388 US patent application
NQYATMFSSIVSRAATLEVLSTGVAGNYNGALQVMLVEFQVPSPLVPTRESYFVRYCKQNADGTWADVDVSLDSLLPGSVLKCRRLPSGCLIHEMPNGYSKVTWMEHVEVDDRSVHNIYKLLVNSGLAFSARRWVGTLDRQCEPLASVMASNIPDKLHWCYH

SEQ ID NO: 38103 - DNA, 593 bp, Panicum virgatum
  misc_feature: Ceres CLONE 1992475
  misc_feature: Encodes the peptide sequence at SEQ ID NO. 38104
gttaccgcgcgagaacaggagccagttacacacgacacgcacccgctcgtcttcgtctccaccacccacctccgaatcccgccgctgcctcctccaccggcccctcgccgcgcgctcccgatgatcacgttcgcggacctgacggagccggtcgcggccgccggcgtggaccggcagctgtggctggcctgcgcgggcgggatgtgcaccgtgccgcccgtgggcgccagcgtctactacttcccgcagggccacgcggagcacgcgctgggcctcgccggggcggccgacctctccgcggcgcgcgtcccggcgctcgtcccctgccgcgtcgccgccgtgcgctacatggccgacccggacaccgacgaggtcttcgccaggatccgcctcgccccgctccgcgccggggaggcggacgccggccccgacgacgacgacgcggccgcggacgacgagcaggagaagccggcgtcgttcgccaagacgctgacgcagtccgacgccaacaacggcggcggcttctccgtgccgaggtactgcgccgagaccatcttcccgcggctcgactacgccgccgacccgcccgtgca

SEQ ID NO: 38104 - protein, 157 aa, Panicum virgatum
  misc_feature: Ceres CLONE 1992475
  misc_feature: The sequence is a functional homolog of SEQ ID NO 1185 in the 10/666,642 US patent application
  misc_feature: The sequence is a functional homolog of SEQ ID NO 1184 in the 10/666,642 US patent application
  misc_feature: The sequence is a functional homolog of SEQ ID NO 1186 in the 10/666,642 US patent application
  misc_feature: The sequence is a functional homolog of SEQ ID NO 442 in the 10/666,642 US patent application
  misc_feature: The sequence is a functional homolog of SEQ ID NO 1428 in the 10/666,642 US patent application
  misc_feature: The sequence is a functional homolog of SEQ ID NO 1431 in the 11/479,226 US patent application
  misc_feature: The sequence is a functional homolog of SEQ ID NO 168 in the 10/666,642 US patent application
MITFADLTEPVAAAGVDRQLWLACAGGMCTVPPVGASVYYFPQGHAEHALGLAGAADLSAARVPALVPCRVAAVRYMADPDTDEVFARIRLAPLRAGEADAGPDDDDAAADDEQEKPASFAKTLTQSDANNGGGFSVPRYCAETIFPRLDYAADPPV

SEQ ID NO: 38105 - DNA, 666 bp, Panicum virgatum
  misc_feature: Ceres CLONE 1992475-R
  misc_feature: Encodes the peptide sequence at SEQ ID NO. 38106
ccagaacagcccgaccaagaactactcgtcgccgtggttcagggacggcagccaagcccccgaggtcgtcgggctggagcccgggcagtgcaaggtgttcgtcgagtccgacacggtcggccgcaacctcgacctctcggcgctgggctcgttcgacgagctctacgggcgcctgtccgagatgttccgcatcgagagcgcggagctgcggagccgcgtgctctaccgcggcgccgccggcgacgtgaagcacgccggcgacgagcccttcagcgtcttcgtcaagtcggcacggaggctcacgatactaaccgacgccgggagcgacaacctagggagctagacgagcagcagtgaccaatccaagccgcaagcattccgttcttggtactactgctactagtagtacaggtgaacccgcgaggttttgtccaactccgttgcagctctgaagagacctccccgtggcagctcgcaagcaatgccacaatcattaggcacactttctccccgtgtatccctccctcctccctatcaaatgtaaaacgtggggttaaccctagtactctcatgcatcttgtccatcccttctccgtattctgaatcctttgtcattccgatgcgcctgttggctcgatgatcacatgatgggaaggattgcaagcc

SEQ ID NO: 38106 - protein, 113 aa, Panicum virgatum
  misc_feature: Ceres CLONE 1992475-R
  misc_feature: The sequence is a functional homolog of SEQ ID NO 1185 in the 10/666,642 US patent application
  misc_feature: The sequence is a functional homolog of SEQ ID NO 1184 in the 10/666,642 US patent application
  misc_feature: The sequence is a functional homolog of SEQ ID NO 442 in the 10/666,642 US patent application
  misc_feature: The sequence is a functional homolog of SEQ ID NO 1428 in the 10/666,642 US patent application
  misc_feature: The sequence is a functional homolog of SEQ ID NO 1431 in the 11/479,226 US patent application
  misc_feature: The sequence is a functional homolog of SEQ ID NO 168 in the 10/666,642 US patent application
QNSPTKNYSSPWFRDGSQAPEVVGLEPGQCKVFVESDTVGRNLDLSALGSFDELYGRLSEMFRIESAELRSRVLYRGAAGDVKHAGDEPFSVFVKSARRLTILTDAGSDNLGS

SEQ ID NO: 38107 - DNA, 688 bp, Panicum virgatum
  misc_feature: Ceres CLONE 1992486
  misc_feature: Encodes the peptide sequence at SEQ ID NO. 38108
ccccacccttcttcgcccaaggatccggacccgcccaataaagcgcctgtacagatccaaccctcaggatccggatcgccccgccgcgtgccgatccgcgcgattccattcgatttttcctccggtttatcgcccgaatttttttttgcgggttctctctcttcttcgatcggagtgctagggtttgggcgcgcgaggggcggcgcattccggggccatcgtcgccaggtgctagggttgatttctcaccgggtggaaggggaccggaccgcagcgatggagaagaagaaggtggcgatcccgctcgtgtgccacggccactcgcggcccgtggtggacctcttctacagccccgtcacgcccgacggctacttcctcatcagcgccagcaaggatacaaacccaatgcttcgtaatggtgagaccggtgactggattgggacatttcaaggtcataaaggagctgtttggagctgttgtcttgacagaaatgctctgcgtgctgcatctgcatctgctgacttctcagctaaagtatgggatgcactgactggtgatgagctacattcatttgaacacaagcatatagtacgggcctgtgccttttctgaggatacccacctgttactcactggaggcatggagaagactttgcgtgtgtatgacatgaaccgccctgatgcagctc

SEQ ID NO: 38108 - protein, 137 aa, Panicum virgatum
  misc_feature: Ceres CLONE 1992486
  misc_feature (51)..(89): Pfam Name: WD40 Pfam Description: WD domain, G-beta repeat
  misc_feature (93)..(130): Pfam Name: WD40 Pfam Description: WD domain, G-beta repeat
  misc_feature: SWISSPROT Homolog: EC 2.7.11.7 [Myosin heavy-chain] kinase
MEKKKVAIPLVCHGHSRPVVDLFYSPVTPDGYFLISASKDTNPMLRNGETGDWIGTFQGHKGAVWSCCLDRNALRAASASADFSAKVWDALTGDELHSFEHKHIVRACAFSEDTHLLLTGGMEKTLRVYDMNRPDAA

SEQ ID NO: 38109 - DNA, 746 bp, Panicum virgatum
  misc_feature: Ceres CLONE 1992488
  misc_feature: Encodes the peptide sequence at SEQ ID NO. 38110
tatgctgaaatccatggtatcgcctatgagcatgagaggccatcctctgcttcaccgatggtgtatcgagtcggttgtcggaagtcatgtgaagttttgaaggcctctgaattcagtaccgtggaaaccgttgaaaagagcatcgaatcatctgcgtcagttcataaaaaaattgtggagttcattggagaaagagctcgtgctcacaagacgcataggttactctgtacacaaaaacaaaaccttgatgagcatcacggaattgattggaacacacgctacaaaatgattaaggggacttgcgagggcttttcatacctccagaggcaactgcaacattgtatttatcattttgatgttaaagcagaaaatatattgctggatgcaaatatggtgccaaaaatcacagattatggcatgtcacggtgcttcggggaagaactagcacgaaacatgacaaattgtataggaacacaggggtacaaggagccagcgatgaatggaaagataacctcacatatgtccgacatatacagtttgggtgtcataatcttgagtatattgaagatttattggaggaacaagcaacaggcaaggcaaataatgttgatgcttgagtcatcttccgaacaaatgaagagattaaaccaaatagttttaagctgtctggaaaaaggcaaatccacgaaggttacgagaagcactgtttcttcaacgcgacgagcagcgcatgatatcatcgtccc

SEQ ID NO: 38110 - protein, 248 aa, Panicum virgatum
  misc_feature: Ceres CLONE 1992488
  misc_feature (9)..(246): Pfam Name: Pkinase Pfam Description: Protein kinase domain
  misc_feature: SWISSPROT Homolog: EC 2.7.11.1 Non-specific serine/threonine protein kinase
YAEIHGIAYEHERPSSASPMVYRVGCRKSCEVLKASEFSTVETVEKSIESSASVHKKIVEFIGERARAHKTHRLLCTQKQNLDEHHGIDWNTRYKMIKGTCEGFSYLQRQLQHCIYHFDVKAENILLDANMVPKITDYGMSRCFGEELARNMTNCIGTQGYKEPAMNGKITSHMSDIYSLGVIILSILKIYWRNKQQARQIMLMLESSSEQMKRLNQIVLSCLEKGKSTKVTRSTVSSTRRAAHDIIV

SEQ ID NO: 38111 - DNA, 1382 bp, Panicum virgatum
  misc_feature: Ceres CLONE 1992491
  misc_feature: Encodes the peptide sequence at SEQ ID NO. 38112
aggagctagcacacgagcagtcgagcactcgccgcctttgagcacaagacccatcatcagctgcggcctctctgcgctcagcttccctactgcaattcaagcaactgctgcaggcatggaggccacccagaacgtggaggtcactgccctggtgcagaagatcaccggcctccacgccgccatctccaagctgccgtcgctgagcccgtcccccgacgtcaacgcgctcttcaccgacctcgtcatggcctgcgtcccgccgagccccgttgacgtgaccaagctcgatccggaggcgcagaggatgcgcgaggagctcatccgcctctgctccgacgccgagggccacctcgaggcgcactactccgacatgctcgccgccttcgacaacccgctcgaccacctcggccgcttcccctacttcagcaactacatcaacctgagcaagctggagtacgacctcctggtccgccacatccccggcctcgcgccgtccagggtcgcgttcgtcgggtcaggccccttgccgttcagctcgctcgtgctcgcggcgcgccacctgcccaacacgcacttcgacaactacgatcggtgcggcgccgccaacgaccgtgcgcgaaagctggtccgcgcggacaaggacctgagcgcgcgcatgtccttccacacggccgacgtctccracctcacggacgagctccgcaagtacgacgtggtgttcctggctgcgcttgtcggcatggcggccgaggacaaggccgacatggttgctcaccttggcaggcacatggccgacggagcggccctcgtcgtgcggagcgcgcacggggctcgcgggttcctgtaccccatcgtcgatcccgaggacatccgtcgcggtgggttcgatgtgctggccgtgtaccacccggacgacgaggtgatcaactccgtsatcgtcgcgcgcaaggtcgacgacgccgacgcgaacgggcctcagaatggacgggcgcacgctcgcggcgcggtgccgatagtgagcccgccttgcaagtgctgcaagatggaggcgagcgcgctccaaatgagggaggagatggagatggcggcaaaggagatgtccgtttgatgtggcgcgacgaggagctgcgcctggtaataacaacttgctgtgtttgatcacttcatcaatttcgtgttatcgtgataacgttcgtgtgtacttttttttatgccatccgttgcgttagtgtgctttgttacctatatatgtgatgtatgccaatacttgagtttccgatgtggaagacatcgatgaggataaaataatgtgcaaggcaaggaataccacatgtgtttgtaagtgtgccgtcaaaaaataaaaaggatttctcccctaacgg

SEQ ID NO: 38112 - protein, 330 aa, Panicum virgatum
  misc_feature: Ceres CLONE 1992491
  misc_feature (4)..(283): Pfam Name: NAS Pfam Description: Nicotianamine synthase protein
  misc_feature: SWISSPROT Homolog: EC 2.5.1.43 Nicotianamine synthase
  misc_feature (190)..(190): Xaa is any aa, unknown, or other
MEATQNVEVTALVQKITGLHAAISKLPSLSPSPDVNALFTDLVMACVPPSPVDVTKLDPEAQRMREELIRLCSDAEGHLEAHYSDMLAAFDNPLDHLGRFPYFSNYINLSKLEYDLLVRHIPGLAPSRVAFVGSGPLPFSSLVLAARHLPNTHFDNYDRCGAANDRARKLVRADKDLSARMSFHTADVSXLTDELRKYDVVFLAALVGMAAEDKADMVAHLGRHMADGAALVVRSAHGARGFLYPIVDPEDIRRGGFDVLAVYHPDDEVINSVIVARKVDDADANGPQNGRAHARGAVPIVSPPCKCCKMEASALQMREEMEMAAKEMSV

SEQ ID NO: 38113 - DNA, 686 bp, Panicum virgatum
  misc_feature: Ceres CLONE 1992498
  misc_feature: Encodes the peptide sequence at SEQ ID NO. 38114
aagcccagccagcgcacgcaacgggcaatcacgcgcgcgcgcgcgccgcgcgtcgccgtacggcggcgactcgaccgcttgctgcctcgctcgcggctcgccaatcatcaccggcgtcggcagacacacagacggaggccgcctccacctcccgagcgagctccgcgtcgtcatcgacctcacctcctcctgcgcgccgccgaaagccaagccagcgcggccggccggccagagcggcggagacttccctcgtggcgccgcctcttcgcccccttcccttgacccgcctgcagccgctggcggcgagcggcgcccacccgggccggtacgcggacgcggcggcggcggccggcccgggggccatggggatctacgggcgccagcgccaccagatggcggcggtcggcgcgtggggagacccgttccggcccgacggctacgcgctggccgcccccctggccgccgtcgctccggtgacagtggcagcggcggcggacgtcgtcgaaacagagtccaagctcggcacacgcctggcgcagcacgacgtcgtcgcggtggaggaagcgccgccgtcgtcggatagcttcgggcacgacgacgccaggcccagagacaagactcagaggcggctggcgcagaacagggaggctgctcggaagagccggctgaggaagaaggcctacatc

SEQ ID NO: 38114 - protein, 107 aa, Panicum virgatum
  misc_feature: Ceres CLONE 1992498
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
MGIYGRQRHQMAAVGAWGDPFRPDGYALAAPLAAVAPVTVAAAADVVETESKLGTRLAQHDVVAVEEAPPSSDSFGHDDARPRDKTQRRLAQNREAARKSRLRKKAY

SEQ ID NO: 38115 - DNA, 681 bp, Panicum virgatum
  misc_feature: Ceres CLONE 1992500
  misc_feature: Encodes the peptide sequence at SEQ ID NO. 38116
caacgcagaagcgcagcctcgacggagcgaccgccgccggggagcaacaccgccgctccagccaaaccgcgcgcgccgcaccgaaggaaaccgcccagccacagcgccagcctcgcggcgacgacggggaccaaaggatggtgcggaaggggcggaaggggaagggcgcgtctgccgcgtccgcgatgaacgaggcgacgctggtgcgcgtcaccaaggcgctggatgacttccgcgcctccgacgccgaggtgtacacatttgaacctgatatatccaaagaagagcgagcaggaatccatgagatgtgtagaaaaatgggcatgaaatccaaaagttctggggttgggacacggcgacgcctctctgtttataaaagtaaacggaaccaggggcctgatatggaagaaggcccttcccaccttgggttttctgaagagtcaagacatgttttgcaggatttatttactcattatcctcccgatgatgctgatttaaatggagatgccagccagaattctagtgataaggccgcaaacatcaaatggaaaacagatagtgccttttgcaggccagcaatgagcaaacacgatataacaaagaaagttgagatgttttccactaaaataaatggatccccacagttgaggaagatcatggaagacagatcaaagcttccta

SEQ ID NO: 38116 - protein, 181 aa, Panicum virgatum
  misc_feature: Ceres CLONE 1992500
  misc_feature (26)..(81): Pfam Name: R3H Pfam Description: R3H domain
MVRKGRKGKGASAASAMNEATLVRVTKALDDFRASDAEVYTFEPDISKEERAGIHEMCRKMGMKSKSSGVGTRRRLSVYKSKRNQGPDMEEGPSHLGFSEESRHVLQDLFTHYPPDDADLNGDASQNSSDKAANIKWKTDSAFCRPAMSKHDITKKVEMFSTKINGSPQLRKIMEDRSKLP

SEQ ID NO: 38117 - DNA, 1339 bp, Panicum virgatum
  misc_feature: Ceres CLONE 1992516
  misc_feature: Encodes the peptide sequence at SEQ ID NO. 38118
gcgcacgcggcgccttccttcctttcccttccaggcgaagcgaggccgcgccccggcggggacgacggcggccgtgtaatccccgacccttctccttccccatccaaatttctctctgttcctcgtatcctgtcatcggagcttttcagccagttcgcaaggtcgtcgtccacgccccacggcgattcgttcaccggcggttctgcacacctcggccaccaacgcggtggtggaagcggcgcggccgtcgacctctgccgcgggagcagatcgggccaaggcacgcacgccgtcgccggttagcacggtcgtctgatcccgggacaagcttgtgaccatggcggacgagcccgccgccgctggcggcagcgctgcggactcgcacgactaccccaccatcgaccccacctcgttcgacgtcgtgctctgcggcacggggctcccggagtccgtgctcgccgccgcctgcgccgccgccgggaagacggtcctccacgtcgatcccagcccgttctacggctccctctactcctccatcccgctcccgtccctccagtccttcctctcccccgaccctcccccgtcctcatcgaccgcggcggcggtcgccggctccgattcgcacaccgtcgtcgatctccgccgccgcggcgtgtactcggaggtcgagacctcggggaccgtccccaagccggcgaggcggttcaccgtcgatctcgtggggccccgggtgctgtactgcgccgacgaggccgtggacctcctcctgcgctcggggggcagccaccatgtggaattcaagagcgtggacgggggcagcctcctctactgggagggctgcctctaccctgtgccagactcgaagggggccatcttcagggacaccacactcaagctcttggagaagaacgccttctacaagttcttcaatcttgtcaaggcgcacattgctgccacatcagctcctgctgatgagatgggagagggggatgcggctgccatgatatccgaggagcacctggaccgcccctttgttgagttccttacgcaacagggcctttctcccaagatgagagcggttgtgctttatgcgattgccatggctgattatgatcaagatggtcctgacccaagtgataaattaattacaacgagggagggaatccagaccattgctctgtactcggcatctattgggaggtttgctaatgcagaaggtgctttcatttaccctatgtatgggcatggtgagctacctcaagctttctgtcgctgtgctgcggttaagggtgccctatatgtgttgcggatgccagtggctgcacttcttatggatgag

SEQ ID NO: 38118 - protein, 333 aa, Panicum virgatum
  misc_feature: Ceres CLONE 1992516
  misc_feature (23)..(333): Pfam Name: GDI Pfam Description: GDP dissociation inhibitor
MADEPAAAGGSAADSHDYPTIDPTSFDVVLCGTGLPESVLAAACAAAGKTVLHVDPSPFYGSLYSSIPLPSLQSFLSPDPPPSSSTAAAVAGSDSHTVVDLRRRGVYSEVETSGTVPKPARRFTVDLVGPRVLYCADEAVDLLLRSGGSHHVEFKSVDGGSLLYWEGCLYPVPDSKGAIFRDTTLKLLEKNAFYKFFNLVKAHIAATSAPADEMGEGDAAAMISEEHLDRPFVEFLTQQGLSPKMRAVVLYAIAMADYDQDGPDPSDKLITTREGIQTIALYSASIGRFANAEGAFIYPMYGHGELPQAFCRCAAVKGALYVLRMPVAALLMD

SEQ ID NO: 38119 - DNA, 542 bp, Panicum virgatum
  misc_feature: Ceres CLONE 1992516-R
tttagcccacaggattcaggatggctcggaaggccaccttgagacaaccagttgcactgatgatgtgaaaccaacattaatctggagctgtgtgtatgttcaagagatcgcacaggaaatgtctggtcctttactatcatgccccatgcctgatgaaaatctggactacaggaacatactggaatcaacaaaaaagttatttgctggtatctatcctgatgaagaattcttgcctaaaaagtcagctcctgtatatgctgatgatgactctgattccgccgagtaaaaccatctttagaggcaaagaatttgactggagaacactgtcacggaatatgcatgaaggcatcgatctctatgtcactgtgttccagtgtatcgcaaggggagcctgttgcatagttgtgttgggatttttgcagccctcgttgtatacaggatggtgtacgggatacatgccgaacgcttgatatgtcgttgtactagcgcgggggaggaaatctagtacttcttttcccttgagatagtcaactgcttagctc

SEQ ID NO: 38120 - DNA, 729 bp, Panicum virgatum
  misc_feature: Ceres CLONE 1992528
  misc_feature: Encodes the peptide sequence at SEQ ID NO. 38121
tggagtcactcggcggccttgccccggaacgaattattggccgacggcgcgatgctccagggcgtgttgtcccgcgcgcccgcctcgccagcagcggcagcgatgaaggccaagcgggcgccggcgtcccccgacgatgaggatgacggggagggccgcccggcgccggggaagcggcagcagctgcttgggctcggctccgccgccgcggcggcggcggacgaggagggcccggagacgcggggtcttcggctgctaagcctcctgctccggtgcgcggaggcggtggccatggaccagctgacggaggcgcgggagctgcttcccgagatcgccgagctggcgtcgccgttcgggtcctccccggagcgcgtggcggcctacttcggcgacgcgctgtgcgcgcgcgtgctcagctcctacctgggcgcctactcgccgctcgcgctccgcccgctggcggccgcgcagagccgccgcgtcgcgggcgcgttccaggcgtacaacgcgctgtcgccgctcgtcaagttctcgcacttcaccgccaaccaggccatcctgcaggcgctccacggcgaggaccgcctccacgtggtcgacctcgacatcatgcagggcctgcagtggccgggcctcttccacatcctcgcctcccgcccgcgcaagccgcgctcgctccggatcaccgggctcggggcctcgctcgacgtcctcgaggccacgggccgc

SEQ ID NO: 38121 - protein, 225 aa, Panicum virgatum
  misc_feature: Ceres CLONE 1992528
  misc_feature (48)..(225): Pfam Name: GRAS Pfam Description: GRAS family transcription factor
  misc_feature: The sequence is a functional homolog of SEQ ID NO 438 in the 11/435,388 US patent application
  misc_feature: The sequence is a functional homolog of SEQ ID NO 431 in the 11/479,226 US patent application
MLQGVLSRAPASPAAAAMKAKRAPASPDDEDDGEGRPAPGKRQQLLGLGSAAAAAADEEGPETRGLRLLSLLLRCAEAVAMDQLTEARELLPEIAELASPFGSSPERVAAYFGDALCARVLSSYLGAYSPLALRPLAAAQSRRVAGAFQAYNALSPLVKFSHFTANQAILQALHGEDRLHVVDLDIMQGLQWPGLFHILASRPRKPRSLRITGLGASLDVLEATG

SEQ ID NO: 38122 - DNA, 1963 bp, Panicum virgatum
  misc_feature: Ceres CLONE 1992535
  misc_feature: Encodes the peptide sequence at SEQ ID NO. 38123
gacccgtgagcgacgcatcgcggcgcagcccccctcctcctccacccctcgtctcccgccgcatcgccgcggcgcggtcctccccgacgagccgccgccgctccccctccatcagccaggcagaagatggagggagctggcaaggatggcaacccgctgaggaattaccggatcggtaagactctggggattggttcattcggtaaggtgaaaattgcagagcacattagtactggacacaaggtggcaatcaagatcctcaaccgtcgtaaaatcagaggcatggagatggaagagaaagttaagagagagatcaaaatattgaggttatttatgcacccacatatcattcgcctctatgaggtcatagacacaccggctgatatctacgttgttatggagtatgttaagtccggggaattgtttgattacattgttgagaaaggtaggttgcaggaggaagaggctcgccgtttcttccaacagattatatccggtgttgaatattgccatagaaacatggtggtgcatcgtgatctaaagccagaaaacctcctattggattcgaaatgcaatgttaagatagcagattttggtttaagtaatgttatgcgggatggtcatttcctcaagacaagctgcggtagcccaaattatgctgctcctgaggtgatatctggtaaactatatgctggccctgaagttgatgtgtggagctgtggagttattctttatgcacttctatgtggtactctgccatttgatgacgagaacataccaaacctttttaagaaaataaagggtggaatatatacccttcccagccatttgtcaggtgcagcaagagatttgattccaagaatgctggttgttgatcctatgaagcggatcaccattcgtgagattcatgaacatgattggttcaaaattcatctcccacgctatttgaccgtgcctcctccagatagtgcacaacaagttaaaaaaattgatgaggaaactctccgtgaggttataggtatggggtatgacaagaatctgttggtggagtcaatccaaaatagactgcaaaatgaggcaactgttgcatattatttattattggacaataggctccgtacaactagtggctatcttggagctgaatgccaagaagttatggactcctcattctcaaacatagcatcatatgaaacaccaagttcagcacgtgggaatcggcagcaaatatttatggactctccagttggtttgagacagcattttccagctgagaggaaatgggctcttgggcttcagtcacgagcacatcccagagaaataatgactgaagtgctgaaagctctgcaagaattgaatgtttactggaaaaagattggtcactataatatgaagtgcagatggaatcctggctttcctggtcaaattcatagcaatcataacttcagtgcagagtccattggaactgacggcctgagtgagaggttaaatttaattaagtttgaaattcagctttacaaaacaagagacgagaaatacctcctcgacttgcaaagagtcagtggaccacagctcctctttctggacttgtgtgcggcctttctagctcagctgagagttctttgattcccagtgtttgccttccatcaattgcattccttgcgtttcactagaggaatgtggaatcactcacaaagctgtaaatagtaatctctccagtagattgaatttctggagtatatgtagattgtagacatgcgaagctgtggttcctggccatcccctgagctagactgtggggtaagatgccgcctggttccttacggctggccggctgccagtgaaggcactaggatatacagtgaactagtgataagtgcttttgctggcaaaatgtctatctacatgaataatttcagctattacaatggttattaattgaaagctgaactgcttacaggtc

SEQ ID NO: 38123 - protein, 499 aa, Panicum virgatum
  misc_feature: Ceres CLONE 1992535
  misc_feature (14)..(266): Pfam Name: Pkinase Pfam Description: Protein kinase domain
  misc_feature (450)..(498): Pfam Name: KA1 Pfam Description: Kinase associated domain 1
  misc_feature: SWISSPROT Homolog: EC 2.7.11.1 Non-specific serine/threonine protein kinase
MEGAGKDGNPLRNYRIGKTLGIGSFGKVKIAEHISTGHKVAIKILNRRKIRGMEMEEKVKREIKILRLFMHPHIIRLYEVIDTPADIYVVMEYVKSGELFDYIVEKGRLQEEEARRFFQQIISGVEYCHRNMVVHRDLKPENLLLDSKCNVKIADFGLSNVMRDGHFLKTSCGSPNYAAPEVISGKLYAGPEVDVWSCGVILYALLCGTLPFDDENIPNLFKKIKGGIYTLPSHLSGAARDLIPRMLVVDPMKRITIREIHEHDWFKIHLPRYLTVPPPDSAQQVKKIDEETLREVIGMGYDKNLLVESIQNRLQNEATVAYYLLLDNRLRTTSGYLGAECQEVMDSSFSNIASYETPSSARGNRQQIFMDSPVGLRQHFPAERKWALGLQSRAHPREIMTEVLKALQELNVYWKKIGHYNMKCRWNPGFPGQIHSNHNFSAESIGTDGLSERLNLIKFEIQLYKTRDEKYLLDLQRVSGPQLLFLDLCAAFLAQLRVL

SEQ ID NO: 38124 - DNA, 709 bp, Panicum virgatum
  misc_feature: Ceres CLONE 1992582
  misc_feature: Encodes the peptide sequence at SEQ ID NO. 38125
agccaggccgccgccgcagccaccaccaaccccgcggcggccggcctcgcccgataagacgccggcccgcctccggcctccccctccccttccgctcccacctgcccccgcgtgccacgaccagccacctcctgccgcagcgatgccgcccccgtccctcttgctcctccactcccgcgccccgcttcagccccgcccattccggatgaactcccggggagctccgagcagggtagtcgtctgctccgccgcgtccgccgaggggttcatctccgcggctccgatccttctcccagagggtccctggaagcaggtagaaggtggcgttactgccgcgaaggggttcaaggcggcgggcatctacggtgggctgcgcgccaagggcgagaagcccgacttggcattggtcgcctgcgacgtcgacgccaccgtagcaggagcttttactacaaacgtagttgctgccgcacctgttttgtattgtaagaacgtcctcaatacatcgaaaacaggtcgtgctgtgttaattaatgctggacaagcaaatgctgcaactggtgatcttggctatcaggatgcagttgatagtgcacatgctgttgccaagcttctcaatgtgagcacagatgacatactgattcagtctactggtgtcattggtcaaagaataaagaaggaggcacttctaaattcactgcctagacttgtg

SEQ ID NO: 38125 - protein, 188 aa, Panicum virgatum
  misc_feature: Ceres CLONE 1992582
  misc_feature (68)..(187): Pfam Name: ArgJ Pfam Description: ArgJ family
  misc_feature: SWISSPROT Homolog: EC 2.3.1.35 Glutamate N-acetyltransferase
MPPPSLLLLHSRAPLQPRPFRMNSRGAPSRVVVCSAASAEGFISAAPILLPEGPWKQVEGGVTAAKGFKAAGIYGGLRAKGEKPDLALVACDVDATVAGAFTTNVVAAAPVLYCKNVLNTSKTGRAVLINAGQANAATGDLGYQDAVDSAHAVAKLLNVSTDDILIQSTGVIGQRIKKEALLNSLPRL

SEQ ID NO: 38126 - DNA, 1673 bp, Panicum virgatum
  misc_feature: Ceres CLONE 1992594
  misc_feature: Encodes the peptide sequence at SEQ ID NO. 38127
ccgccccgcccgccatagatcccaaaccctaaccctaggcggccgtccaggggcccttaaccgccggaagccggtggccggcgggcgacgcgatcgggcgccgacggccgaccgacgcgggagcagcgccgaggcgccgtcaggaagaagaggaaaaggcggggagcccgaaccccctacccgtgcggccgaggcgcggatcggggaagggagtggaggggtaaggaaggttgaggtgagcgaagcgagatgccgggcgacgctgcgacctcaccggcgccgccgccttcgtcagcgtcctcgtcctcgcactcgcagcaccaccaccatcacggccccacatccgcccgcgggctcctgtgtcacgccgtcgccggcgcctccgctggtaaccttgacgctgggactcttcttcatttcgggtggggggttcgggacatttgatgtgatttgtggcttgggcgcaggtgtggtggcggcgacgttcgtgtgcccgctcgatgtcatcaagacgaggttccaggtgcacggctgtcccaagctagccacaggcacaattggaggtagtgtaattattgggaccttacaacagattgctcaacgggaaggttttcggggaatgtatcgtggcctctccccgactattctggcgctattgccaaactgggcggtctattttactgtatatgagcaactcaaaagcctactttcttccaatgatggaagtcaccaactctctttaggggcaaatgttgttgctgcatcatgtgcaggagctgcaacaagtattgcaacaaatccactttgggttgtgaagacaagatttcagacccaaggaataagagccgggccaatcctgtataaaggtactcttgctgccttgagaagaatagcacatgaggagggcatacgtggactatacagtggtctggtccctgccttggttggtgtcagtcatgttgctattcagttcccggcatatgagaagattaaagcttatctggcggagcgagataatacaactgttgaagcattgagttttggtgatgttgctgttgcttcatctctggctaaagtagctgcatcaactatgacatatcctcacgaggttgttcgttcaaggctgcaagaccagggagcacactcggatgctagatacaaaggtgtaatagactgcatcagaaaggtttattacaaagagggtgtggctggcttctaccgtggatgtgccacaaatctgttccggacaacccctgctgcagtgataactttcaccagctttgagatgatccacaggttcctccttgatctactccctcctgcacctggaccgcacatccagccactgaagcattgaccatacaataactgtaccctgtccatgctgccaatggaaattaggaagccagcccagtaagtaaccatccagcaatgctgttcaccaagccctcttgctcgtgtaaaagagagaattctttttccccggatatgcaataggtagctgccattcaaaagttgaaacttatagtgtaggcggggattagcatctttgtaatagattcgttagcatgcatttgggaggtatatgtggtgatatgggtatgttgtcttgatgatgaaaaagaaaagaatttttccttcggatcaatgaataattacttattctctttcag

SEQ ID NO: 38127 - protein, 451 aa, Panicum virgatum
  misc_feature: Ceres CLONE 1992594
  misc_feature (346)..(438): Pfam Name: Mito_carr Pfam Description: Mitochondrial carrier protein
  misc_feature (246)..(338): Pfam Name: Mito_carr Pfam Description: Mitochondrial carrier protein
  misc_feature (144)..(240): Pfam Name: Mito_carr Pfam Description: Mitochondrial carrier protein
RPARHRSQTLTLGGRPGALNRRKPVAGGRRDRAPTADRRGSSAEAPSGRRGKGGEPEPPTRAAEARIGEGSGGVRKVEVSEARCRATLRPHRRRRLRQRPRPRTRSTTTITAPHPPAGSCVTPSPAPPLVTLTLGLFFISGGGFGTFDVICGLGAGVVAATFVCPLDVIKTRFQVHGCPKLATGTIGGSVIIGTLQQIAQREGFRGMYRGLSPTILALLPNWAVYFTVYEQLKSLLSSNDGSHQLSLGANVVAASCAGAATSIATNPLWVVKTRFQTQGIRAGPILYKGTLAALRRIAHEEGIRGLYSGLVPALVGVSHVAIQFPAYEKIKAYLAERDNTTVEALSFGDVAVASSLAKVAASTMTYPHEVVRSRLQDQGAHSDARYKGVIDCIRKVYYKEGVAGFYRGCATNLFRTTPAAVITFTSFEMIHRFLLDLLPPAPGPHIQPLKH

SEQ ID NO: 38128 - DNA, 923 bp, Panicum virgatum
  misc_feature: Ceres CLONE 1992600
  misc_feature: Encodes the peptide sequence at SEQ ID NO. 38129
gagcccgtccgtccccaatttccccttcgctttctcgcttcccgctcggcccccccaccggaacccgctgattcgccgctcgccggaaccctagccctagctgaggagccgcccatggccgccgcgatcgtgggctgaggcggtgctgctcctcttatgggatgaggagaccgtgcggaggcgtggggatggaccctactggcctgaaggaggaggtgagggcggcggaggagggggaggtgagcgaggtggcgagggcggctgcggcggcggcgatggcgatggcggcgccgaggtgccgggtggtgcggatcatcgtgcacgacgaggacgccaccgactcgtcctccagcgaggacgaggatgaggaggagggggaggaggaggaggcggggaggagcgtgaagcgcagccgcgtgctgctccagatcggcggcggcggcgggcaggaggaggcggaggacgacgccgcggagggggtgcggttccggggcgtgcggcggcggccgtggggccggttcgcggcggagatccgcgacccgcagcgcggccgccgcctgtggctcggcaccttcgacaccgccgaggaggccgccgcggcgtacgacgccgcccgcctccgcatccgcgggccgggcgcccccaccaacccgccgcccgccgccgacagcgacccgctccctccgcccgccgcgcgcatccgcatccgcgggccgggcgcctccaccaacccgctgcccgccgccgacagcgacccgctccctcctccgcccgcggcggctcccctgcccccgcgccctccgccgcccgcggcgcccctgccccctcgcccgccgcctccgccacgcctacctcagcgggaggagcagccgaagccaccgccgcctctgctcccgccgaagaagcggctgccctccccgcct

SEQ ID NO: 38129 - protein, 253 aa, Panicum virgatum
  misc_feature: Ceres CLONE 1992600
  misc_feature (107)..(158): Pfam Name: AP2 Pfam Description: AP2 domain
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
MRRPCGGVGMDPTGLKEEVRAAEEGEVSEVARAAAAAAMAMAAPRCRVVRIIVHDEDATDSSSSEDEDEEEGEEEEAGRSVKRSRVLLQIGGGGGQEEAEDDAAEGVRFRGVRRRPWGRFAAEIRDPQRGRRLWLGTFDTAEEAAAAYDAARLRIRGPGAPTNPPPAADSDPLPPPAARIRIRGPGASTNPLPAADSDPLPPPPAAAPLPPRPPPPAAPLPPRPPPPPRLPQREEQPKPPPPLLPPKKRLPSP

SEQ ID NO: 38130 - DNA, 614 bp, Panicum virgatum
  misc_feature: Ceres CLONE 1992600-R
ggcgcttctgtccgggaagcgcaagaagcggtcgggctgcggcgggcgcgtccccgccctccgcaccccacctgccgaggaggccagccgcgcctgagccgcccacctctccggccatcccccgccgctctcttcctcctcggtaccaatctgaatctcttactagtaccagctcctcctcgcgtcgtgattgcaatcgatgctaatgtcgacaatctctgtaactcctctgattcatgaactgatgatgatgatgtacatatgctgctgctgctactgctgctgaagttgcagctgatctgatctgtaaaatttgctgaaccctttgatgtgttataaataatatgcgttgacatttttttcctgatccgggcaaggttctctggccgtggagattgcaagattgctgctgctgatgttgcagccgttgtggccatttcgttggatcctcctgcagtttttgtggcagtgaaagtcgtatgagagtttttttgttttcagggtgtgtttagatctgccaaaatctggtagaaaatgtcacatatgacactgaagtattttgtagcactttttgtttgtggtaaatattgttttattataggctaactaggctc

SEQ ID NO: 38131 - DNA, 1696 bp, Panicum virgatum
  misc_feature: Ceres CLONE 1992606
  misc_feature: Encodes the peptide sequence at SEQ ID NO. 38132
gtttgcctgctcggtttcggtcggtcgcctcccctcctcttttcctcctccgctcctccccttctccgtgcgggaaggcaggcaagctcagaccgggggcgtgagatccgacgccctccctctctcgccgagcggcgggtaggcttcgtccgcgtcttctttctcatcgtctccgccgaacggcttcggctcctaccaccttcggctgtcccgcgggtttccaatacgatttcacccccgaccgatcgattcgactccatggccggctggagcaattccaccggcggcggcggcgggcgaggagcaggaggaagagggttcacgaatcgacacttcactaattataccagtgacatgatgcacggtggttccagcagcggcggcaggtggagagacaggtcgagggggaggccgcccccgcagcctcactattgctaccgccctgtagatgctgctcatcgccaagcccaacccatatctgaacaacaggcggcctcctccgcctccagtcgcatccaacagcgaacatatccgatcccagcggcagacaagtcatctgcctctggaactgcggctcctcccagcaccagggagcccgatgacaaggctacccgcagtgctgccaactttgagtgcaacgtctgctttgacatggctgccgaacccgtcgtcaccaagtgcggccatctcttctgctgggagtgcctctatcagtggctccatgttcactccaaccaccgtgagtgccctgtttgcaagggccaggtcgccgacgacgctatcatacccatctatggccgtggtggctctgcagcctctgtggacaacgcaccgccaaggcccaccggagctagagtcgagagctccaggcagcagcagcagctgctgccaactttccctcccaccgtatatttggatgatgatgaagaagacccctttgatttcccaggcatgatgaactttggttttggagctacagctacctcaatcagagatgctgttatgagcttcatgcctcccagctttcaagacatggcactcgaagagtttgatgactactcttatgagtatgacaccgatgactttgatgactacaattggctgggctttccggtgtttggatctgctggggctgaggctggcaatcccatttcttcacaggcacatgctgatatgatcaatattaggaataacattgttggcactaccactggcatgtatcatcagcaagaaattggctaccctggtgcgaaccctaataacagagggagacgtcgccgtaatcgtgcaaggccatcagcagatcagttgagcaccaatgggatggtgatgggtggcagcggtgccttctaccgtgacaacggtgccagttataatgttaccgcaggtgcttcttctcggcctaatggcggctgggttgagagacgaggaagaagcagcaggaattcaaattcagctggtggaagaggagggatgcaggatagcaggagacagaggacaaattacaattgatgctaatattcggtgaggctcgatgacagcagggttgagataaacaaacaaagttgtcaatccttcttcttttttcgtttctctctcttcatccttttgtagtctgtggctatgtgcagccttggtaaacatactggttgcattttctttcttttccctgatggaatgtgtggtagattggctg

SEQ ID NO: 38132 - protein, 417 aa, Panicum virgatum
  misc_feature: Ceres CLONE 1992606
  misc_feature (126)..(166): Pfam Name: zf-C3HC4 Pfam Description: Zinc finger, C3HC4 type (RING finger)
MAGWSNSTGGGGGRGAGGRGFTNRHFTNYTSDMMHGGSSSGGRWRDRSRGRPPPQPHYCYRPVDAAHRQAQPISEQQAASSASSRIQQRTYPIPAADKSSASGTAAPPSTREPDDKATRSAANFECNVCFDMAAEPVVTKCGHLFCWECLYQWLHVHSNHRECPVCKGQVADDAIIPIYGRGGSAASVDNAPPRPTGARVESSRQQQQLLPTFPPTVYLDDDEEDPFDFPGMMNFGFGATATSIRDAVMSFMPPSFQDMALEEFDDYSYEYDTDDFDDYNWLGFPVFGSAGAEAGNPISSQAHADMINIRNNIVGTTTGMYHQQEIGYPGANPNNRGRRRRNRARPSADQLSTNGMVMGGSGAFYRDNGASYNVTAGASSRPNGGWVERRGRSSRNSNSAGGRGGMQDSRRQRTNYN

SEQ ID NO: 38133 - DNA, 713 bp, Panicum virgatum
  misc_feature: Ceres CLONE 1992608
  misc_feature: Encodes the peptide sequence at SEQ ID NO. 38134
gagactgggagaggtcaatgccgctgcttccgccgactgctccgcagctacagtgcctgcaccactcgctctcctcgagctcccacacttgtcactagtgcaaatttatgccggaggttggagctgttcttcttcgccctgccccctgctcatctttctttcctgctccgatccaagaagtgggtgacaagagattgcggcggtagggtttggttaaatcgttcgaggtcttgggaaaattttgaggctgaactgaagaagggagatcacaatgccgaagatgtttgggttctctcggcgccgcatgaagctggggaggttaaagggtcatctacacgatcctttccatggctctcggagcccttctcggcacaccaagcgttttaatcaccccaatggagaagatccagtgactacctcagtgagtggtcgtgtcgatgaccttgcttggcgatgctcatctgatacttttgatctcaatgggcgtgcttttgagagctcagagaactgggcagtgctgtcaacagagggcgacaaaccgactcctcgttttgatcatgcagcagccattgtagggagtaaaatggtagtctttggtggtgattctggtcatcacttgctagatgatacaaagatattgcgcttagacaagcttacctggggatctgtgtctcctaaagttcgaccatcatcaaacggacgttctctgaagt

SEQ ID NO: 38134 - protein, 147 aa, Panicum virgatum
  misc_feature: Ceres CLONE 1992608
  misc_feature: SWISSPROT Homolog: EC 3.1.3.16 Phosphoprotein phosphatase
MPKMFGFSRRRMKLGRLKGHLHDPFHGSRSPSRHTKRFNHPNGEDPVTTSVSGRVDDLAWRCSSDTFDLNGRAFESSENWAVLSTEGDKPTPRFDHAAAIVGSKMVVFGGDSGHHLLDDTKILRLDKLTWGSVSPKVRPSSNGRSLK

SEQ ID NO: 38135 - DNA, 680 bp, Panicum virgatum
  misc_feature: Ceres CLONE 1992609
  misc_feature: Encodes the peptide sequence at SEQ ID NO. 38136
accaaccacctcactcgacgacgccggaatcttcgagttcctattcatcatcttcctgaccactagcccggtaggaacggttcgagaagggcgctctctctcttctcccggcttcacttctaacacccttttacaccgcctgcaagcagtagcgcaaagagggttgtcgtttattttcttctttctaccacacagctttcgacatggagagtcgatcgcggagctgggccctcggcctgagcttcattgggttctttgccctccttttctctctgggcttcgtccagcaagtcaaggcggatgatgtctctgagtatggcaccgtcattggtattgatctgggcaccacctactcgtgtgtgggtgtgatgcaaaagggcaaggtcgagattctcgtcaacgatcaaggaaaccgtatcaccccctcttatgtcgccttcaccgaggatgagagactcgtcggagacgccgccaagaaccaggccgcatcgaacccgttcaagaccatctacgacatcaagcgtctgatcggccgcaagttctcggagaaggacgtccagagcgatatcaagcacttcccctacaaggttgtcgccaaggatgagaagccggttgtcaaggttgagattgacggcactgataagaccttcacccccgaggagatctccgccatggttctc

SEQ ID NO: 38136 - protein, 158 aa, Panicum virgatum
  misc_feature: Ceres CLONE 1992609
  misc_feature: Useful for making plants with modulated heat sensitivity
MESRSRSWALGLSFIGFFALLFSLGFVQQVKADDVSEYGTVIGIDLGTTYSCVGVMQKGKVEILVNDQGNRITPSYVAFTEDERLVGDAAKNQAASNPFKTIYDIKRLIGRKFSEKDVQSDIKHFPYKVVAKDEKPVVKVEIDGTDKTFTPEEISAMV

SEQ ID NO: 38137 - DNA, 552 bp, Panicum virgatum
  misc_feature: Ceres CLONE 1992609-R
tgagcgcattgaggctcgcaacggccttgagaactacgccttcagcctgaagaaccaggtcaacgatgaggagggcatgggcagtaagatctctgaggacgacaaggagaccatccttgacgccgtcaaagaggcccaggactggcttgaggagaacgccgctactgcctccgccgaggactttgaggagcagaaggagaagctcagcaacgtggcgtacccgatcacgagcaagctctactcgggcggtgaaaccggtggcgaagatgagcctgactcgcacgacgagctttaattacctcgctcgtattagtatcatagagattccccccgttttttgttttgatggcataaaaaatgaagcctacccgggtttggggttgggtttgcttacccttttggtcttgggccctttgccggtgtctgcgtttggtcaacggcaggtggggatgcatattggtagtgtgatgatgacgggcgttgtatgttgcgaaggcttgtacaagtatcagttgagtcgcgagttgtgacaatgcatagaaccctttgatc

SEQ ID NO: 38138 - DNA, 744 bp, Panicum virgatum
  misc_feature: Ceres CLONE 1992616
  misc_feature: Encodes the peptide sequence at SEQ ID NO. 38139
ccaggccgtctgctactctgcattgttcctactcgctagtccctccgctcccgaagtaggatttctaaagcataaacacggaggacatggcgacaccgtacaaacctaagaacatcctcatcactggagctgctgggtttatcgcctcccatgtcgcgacccgcatcgtgaagaattaccctgactacaagatcgttgtcctcgacaagcttgactactgctcgaacctgaagaatctgctccccgtgagctcattgccaaacttcaagtttgtcaagggagacatcgcaagcgccgaccttgtcaacttcatccttgtcacagagaacattgacactgtgatgcactttgcaacccagacacatgttgacaattcctttgggaactctttcgagttcaccaagaacaatatttatggtacacatgtccttcttgaggcctgccggcagatcactggtcagatcaagaggttcatccatgtcagcactgatgaggtttatggagagacagatgaggatgcagttgttggcaaccatgagatgtcacagctgctccccacaaacccctacgcagccaccaaagccggagcggagatgcttgtcatggcctatgggagatcctatggtcttccagtcatcactactcggggcaacaatgtctatggccctaaccaattcccagagaagctcatccccaagtttattctcttggccatgagagggggaccccttccaatccatggtg

SEQ ID NO: 38139 - protein, 219 aa, Panicum virgatum
  misc_feature: Ceres CLONE 1992616
  misc_feature (10)..(219): Pfam Name: Epimerase Pfam Description: NAD dependent epimerase/dehydratase family
  misc_feature: SWISSPROT Homolog: EC 4.2.1.46 dTDP-glucose 4,6-dehydratase
  misc_feature: Useful for making plants with altered carbohydrate content
  misc_feature: Useful for making plants with altered cell wall content and/or composition
MATPYKPKNILITGAAGFIASHVATRIVKNYPDYKIVVLDKLDYCSNLKNLLPVSSLPNFKFVKGDIASADLVNFILVTENIDTVMHFATQTHVDNSFGNSFEFTKNNIYGTHVLLEACRQITGQIKRFIHVSTDEVYGETDEDAVVGNHEMSQLLPTNPYAATKAGAEMLVMAYGRSYGLPVITTRGNNVYGPNQFPEKLIPKFILLAMRGGPLPIHG

SEQ ID NO: 38140 - DNA, 627 bp, Panicum virgatum
  misc_feature: Ceres CLONE 1992617
  misc_feature: Encodes the peptide sequence at SEQ ID NO. 38141
aaaggcgagaaatccccaacggaaggagcagcagcagcagcagcgcaaattctttcctcctcatcttcgccgcgcttgcccacccggatcgaaacccctagggtttcgcatccgcctaccaccgcgtactacttcctctccccgtctccctccgccgcgcgcgcgcgcggggagccaccaaaccctcgtcggcggccgagaggagccgctcagggctcgggtcagggttccggtacctcgccggcgccgcctccgggtggttggaccggtggatggtcatgggagccagcggctccaagctggagaaggccctcggcgaccagttcccggaaggcgagcgctacttcggcctcgagaacttcggcaacacctgctactgcaacagtgtcctccaggcactttatttttgcattccattcagggagcagttactggaatattacgcaaataacaaaaatccaggagacgcagaggaaaatcttttgacttgtttggctgacctttttatgcagataagccaagcaaagaaaaaaactggtgttattgctccaaaacgttttgttcagagagtgaagaaacagaatgagttgtttcgtagctacatgcaccaggacgcacatgagttct

SEQ ID NO: 38141 - protein, 118 aa, Panicum virgatum
  misc_feature: Ceres CLONE 1992617
  misc_feature: SWISSPROT Homolog: EC 3.1.2.15 Ubiquitin thiolesterase
MVMGASGSKLEKALGDQFPEGERYFGLENFGNTCYCNSVLQALYFCIPFREQLLEYYANNKNPGDAEENLLTCLADLFMQISQAKKKTGVIAPKRFVQRVKKQNELFRSYMHQDAHEF

SEQ ID NO: 38142 - DNA, 1435 bp, Panicum virgatum
  misc_feature: Ceres CLONE 1992621
  misc_feature: Encodes the peptide sequence at SEQ ID NO. 38143
gggtcatccccgactcctaaaccccaaagcaccaaaaccctaatcccctcctccccgccgccaccgccgccatgggctccgccgccgccgccgccgccgctctcccggcctccgccggctctggcgagaatctagtcctcatcctcgactacggctcgcagtacacccacctcatcacccgccgtgtccgccagctgggcgtcctctccctctgcgtctccggcacggcgccgcttgccgccctcgagagcctgcgcccgcgtgccatcgtcctctccggcgggccccactccgtccacgccgagggagcgcccacctttcccgagggattcctggacttcgccgatggcgcgggcgcccacgtgcttggcgtctgctacgggatgcagctgctcgtgcagtcccttggcggcgccgtggagcccggggagcggcaggagtacgggaagatggaggtcgaggggacggcgccgtcctctgccctgtacggggaggcggagaccgggaagcgccagacggtgtggatgagccacggcgatgaggtggtcaggctgccggaggggttcgaggtggttgcgcgcagcgtcgagggcgccgttgcagccatcgagaatcgggagaagcgcttttatgggctccagtatcaccccgaggttacacattcaccccaaggaatggaaacactccgccgcttcctatttgatgtttgtgggatcaaagctgattggaagatgcaagatgtgctggatgaagaaatcaagaccatccaaagcatggttggccctgatgaggatgttatctgtgcattgtcaggtggagttgattcaactgttgttgccacccttgttcacaaggcaataggagataggcttcattgtgtttttgttgacaatggtctattgaggtacaaggagagagaacgagtaatgtcaacctttgaaagtgatttgcacctgccagttacatgtgttgatgcctcggagcaatttctcagcatgttaaagggcatcgaagacccagagcagaaaagaaagattattggcagggagttcatagctgtttttgatgattttgctcacaagctggaacagaaggtagggaaaaggcctgaatatttagttcaagggacattgtaccctgatgtaattgaatcatgcccacctcctgggagtggaaggacacattcccacaccatcaaaagccatcacaatgttggtggccttccaaaagatatgaagttaaaactcattgaaccactcaagctcctattcaaagatgaggtgcggaagttggggagtattttgaatgtcccagattcatttttaaagcggcacccatttcctgggcctggtcttgctgtacgtgtcctaggtgatgttacacaaggcaatgctttggacacccttcgtcaggtggatgacatatttgttcaggc

SEQ ID NO: 38143 - protein, 454 aa, Panicum virgatum
  misc_feature: Ceres CLONE 1992621
  misc_feature (23)..(212): Pfam Name: GATase Pfam Description: Glutamine amidotransferase class-I
  misc_feature: SWISSPROT Homolog: EC 6.3.5.2 GMP synthase (glutamine-hydrolyzing)
MGSAAAAAAALPASAGSGENLVLILDYGSQYTHLITRRVRQLGVLSLCVSGTAPLAALESLRPRAIVLSGGPHSVHAEGAPTFPEGFLDFADGAGAHVLGVCYGMQLLVQSLGGAVEPGERQEYGKMEVEGTAPSSALYGEAETGKRQTVWMSHGDEVVRLPEGFEVVARSVEGAVAAIENREKRFYGLQYHPEVTHSPQGMETLRRFLFDVCGIKADWKMQDVLDEEIKTIQSMVGPDEDVICALSGGVDSTVVATLVHKAIGDRLHCVFVDNGLLRYKERERVMSTFESDLHLPVTCVDASEQFLSMLKGIEDPEQKRKIIGREFIAVFDDFAHKLEQKVGKRPEYLVQGTLYPDVIESCPPPGSGRTHSHTIKSHHNVGGLPKDMKLKLIEPLKLLFKDEVRKLGSILNVPDSFLKRHPFPGPGLAVRVLGDVTQGNALDTLRQVDDIFVQ

SEQ ID NO: 38144 - DNA, 662 bp, Panicum virgatum
  misc_feature: Ceres CLONE 1992621-R
  misc_feature: Encodes the peptide sequence at SEQ ID NO. 38145
agtgaggatggcatgactgcagattggtactattttgcccgtgatttcctagtagatgtggtcaacaaaatctgcaacaatgtccgtggcatcaaccgtgtctgccaggacatcacatcaaagccacctgcaacagttgagtgggaataggaactggtgctctgatggtgtgacggtggggtctggctcggaagttgaggaacaatttaccttttggtgctgagatcaaatgatatatggccccagttattagtgtaatgattacggtttagtcaaaaatatcctttatcgaaccttagatgataaacacagcaaaactcgtgaactctatactctgctaaattctagagtagacttctgggtcactgagcattttctggggcatctggatccgagagtttctttttctattcatggatcgagactgatgttgggaaggacatctggatccgagggtttggggaagcgcacttggtttcttcgttttacgtttgtcttgctaagcactattctgaagctttttttttcagcatgtagatttaaccaaacggcaggcaatgtaggttcaaaccaaatggcaaaaaagacatttgcgccatttgcctgttgtatatgtaagcgaccggagtaatcttcattacatatattttgaaagttggtcc

SEQ ID NO: 38145 - protein, 49 aa, Panicum virgatum
  misc_feature: Ceres CLONE 1992621-R
  misc_feature (1)..(48): Pfam Name: GMP_synt_C Pfam Description: GMP synthase C terminal domain
  misc_feature: SWISSPROT Homolog: EC 6.3.5.2 GMP synthase (glutamine-hydrolyzing)
SEDGMTADWYYFARDFLVDVVNKICNNVRGINRVCQDITSKPPATVEWE

SEQ ID NO: 38146 - DNA, 403 bp, Panicum virgatum
  misc_feature: Ceres CLONE 1992629
  misc_feature: Encodes the peptide sequence at SEQ ID NO. 38147
atttgccctcaatcccggtccggccgccggccgccgcgccgccattccgccatggcgatggacaccacgactaggaggaggagaaggctggaaggggaggaagaggaggagggcctcgaccgcattagcggcctccccgacgccgtcctcggcgaaatcgtctcccttctacccaccaaggatggcgcccgcacgcaggtcctctcctcccggtggcggcccctatggcgctccgctcccctcaacctcgatccctgcggcctctcggacggccgggagatctcccgcatcctcctcctgcaccgcgggccccggacgccgctccttcccccccgaatacacctccagaccaagagcgaaacccgcacgcaccgatcctggtcgatggatgagtccaggctcc

SEQ ID NO: 38147 - protein, 117 aa, Panicum virgatum
  misc_feature: Ceres CLONE 1992629
  misc_feature (23)..(70): Pfam Name: F-box Pfam Description: F-box domain
MAMDTTTRRRRRLEGEEEEEGLDRISGLPDAVLGEIVSLLPTKDGARTQVLSSRWRPLWRSAPLNLDPCGLSDGREISRILLLHRGPRTPLLPPRIHLQTKSETRTHRSWSMDESRL

SEQ ID NO: 38148 - DNA, 691 bp, Panicum virgatum
  misc_feature: Ceres CLONE 1992633
  misc_feature: Encodes the peptide sequence at SEQ ID NO. 38149
attcgcacccccgccgcgccgccccccaaaccctagccgccgccgccgccatggtcgccttcagccgccccctcgtttccgtgaaggccctggagggcgacatggccgtcgacgccgcgggcatccccttcccggcggtcctcagcgcgccgatccgccccgacgtcgtcaggttcacccacaagctgctgtcctgcaacaagcgccagccctacgccgtctcccgccgcgccggccaccagacgtcggcggaatcctggggcaccgggcgcgcggtgtcgcgtatcccccgcgtccccggcggcggcacccaccgcgccggccagggggccttcggcaacatgtgccgcggcggccgcatgttcgcgcccaccaagacctggcgcaagtggcaccgccgcgtcaacgtcaacctccgccgcgtctccgtcgcctcggcgctcgccgccaccgccgtccccgccctcgtccaggcgcgcggccaccgcatcgaggccgtccccgagctgcccctggtcatctccgacgccgccgagtccatcgagaagacctcccaggccattaagatcctcaaacaggttggcgcctacgccgacgccgagaaggccaaggactcggtcggcatccgccccggcaagggtaagatgcgcaaccgccggtacatcaaccgcaagggcccgctgattgtcta

SEQ ID NO: 38149 - protein, 213 aa, Panicum virgatum
  misc_feature: Ceres CLONE 1992633
  misc_feature (23)..(213): Pfam Name: Ribosomal_L4 Pfam Description: Ribosomal protein L4/L1 family
  misc_feature: Useful for making plants with modulated biomass
MVAFSRPLVSVKALEGDMAVDAAGIPFPAVLSAPIRPDVVRFTHKLLSCNKRQPYAVSRRAGHQTSAESWGTGRAVSRIPRVPGGGTHRAGQGAFGNMCRGGRMFAPTKTWRKWHRRVNVNLRRVSVASALAATAVPALVQARGHRIEAVPELPLVISDAAESIEKTSQAIKILKQVGAYADAEKAKDSVGIRPGKGKMRNRRYINRKGPLIV

SEQ ID NO: 38150 - DNA, 709 bp, Panicum virgatum
  misc_feature: Ceres CLONE 1992638
  misc_feature: Encodes the peptide sequence at SEQ ID NO. 38151
acacacggccacacctccccgactccgccgtcacctccccctccgcctccttcccacgccgcctcagcggtttgaggttcacctgcagccatgggtaaggagaagacccacatcaacatcgtggtcattggccacgtcgactctggcaagtcgaccaccaccggccacctgatctacaagcttggcggtatcgacaagcgtgtgatcgagaggttcgagaaggaagccgctgagatgaacaagcggtccttcaagtacgcgtgggtgcttgacaagctgaaggctgagcgtgagaggggtatcacaatcgatatcgccctgtggaagttcgagaccaccaagtactactgcactgtcattgatgcccccggacaccgtgacttcattaagaacatgatcacgggtacctcccaggctgactgtgctgtacttatcatcgactccaccactggtggttttgaggctggtatctccaaggatggccagacccgtgagcatgctctccttgccttcactcttggagtgaagcagatgatctgctgctgcaacaagatggatgccaccactcccaagtattccaaggcccgttatgatgagatcgtgaaggaagtctcctcctacctgaagaaggtgggatacaaccctgacaagattgccttcgtccccatctctggttttgagggtgacaacatgattgagaggtccacga

SEQ ID NO: 38151 - protein, 206 aa, Panicum virgatum
  misc_feature: Ceres CLONE 1992638
  misc_feature (5)..(205): Pfam Name: GTP_EFTU Pfam Description: Elongation factor Tu GTP binding domain
  misc_feature: SWISSPROT Homolog: EC 2.7.7.4 Sulfate adenylyltransferase
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERST

SEQ ID NO: 38152 - DNA, 735 bp, Panicum virgatum
  misc_feature: Ceres CLONE 1992640
  misc_feature: Encodes the peptide sequence at SEQ ID NO. 38153
agaggggagggaggcagccggcggcagccattactcctccagtcctcacactagccaccaccgccgccgctgctggggacgcctgcggcaagtacaggcggaccagcggcagcagagggttcgattcggcggccgcaataaattccgtcccgcccatggcacggagggccgcctcctcgctcgtctcccgctacctgctcgccagcagggccgcctctgccggtgccgcgccggctgtcccctctgcgctgcgcggaccagatgggacgcgcggactgttgccaggggtccttcaaaggttcagcactgcagcagcagcagaggagcccatctcgcccccagtccaagtgaactacacaaagctcctcatcaatggcaactttgttgattccgcatccggcaagaccttcccaacactggaccctcgtacaggggaggtaattgctcatgtggctgaagctgatgcagaggatgttaaccgtgctgtcgctgcagcacgcaaggcttttgatgaggggccgtggccgaagatgactgcatatgagaggtcccgtatcctgctacggtttgctgatttgatcgagatgcacaatgatgagattgctgctttggagacatgggacaatgggaagccatatgaacaagctgcccaaattgaagtaccgatggtggcccgtcttatgcgttactatgctgggtgggctgataagatccaggggctcgttgtgccggctg

SEQ ID NO: 38153 - protein, 193 aa, Panicum virgatum
  misc_feature: Ceres CLONE 1992640
  misc_feature: SWISSPROT Homolog: EC 1.2.1.3 Aldehyde dehydrogenase (NAD(+))
MARRAASSLVSRYLLASRAASAGAAPAVPSALRGPDGTRGLLPGVLQRFSTAAAAEEPISPPVQVNYTKLLINGNFVDSASGKTFPTLDPRTGEVIAHVAEADAEDVNRAVAAARKAFDEGPWPKMTAYERSRILLRFADLIEMHNDEIAALETWDNGKPYEQAAQIEVPMVARLMRYYAGWADKIQGLVVPA

SEQ ID NO: 38154 - DNA, 1753 bp, Panicum virgatum
  misc_feature: Ceres CLONE 1992644
  misc_feature: Encodes the peptide sequence at SEQ ID NO. 38155
attaaaatcattctgcagctagcgcactcacaaacacagacccaaatcgatcgaaatgcccctctccctgacctcatggctttacgaccttgccttcctgatcctcctgcctctgctcctcctacccctcatctacctgctgtaccagcgccgccatgatccctgcaagaagcagcctcgcggagatgatgacctcaaggcctacccactcctcgggaggctcccacacctggtcaggaaccagcaccgcttagccgaatggtcggtcggcgtcgtgaagcgaagcccgacgcataccgcgtccttcaaagccgccggcctgcccggcgtcgtcatcaccgccaaccaggagaatctcgagcacgtagccaagacaagcttcgccaactaccccaagggcgactacatgctatccatgatcagggacctgctcggccacggcctcttcaactccgacggcgaccagtggctgtggcagcgcaaggccgccagctacgagttcagcaagcgctcgctgaggaagttcatcgccgacaccgtccggtccgaggtcgtcgaccggcttctaccgctgctggagcaggccgcgcgccatgggcgcactctggacatgcagcgcgtcttcgagtccttcgccttcgacaacatctgccacgtggccttcggcgaggacccggcgtgcctcgccgaggagggcacggccacgccgccgcaggcctcggagttcatgcgcgcctttgacgacgtccagaacgccatggtggcccgtttccggccgccggagagcttgctgtggcgtctgaagcggatgctcgacatagggtccgagaggcaggtccgccaggcgctcgacatcgtccacggctacgccgacatgatcgtccgaaggtgcagggagagaggagagagcagggacgacttcctagcgcacttagttgccgctcgcggggatctcagcaaagagagcctccgggacgtggtcaccaacttcctccttgctgggcgcgacacgacgtcctccgcgctgacatggttcttctggctggtctccggccggcctgacgtcgaggacaagatcgtgcgtgaggtccgcacactgctgcgcggatcaccaagatcgtcctcaagccatggcggcggcacgggcacgacgacgacgacgacgttcggcttggacgagctccgggaaatgcactacatccacgccgccatcaccgagtcgatgcggctgtacccaccggtggccatgggcatgcactccagcaagcgggatgaccacctgccggatggcacgttcgtcgggaaagggtggctggtgaaccactccatgtacgccatggcacggctggagagcttatggggcaaggattgtgaggagttcaggccggagaggtggctccgggaagacgacacgttccagccagagagcccgtcgaagtaccccgtgtttcatgtggggccaaggatgtgcctcggcaaggagatggcctacatccagatgaagtctatcgtgtcctgcgtgttccagaggttcagcttccagttccttggcggtgaggagcgccctaggctagacttatccttcacgctgcggatgaaaggcggtttgccgatgcaagtgaccaagcggccgggagaagctgctctaggctagcataaaggaaggagggagtatcaattgttgttgtgagtcactcactcccaggggcgaatccagcagcaagtcaagagggggctcactctccattctctc

SEQ ID NO: 38155 - protein, 532 aa, Panicum virgatum
  misc_feature: Ceres CLONE 1992644
  misc_feature (41)..(522): Pfam Name: p450 Pfam Description: Cytochrome P450
  misc_feature: SWISSPROT Homolog: EC 1.14.14.1 Unspecific monooxygenase
MPLSLTSWLYDLAFLILLPLLLLPLIYLLYQRRHDPCKKQPRGDDDLKAYPLLGRLPHLVRNQHRLAEWSVGVVKRSPTHTASFKAAGLPGVVITANQENLEHVAKTSFANYPKGDYMLSMIRDLLGHGLFNSDGDQWLWQRKAASYEFSKRSLRKFIADTVRSEVVDRLLPLLEQAARHGRTLDMQRVFESFAFDNICHVAFGEDPACLAEEGTATPPQASEFMRAFDDVQNAMVARFRPPESLLWRLKRMLDIGSERQVRQALDIVHGYADMIVRRCRERGESRDDFLAHLVAARGDLSKESLRDVVTNFLLAGRDTTSSALTWFFWLVSGRPDVEDKIVREVRTLLRGSPRSSSSHGGGTGTTTTTTFGLDELREMHYIHAAITESMRLYPPVAMGMHSSKRDDHLPDGTFVGKGWLVNHSMYAMARLESLWGKDCEEFRPERWLREDDTFQPESPSKYPVFHVGPRMCLGKEMAYIQMKSIVSCVFQRFSFQFLGGEERPRLDLSFTLRMKGGLPMQVTKRPGEAALG

SEQ ID NO: 38156 - DNA, 456 bp, Panicum virgatum
  misc_feature: Ceres CLONE 1992661-R
  misc_feature: Encodes the peptide sequence at SEQ ID NO. 38157
gatttacgggccttcactgcacaacgattatggggctgaaatatatccaggtattgatgatgccatccagacagcaaagagaacaaatacatcagaatcctggcaggctgtacagaatgagattcacagggttgctagagtcataaatcaggcagcattagttctaactggagggctaacgtgaaaagctatctgcggtagaacttggctatacaagcggaagcagcaacaagacagaatgaatggtacagtgaatcttgtaacgaggaaagtatttgtgattagtgtactaattgttattgctacagcacggcctcaccattggccattaacttggatgtaagattgtagagttcgtctgctcaggcaatcttaccgtccaatcaaacagcaggaacaaaatagtttgtctactcaggcagccttactcaagaatgaaaccaatagcacttttcc

SEQ ID NO: 38157 - protein, 60 aa, Panicum virgatum
  misc_feature: Ceres CLONE 1992661-R
  misc_feature: SWISSPROT Homolog: EC 3.4.17.21 Glutamate carboxypeptidase II
IYGPSLHNDYGAEIYPGIDDAIQTAKRTNTSESWQAVQNEIHRVARVINQAALVLTGGLT

SEQ ID NO: 38158 - DNA, 698 bp, Panicum virgatum
  misc_feature: Ceres CLONE 1992661
agacacatccggcttctcccccccgtgcggccggccctgcccgtctcggcgtctcctccgcttcactcgtaactgcagcctccgccgcacaccgccgcccgctccccggctgctgatcctgatctcacgccgccaccccgcgtagccggcttccctgaggcggcgccatgcctcccctggacggggccgacgagccctcggcgcggggcccgctcctcccgcccccagctccgcgccgcgcggccgcgaggctccacaagctcccgctcatcgtcacggccgccttcgtcgcctcgctccacctgctcttcctcacgccgggcccctcctattaccagtccctcttcctctcgctcggctccaacgacaccgccgcggcgcaccttcgcgcgctcacccagcgcccgcacgtcgccggcacccgggccaactccctcaccgccgcctacgtgcgcgacgcactctcctcccactccttccctacccgcctcactccctactccgtcctcctctcctaccccgcgcgccgctcgctctccctctccgcgccggaccgcggcaccattcacttcgctctggagcaggaaacctaccccggggacccctacgccgcggtctccgcggaggccgtccccaccttccttgcctacgcggcctccggctcggtcgcggccgaggccgtctacgccaactacggc

SEQ ID NO: 38159 - DNA, 696 bp, Panicum virgatum
  misc_feature: Ceres CLONE 1992665
  misc_feature: Encodes the peptide sequence at SEQ ID NO. 38160
gcggggctgggcgcggggactacgaccagcagcggcaggctgcggaggccatgtgcgacgccgcctcccgcttagggttcaattgcaccatcaactatggaccggaccttctgctgtcgcctcagattaattttctcgtggcgtgcgacagtggcaacatccgccgcatcaaggcactggtggaaagcatggatgaggatgacagagaatcacttgcctctgtgcgtatggagggcttaggggcactgcatgcggcagcaatgaagggtaaagtggaagtttgtaggtacttggtggaggagctgaagtttgacgtcaattcggtttctagccctgaattgggtatgacaccattgatttcagctgtctcggaaggacaagttgctgctgtcaggtatcttcttgctaaaggtgcagatccaaataagcaagatcatgaaggctatgctcctctgcatgatgctgcaaaaggaggatttgatgaaattgctcggttgttgctatctggaggagcaataattgatatatcatcttctgaagggacaccattacatgctgctgctgcctttggaaagattggtgtcatgcagattttactggagcatcatgcagatgtgaacaaggtctcagcaagggattgtacacccctggctgaaactcttcttgccattccggaaaaaatgaatgaatcaactc

SEQ ID NO: 38160 - protein, 231 aa, Panicum virgatum
  misc_feature: Ceres CLONE 1992665
  misc_feature (113)..(145): Pfam Name: Ank Pfam Description: Ankyrin repeat
  misc_feature: SWISSPROT Homolog: EC 2.7.11.1 Non-specific serine/threonine protein kinase
  misc_feature: The sequence is a functional homolog of SEQ ID NO 1844 in the 10/374,780 US patent application
  misc_feature: The sequence is a functional homolog of SEQ ID NO 1843 in the 10/374,780 US patent application
GAGRGDYDQQRQAAEAMCDAASRLGFNCTINYGPDLLLSPQINFLVACDSGNIRRIKALVESMDEDDRESLASVRMEGLGALHAAAMKGKVEVCRYLVEELKFDVNSVSSPELGMTPLISAVSEGQVAAVRYLLAKGADPNKQDHEGYAPLHDAAKGGFDEIARLLLSGGAIIDISSSEGTPLHAAAAFGKIGVMQILLEHHADVNKVSARDCTPLAETLLAIPEKMNEST

SEQ ID NO: 38161 - DNA, 1487 bp, Panicum virgatum
  misc_feature: Ceres CLONE 1992667
  misc_feature: Encodes the peptide sequence at SEQ ID NO. 38162
ggagtgagtcgtcgtgtgggtgactcggtgtggccggccaagcccaagcccgtcgtcgtcgtcagctcgtcgccgcgacgccgaccgagcaggtcgccgccgttgtccggcatccatccattcatcccccccggcaggaggcagcagtcgcaggtagaagcagagcgggcctgacaggatgccggagaagaagagcggcgacgaggaggggcgcggcggcgccttctgcggcgaggcggtgatcgccgagttcgaggcgctcagtcgggacgccgccgccgtgcagcgggagacgctgcgccggatcctcgccgagaacgccgccgccgagtacctccggggccggggcctcgacggccgcaccgacccggacagcttccgggcctgcgtgccgctcgccacgcacgccgacgtcgagccctacattgcgcgcatcgccgacggcgacgcctccgccgtgctcaccgccgggcccatcacctccatctccctcagctccggcaccacgcaggggaagcgcaagtacctgcctttcaaccaggagctcgtcaagtccaccatgcagatataccggacttcgtacgccttcaggaacagggcgttccccgtggaggacggcaaggcgctgcagttcatctacggcagccgggagttcaccaccaagggcggcctcacggcgaccacggccaccaccaacgtgtaccggagccaggagttcatgcccaccatgcgcgccatccagtcgcaggtgtgcagcccggacgcggtgatcttcggcccggacttcgtccagtcgctctactgccacctcctctgcggcctgctcttcgccgacgaggtccgcatcgtctccgccaccttcgcgcacagcgtcgtcctcgccttccagaccttcgagcgcgtctgggaggagctctgcgccgacatccgcgccggcgcgctgtccccgacgcgggtcaccgcccccgccgtccgcaaggccgtctcggcgctcctcgccgcgcccaacccggcgctcgccgacgaggtggcgcgccggtgcgccgcgctcagcaactggtacggcgtcatcccggcgctgttccccaacgccaggtacgtgcacggcatcatgacggggtccatggagcactacgtcaagaagctccgccactacgccggcgggctgcccctcgtcgccgccgagtacggcgcatccgagggctgggtcggggccaacgtcgagcccgagacgccgccggagtccgccacattcaccgtgctccccaacatcggctacttcgagttcatcccgctcaaggccagcgacggcgccgccgccgcctccgacacctccttcgccgaggcggagccagtcggcctcacggaagtcaccgtcggcgagcactacgaggtcgtcatgaccacattcgcagggctgtaccggtaccgtctgggcgacgtggtgaaggtggccgggttctacaactcgacgcccaagctcaagt

SEQ ID NO: 38162 - protein, 436 aa, Panicum virgatum
  misc_feature: Ceres CLONE 1992667
  misc_feature (20)..(436): Pfam Name: GH3 Pfam Description: GH3 auxin-responsive promoter
  misc_feature: Useful for making plants with modulated light quality sensitivity
MPEKKSGDEEGRGGAFCGEAVIAEFEALSRDAAAVQRETLRRILAENAAAEYLRGRGLDGRTDPDSFRACVPLATHADVEPYIARIADGDASAVLTAGPITSISLSSGTTQGKRKYLPFNQELVKSTMQIYRTSYAFRNRAFPVEDGKALQFIYGSREFTTKGGLTATTATTNVYRSQEFMPTMRAIQSQVCSPDAVIFGPDFVQSLYCHLLCGLLFADEVRIVSATFAHSVVLAFQTFERVWEELCADIRAGALSPTRVTAPAVRKAVSALLAAPNPALADEVARRCAALSNWYGVIPALFPNARYVHGIMTGSMEHYVKKLRHYAGGLPLVAAEYGASEGWVGANVEPETPPESATFTVLPNIGYFEFIPLKASDGAAAASDTSFAEAEPVGLTEVTVGEHYEVVMTTFAGLYRYRLGDVVKVAGFYNSTPKLK

SEQ ID NO: 38163 - DNA, 617 bp, Panicum virgatum
  misc_feature: Ceres CLONE 1992667-R
  misc_feature: Encodes the peptide sequence at SEQ ID NO. 38164
caacgccgacggcaacgacgacgtgctgcagggctgctgcgacgagctggaccgggcgttcacggaccccgggtacgtcgggtccaggaaggccggcgccatcgggccgctggagctgcgggtgctgcagcggggcacgttccagaaggtgctccgccactacctctcccacggcgcccccgtgagccagttcaagtcgccgcgctgcgtcggccggagcaacgccggcgtcctccagatcctctccggcaacgtcgtcaaggtgttcttcagcgccgcctacgactgacgacgacgctgacaggcgcggcggcggcgccggggaggggaggatcggaggagacgacgcatgcggctgacagacggcgacgcagcgagcagcaactgatcatcatcagggcatcaggctgttgccgttcagcaccctcagcaggatatggatgcagtagtgatctatgatctgtagccaagtagccgcgcctgccggccatgtgttgtgttgtgtaactaccaaatctgcatgacgcatcgcatgtggtctgttaatttgcaacaagtagctagtgtcgttgaatcgagtgaaataaacctgttaattattaatctatctttcctcc

SEQ ID NO: 38164 - protein, 95 aa, Panicum virgatum
  misc_feature: Ceres CLONE 1992667-R
  misc_feature: Useful for making plants with modulated light quality sensitivity
NADGNDDVLQGCCDELDRAFTDPGYVGSRKAGAIGPLELRVLQRGTFQKVLRHYLSHGAPVSQFKSPRCVGRSNAGVLQILSGNVVKVFFSAAYD

SEQ ID NO: 38165 - DNA, 1358 bp, Panicum virgatum
  misc_feature: Ceres CLONE 1992672
  misc_feature: Encodes the peptide sequence at SEQ ID NO. 38166
gtcagtttatattttccgaaaaaaaaagttagggttcaactaaaccccgcagccgccgcctctcgctctcctctcgcgccgccaccgccatacacctccgctccgatccgctcctttccttctccgctctacctctcagatccagcgcggcgattctccgcttcctagcccggctctcccgggccccttgtgctagtttggttgcattcagggggctaggttttagattcggagacatggcggaagtggaggcctacgagattattagggagggtgaggccgagatcctccagctcaagaaaaacgccgtcttcttcaatcccgtgcaggttcacaacagagacatgtccattgctgttttaagggcctttgttgccaagcgcaaggaagaacatgaagcgctggcgaataagaggaataaatcgcatcaagaaaacaaacatagtgaaacatctgttcagaatggagaggatgcttcaactagccagcctgatgaaatggatgttgttcctgaaaaggatcaaagtcaagctcaagcgacaaaaacaccttcctggaaagtaaccagagaacttaagccgccacttgttcttgaggctttggctgcttctgggttgagatctctccggtatgcccgtgaagttgatggcttaggaaaggtagttgctctggacaatgataaagcttctgtcgattcttgcaagcggaacataaagttcaatggtgcttccgcaactagtaagatggaagctcacttggttgatgctagagtttacatgctcacgcatccaaaagaatttgatgtggttgatattgacccttatgggtcaccatctgtattcctcgactcagctgtacaggctgttgctgatggagggctattgatgtgcactgccactgatatggcagttctttgtggcaccaatggagaagtttgttactccaagtatggttcgtacccaaccaagggcaaatattgccatgaaatggctttgagaatcctccttgccagtattgagagccatgcaaatcggtacaagagatatatcgtgcctgttctctctgtgtttatggatttttacgtgcgtgtttttgttcgggtgttcacttctccaagtgaaataaagaatactcctcttaaactttcttacatatatcaatgtgttggctgtgattcgttccatcttcaatgtcttgggaggagtatttctaagaatagcactgtgaagcatgcacctgcaattgggcctgttgtccctcaagaatgcagtgattgtggaaagaaatttaatgtgggcgggccaatatggtctgctcctattcatgatcaagactgggtagtttctactttggcaggt

SEQ ID NO: 38166 - protein, 373 aa, Panicum virgatum
  misc_feature: Ceres CLONE 1992672
  misc_feature (3)..(373): Pfam Name: TRM Pfam Description: N2,N2-dimethylguanosine tRNA methyltransferase
  misc_feature: SWISSPROT Homolog: EC 2.1.1.32 tRNA (guanine-N(2)-)-methyltransferase
MAEVEAYEIIREGEAEILQLKKNAVFFNPVQVHNRDMSIAVLRAFVAKRKEEHEALANKRNKSHQENKHSETSVQNGEDASTSQPDEMDVVPEKDQSQAQATKTPSWKVTRELKPPLVLEALAASGLRSLRYAREVDGLGKVVALDNDKASVDSCKRNIKFNGASATSKMEAHLVDARVYMLTHPKEFDVVDIDPYGSPSVFLDSAVQAVADGGLLMCTATDMAVLCGTNGEVCYSKYGSYPTKGKYCHEMALRILLASIESHANRYKRYIVPVLSVFMDFYVRVFVRVFTSPSEIKNTPLKLSYIYQCVGCDSFHLQCLGRSISKNSTVKHAPAIGPVVPQECSDCGKKFNVGGPIWSAPIHDQDWVVSTLA

SEQ ID NO: 38167 - DNA, 584 bp, Panicum virgatum
  misc_feature: Ceres CLONE 1992672-R
  misc_feature: Encodes the peptide sequence at SEQ ID NO. 38168
aggaacgaccatcctttcaaagtccccaacgatagaagcggatttctctagagcaggggctgccctcagcaaggctcagacgaagaaggtgaagcggttccttccaaacccagaacggcactggggtccaaaggtcagagcaggccggaagatcacgagcaaacatgtctctctcttgggccctgaggctatcaatagtattctgaatggagctgtcagccacgaaggtggaaatggagcagcgccagacaaggcagctccagaacctgaagggatcaaggatgacgaaccctcaaccaaacgccagaaaactggtgatgacgaacaggcaaacgaaccttgatcgccaaaaccaccattaatttttgtttgctttacctttatatgcttccgagctttactctgttcgtgtggtcgattggttatctatatcacctgttgctgggacaacaatgaattttgatcggtcaagttttgggctaggatgtgctatgctttgctatgctctgtacgacgcgccaagtaaggctgttgaacttgtggcgaaacgtataagggaaagcatgcgtcttaaccaattctac

SEQ ID NO: 38168 - protein, 113 aa, Panicum virgatum
  misc_feature: Ceres CLONE 1992672-R
  misc_feature: SWISSPROT Homolog: EC 2.1.1.32 tRNA (guanine-N(2)-)-methyltransferase
GTTILSKSPTIEADFSRAGAALSKAQTKKVKRFLPNPERHWGPKVRAGRKITSKHVSLLGPEAINSILNGAVSHEGGNGAAPDKAAPEPEGIKDDEPSTKRQKTGDDEQANEP

SEQ ID NO: 38169 - DNA, 1754 bp, Panicum virgatum
  misc_feature: Ceres CLONE 1992673
  misc_feature: Encodes the peptide sequence at SEQ ID NO. 38170
ggggtctcatggcgctagcctagccgcctccccaacctcctcaccgaggagagagaggacagaggaggttccatttccgcgtcgtctccgcccgcagccccaccctccacatggccgcgctgccgggtggggcccacgccgccggcgccgcggacccgatgcaggtggaccagccgcgccccgccgccgcggcagcagcgaccgctcccgcggacgccaagcaagctggttctatgattgaagggggtgatccagtcactggtcacataatctcaacaaccattggaggcaagaatggagaacctaaaaggactatcagctacatggccgagagagttgtgggaactggatcattcggaatcgttttccaggctaaatgtctggagactggtgagactgttgcaattaagaaggttttacaggacaagcggtacaagaatagggagcttcaaatcatgcgatccatggatcactgcaatgtcgtctccttgaagcattgcctcttctctaccacaagcagggatgaacttttccttaacttggtgatggagtttgttcctgagtcactgtatcgtgtactgaagcattacagcaatatgaaccagaggatgccgcttatatatgtcaagttatacacctaccagatatttcggggtttagcctacattcacactgtacctggcgtttgccacagggatgtgaaacctcagaatcttttggttgatcctctgactcaccaagtgaagatatgtgattttgggagtgccaaaatgttggtcaaaggtgaagcgaacatatcatatatatgctcacgttattaccgtgctccagagctcatatttggggcgactgagtacacaacatcaattgatatctggtcagctggatgtgttcttgctgagctgcttcttggccaacctctcttccctggtgaaagtgctgtggatcagcttgttgagataataaaggttcttggtactccaacacgcgaggaaattcgatgtatgaacccaaactacactgaatttagattccctcagatcaaagctcatccatggcacaagattttccacaagcggatgcctccagaagctatagatctcgcttcacgtctgctccagtattcaccaaatctacgatgcactgctcttgaagcatgcgcacatccattctttgatgagttgcgggaaccacatgcaaggttgccaaatggtcggccattccctccactgtttaactttaaacaggaactagcaaatgcttctcctgagcttatcaacaggttgatcccagaccatgtgaggcggcatgttgggctcagttaattgcctgcaactggaccatagggaagctgtatggtgttttaccctgcgcttccgatgcttcttcgtgacgaagggcaacctgcatgtccgcacatttaagatgtagaatctgaccattattggaaagccaaacgtgagctggtgccattgtgttgcatgaggggaggtgtgtttggtgcagccagccctcgtcacttgttttaatgctccatccaatttagcctaagtagcgggagggaagggggtggtgtattgttaagctattgaaggaatccctactatcgtattactttctccaatgctaaatgttgtagtgcgcctgtaagtgttccatatccccgagtgtcagtcaatgtaattctgtaaatgttattgatgggaaattatcttgtgttatggtaattatcaagtcgtttaccctgtttagtt

SEQ ID NO: 38170 - protein, 404 aa, Panicum virgatum
  misc_feature: Ceres CLONE 1992673
  misc_feature (71)..(355): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated biomass
  misc_feature: Useful for making plants with modulated water use efficiency
MAALPGGAHAAGAADPMQVDQPRPAAAAAATAPADAKQAGSMIEGGDPVTGHIISTTIGGKNGEPKRTISYMAERVVGTGSFGIVFQAKCLETGETVAIKKVLQDKRYKNRELQIMRSMDHCNVVSLKHCLFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHVRRHVGLS

SEQ ID NO: 38171 - DNA, 1410 bp, Panicum virgatum
  misc_feature: Ceres CLONE 1992694
  misc_feature: Encodes the peptide sequence at SEQ ID NO. 38172
gtcgcaagcacgaggctgtgagcgagccagccaaggcgctcttcgatttcccctcactccagccagccgcccaaaaagccaggcgcaaatcgcaacctcgcctcctgtcccctccccggctcctcgttcccctctcgccgcccgcctcccggccgcgatcgaggcggcgccaataaccgagggcggaccgctcctctctgaccggacccatccccggcgcctccgcccccgaatctcccccgcaccccagttggccgccgccgcgccgcgatggatttggatctgtggatctccaaggtcaaggagggccagcacctcgccgagcacgagctccagtccctctgcgaatacgtgaaggagatcctcatcgaagagtcgaacgttcagccggtgaacagccccgtgacggtgtgtggtgacatccacgggcagttccatgacctgatgaagctgtttgcgactggtggccacgtcccggagaccaactatattttcatgggtgattttgtggaccgtggcttcaacagtctggaggttttcaccattctcttgctactaaaagcaaggtatccagctcacataacccttctgcgtggaaaccatgaaagtaggcagctgacacaggtgtatggtttctatgatgagtgccagaggaagtatggtaatgctaatgcatggcggtactgcactgatgtttttgattaccttacactctcagcaatcattaatggccaagtcctctgtgttcatggtggtctttctcctgatgtgcgcacaattgatcagatacgaacaattgatcgcaattgtgaaattccccatgaaggtcctttctgcgatcttatgtggagtgaccctgaagagatagagacatgggctgttagtccccgtggagcaggttggctgttcggatcacgagtcacagcagagttcaactttgttaacggtatcgagctagtttgccgggctcaccagctggtgcaggaaggcttaaagtacatgtttcaggagaagggccttgtgactgtgtggtctgcacctaattattgctacagatgtggcaatgtagcttctatattaagcttcgatgagaagatggaaagagatgtcaagttcttcacagagacagaggagaacaaccagatgcgaggcccaaggactgcagtcccatatttcctctgacttcaattgtacaattttagaagtcaaatgttttaatctgtaagggctaaagatcaaccagaggttgtttattgttgtaggttcagatcatagtgcaatttgatgcatttgatttctctattttctttgaccacatgtacaatagaccatcgggggtgctatatgttcctgtattccttcagtgacagtcaagttttgtttctaatttatttcacgtgctatttaccc

SEQ ID NO: 38172 - protein, 303 aa, Panicum virgatum
  misc_feature: Ceres CLONE 1992694
  misc_feature (43)..(238): Pfam Name: Metallophos Pfam Description: Calcineurin-like phosphoesterase
  misc_feature: SWISSPROT Homolog: EC 3.1.3.16 Phosphoprotein phosphatase
  misc_feature: The sequence is a functional homolog of SEQ ID NO 13 in US patent 7271316
MDLDLWISKVKEGQHLAEHELQSLCEYVKEILIEESNVQPVNSPVTVCGDIHGQFHDLMKLFATGGHVPETNYIFMGDFVDRGFNSLEVFTILLLLKARYPAHITLLRGNHESRQLTQVYGFYDECQRKYGNANAWRYCTDVFDYLTLSAIINGQVLCVHGGLSPDVRTIDQIRTIDRNCEIPHEGPFCDLMWSDPEEIETWAVSPRGAGWLFGSRVTAEFNFVNGIELVCRAHQLVQEGLKYMFQEKGLVTVWSAPNYCYRCGNVASILSFDEKMERDVKFFTETEENNQMRGPRTAVPYFL

SEQ ID NO: 38173 - DNA, 641 bp, Panicum virgatum
  misc_feature: Ceres CLONE 1992701
  misc_feature: Encodes the peptide sequence at SEQ ID NO. 38174
atacctggcttccacacagaaagagtgtttacaaagtgtaatcatgatcatcaaatctgcaaaacctgttgcactttccatcctggtgatcctcttactaggtatcgtagttgatggtgtacaagggaatgctgataccgaatttactcttcgagggatcaaaataaataatcctacaacgtttggtgatagcatccccaactctggtgacaaggaagaacacaaacagttaaccactgcccttggagctactacaacgtacacagaccaccatatactatctcgtgaagaccactgcaagatcttcaaatgcccttagtaaaactgggtatatgtatgggtgtcctggagtaactgcagctttcaggcctaatgttaaggtcaagtaatagaataaagctccaggacttaattggaaatatgacaatatgtacactgaacccttgcacgtcaagggaagactagttataaaatggagatatgttaactctcacaaaaacaaatttgaacgcattctcatttggtgatctcaaagctgcatctaaaaacttccggtcacacagtcttcgtggggaaggaggatttggttatgtattcaaaggctggattgacgaacaaactcttgccccttcaaagccggt

SEQ ID NO: 38174 - protein, 53 aa, Panicum virgatum
  misc_feature: Ceres CLONE 1992701
  misc_feature: SWISSPROT Homolog: EC 2.7.11.1 Non-specific serine/threonine protein kinase
  misc_feature: Useful for making plants with modulated drought sensitivity
MLTLTKTNLNAFSFGDLKAASKNFRSHSLRGEGGFGYVFKGWIDEQTLAPSKP

SEQ ID NO: 38175 - DNA, 729 bp, Panicum virgatum
  misc_feature: Ceres CLONE 1992706
  misc_feature: Encodes the peptide sequence at SEQ ID NO. 38176
aaatccccaccccgaggcaggcacgccgcccgttgtcctcaccgccgccgcatccatggagaagatctccgtcgccgtccgcttccgcccccccaaccctgccgccgccgactcctccccgggcggcgccggcgaccgcgagtggcgcatcgacgacacccgcgtcaccctcgtccaccgcaccgccggcccccttcccggctcacccttcgtcttcgaccacgtgttcgacaggaccgccaccaacgagcgggtctacggcacggtcgtccgggacctcatcggcgccgtcgtcgacggcttcaacgccaccgccttcgcttacgggcagaccagcagcggcaagacgttcaccatgaacggctccgacgccgaccccggcatcatcccgcgcggcgtccgcgacgtcttcgacaccgtgcgtcagacggacgaccgcgagttcctcgtcagggtgtcctacatggagatctacaacgaggagatcaacgacctcttgacgcttgagggccggcggctgccgattaaagagaacctcgagcgtggagtatatgtagctggtttgcgggaggagatcgtgaacagcgcagaacaagtgttggagctcctccagctcggagaagtgaacaggcattttggggagacaaacatgatcgcccggagtagtcggtcacacactattttcagaatggtcattgaaagcagtgctaagaatcagatagactctga

SEQ ID NO: 38176 - protein, 224 aa, Panicum virgatum
  misc_feature: Ceres CLONE 1992706
  misc_feature (9)..(224): Pfam Name: Kinesin Pfam Description: Kinesin motor domain
MEKISVAVRFRPPNPAAADSSPGGAGDREWRIDDTRVTLVHRTAGPLPGSPFVFDHVFDRTATNERVYGTVVRDLIGAVVDGFNATAFAYGQTSSGKTFTMNGSDADPGIIPRGVRDVFDTVRQTDDREFLVRVSYMEIYNEEINDLLTLEGRRLPIKENLERGVYVAGLREEIVNSAEQVLELLQLGEVNRHFGETNMIARSSRSHTIFRMVIESSAKNQIDS

SEQ ID NO: 38177 - DNA, 710 bp, Panicum virgatum
  misc_feature: Ceres CLONE 1992726
  misc_feature: Encodes the peptide sequence at SEQ ID NO. 38178
actcacacaacacaagcaagctaagctcgatcgcccgcccgcccccttcgaccttcgtccagctccaccaccacacatctcgccgcttcggccatggtccggcgggtgtccctgctgcagctgctgctgctgggcgcgctggcggcctgctcggcggcggcggcggccagcttcgaccaggagttcgacatcacctggggcgacggccgcggcaagatccaggacggcggccgcctcctcacgctcacgctcgaccgcacctccggctccggcttccagtccaggcacgagtacctcttcggcaagatcgacatgcagctcaagctcgtccccggcaactccgccggcaccgtcaccgcctactacctctcctcccaggggagcgcccacgacgagatcgacttcgagttcctgggcaacgtctccggcgagccctacacgctgcacaccaacgtgttcacgcaggggcagggccagcgcgagcagcagttccgcctctggttcgaccccaccaccgacttccacacctactccatcctctggaatcccaagcacatcatcttcatggtggacgacctgccgatcagggacttccggaacctggagagcaaggggatcgcgttccccaagagccagcccctgcggctctactccagcctctcgaacgccgacgactgggccacgcaggggggccgcgtcaagacggactg

SEQ ID NO: 38178 - protein, 205 aa, Panicum virgatum
  misc_feature: Ceres CLONE 1992726
  misc_feature (27)..(205): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
  misc_feature: Useful for making plants with altered lignin content
MVRRVSLLQLLLLGALAACSAAAAASFDQEFDITWGDGRGKIQDGGRLLTLTLDRTSGSGFQSRHEYLFGKIDMQLKLVPGNSAGTVTAYYLSSQGSAHDEIDFEFLGNVSGEPYTLHTNVFTQGQGQREQQFRLWFDPTTDFHTYSILWNPKHIIFMVDDLPIRDFRNLESKGIAFPKSQPLRLYSSLSNADDWATQGGRVKTD

SEQ ID NO: 38179 - DNA, 584 bp, Panicum virgatum
  misc_feature: Ceres CLONE 1992737
  misc_feature: Encodes the peptide sequence at SEQ ID NO. 38180
cccacccgctgcgcttctccctcctctgcccccgcctccgcccttccctcgctcgcctctcctctctcctagtcctctctccacaaaccacccccacccccaccaccgtccagggacaccgaccgatcgccaggatgagggagatcctgcacatccagggcggccagtgcggcaaccagatcggcgcccagttctgggaggtgatctgcggggagcacgccgtcgactccacgggccgctactcggggtcctccgcgcagcagctcgagcggatcaacgtctactacaacgaggccgggggcggccgctacgtgccccgcgccgtgctcatggacctcgagcccggcaccatggagtccatccgcgccggccccttcggcggcatcttccgccccgacaacttcctctaccgccagtcgggcgccggcaaccactgggccaagggccactacaccgagggcgccgagctcatcgacgccctcctcgacgtcgtgcgccaggaggccgagaactgcgactgcctcccagggttccaagtatgccactccctgggtggaggcacgggatccggcatgggcaccccg

SEQ ID NO: 38180 - protein, 149 aa, Panicum virgatum
  misc_feature: Ceres CLONE 1992737
  misc_feature (45)..(149): Pfam Name: Tubulin Pfam Description: Tubulin/FtsZ family, GTPase domain
  misc_feature: Useful for making plants with modulated flowering time
MREILHIQGGQCGNQIGAQFWEVICGEHAVDSTGRYSGSSAQQLERINVYYNEAGGGRYVPRAVLMDLEPGTMESIRAGPFGGIFRPDNFLYRQSGAGNHWAKGHYTEGAELIDALLDVVRQEAENCDCLPGFQVCHSLGGGTGSGMGT

SEQ ID NO: 38181 - DNA, 715 bp, Panicum virgatum
  misc_feature: Ceres CLONE 1992760
  misc_feature: Encodes the peptide sequence at SEQ ID NO. 38182
tgttcctcgtgctaccgtgtcagtgtctgtcgatagctctgcgcgcggatccaggcgggcggggactgtggcaacgccgcgatgccgatctgcccgccgtcgtcggactcctcggcctcgtcggcctccggcggccgcgcgtggatagtccacgggctggcgctcggcgtggcggccgcggcggccgccgccgcggcgtacctgtaccgccggccgagcgggttccgcagccgcgcggtggggatcatacccgcgcgcttcgcctcctcgcgcttcgagggcaagccgctcgcgcacatcctcggcaagcccatgatccagagaacatgggaaagagttatgttagcttcttccttggaccacgttgttgtggcaacagatgatgagagaattgcagattgttgtcgaggatttggagctgatgttataatgacatcagaatcatgcagaaatggatctgagcgctgctgtgaggcacttgaaaagcttgggaaacgttatgatattgttgtcaatattcaaggagatgagcctcttatcgaaccagagataatagatggtgtcgttatggcattgcagcgagctcctgatgcagtgttcagcacagctgttacttcactgaaacctgaagatgcatctgatacgaatcgagttaagtgtgttgtggataatcagggctatgcaatctacttttcaagagggctgataccatcca

SEQ ID NO: 38182 - protein, 211 aa, Panicum virgatum
  misc_feature: Ceres CLONE 1992760
  misc_feature (53)..(211): Pfam Name: CTP_transf_3 Pfam Description: Cytidylyltransferase
  misc_feature: SWISSPROT Homolog: EC 2.7.7.38 3-deoxy-manno-octulosonate cytidylyltransferase
MPICPPSSDSSASSASGGRAWIVHGLALGVAAAAAAAAAYLYRRPSGFRSRAVGIIPARFASSRFEGKPLAHILGKPMIQRTWERVMLASSLDHVVVATDDERIADCCRGFGADVIMTSESCRNGSERCCEALEKLGKRYDIVVNIQGDEPLIEPEIIDGVVMALQRAPDAVFSTAVTSLKPEDASDTNRVKCVVDNQGYAIYFSRGLIPS

SEQ ID NO: 38183 - DNA, 696 bp, Panicum virgatum
  misc_feature: Ceres CLONE 1992770
  misc_feature: Encodes the peptide sequence at SEQ ID NO. 38184
gctcagaccggcccattagacaagtgaagaagaaaacctaccggacgctgcaccgcctcctcccccttgaagcttcttctcagcggcggccgagggagaagatggttgcggcgatcagggtcaagacccaacgcgccaggcgggagctcctcaagcacgcgcccaagctcgtcgagactggcaaaaaaacgcttatcctccatggtacaaagactagtgctgtgttgaactcagtgctgtcagatatctaccacctgaagcgagataatgccatgaagtacaccaagaagaatgacagcattcggccgtttgaaagtggtggggaatcttctctggagtttttctccctcaagacagactgcagccttatagtgtatggttctcattcaaagaagaggcccgacaatctcattttgggaaggacatatgaccaccacatatatgaccttgttgaagtaggtgttgataagaagctggcaccaaaacttggatcgaagcctttctttgccttcataggggaacactttgagagtgtcgaagagctgaagcatttgaaagaagtgctgcttgatcttttcaggggagaggttatagagaatgtaaaccttgctggtgtagatcggatctatgtgtgcacagcaatctctcctactactgtctacatgatgcactgtgctctccatctaaaaaggtcag

SEQ ID NO: 38184 - protein, 198 aa, Panicum virgatum
  misc_feature: Ceres CLONE 1992770
  misc_feature (31)..(198): Pfam Name: Brix Pfam Description: Brix domain
  misc_feature: Useful for making plants with modulated biomass
MVAAIRVKTQRARRELLKHAPKLVETGKKTLILHGTKTSAVLNSVLSDIYHLKRDNAMKYTKKNDSIRPFESGGESSLEFFSLKTDCSLIVYGSHSKKRPDNLILGRTYDHHIYDLVEVGVDKKLAPKLGSKPFFAFIGEHFESVEELKHLKEVLLDLFRGEVIENVNLAGVDRIYVCTAISPTTVYMMHCALHLKRS

SEQ ID NO: 38185 - DNA, 685 bp, Panicum virgatum
  misc_feature: Ceres CLONE 1992777
  misc_feature: Encodes the peptide sequence at SEQ ID NO. 38186
aattttctcactttccccatttgttcgccggagcgcccgccgccgccgccgccggagcgccgccgatggcgagcggggcggaccgcatcagcggcctcccggagggcgtcctccaccacatcctctccctcctgccggcgcaggacgcggtgcgcacgtgcgtgctcgcgcagagctggcgccaccactggcggtccgcgcccgccctgcgcctcgctggctgtgccggctgggccggcggcgcctacaccttcggccccttcgtcgacgccctgctgcgcgcccgccgcgggggcgggggcgcgcccctcgactccgtcgacttcgacctcgacgtcgatctggatctgggccgctacgacgtccccaagatggagcgccacgtcaacggctggctccgccgcgcgctgcggcgccaggtccgggacctccggttccgggtctccgtcgcgccccggctcacctgtgcgctggaggaccggcccctcgcctccgagcacctcaccaggctggagctcgtcggcgtcaagggcaacgccggcgtcctcgatttctcctgctgccccgcgctggaggagctcaggatggaggactgcgatgtcggctcgacggagatgctctccccgtccttgaaacgcctgaggatcagatactgcatcttctactgcaacttccgcactgggat

SEQ ID NO: 38186 - protein, 206 aa, Panicum virgatum
  misc_feature: Ceres CLONE 1992777
  misc_feature (6)..(53): Pfam Name: F-box Pfam Description: F-box domain
MASGADRISGLPEGVLHHILSLLPAQDAVRTCVLAQSWRHHWRSAPALRLAGCAGWAGGAYTFGPFVDALLRARRGGGGAPLDSVDFDLDVDLDLGRYDVPKMERHVNGWLRRALRRQVRDLRFRVSVAPRLTCALEDRPLASEHLTRLELVGVKGNAGVLDFSCCPALEELRMEDCDVGSTEMLSPSLKRLRIRYCIFYCNFRTG

SEQ ID NO: 38187 - DNA, 698 bp, Panicum virgatum
  misc_feature: Ceres CLONE 1992784
  misc_feature: Encodes the peptide sequence at SEQ ID NO. 38188
agtcgatccatcaatgcacaggcatcaactcgggaaaaagtgtgaggaaagctgggccatgggagccactgccccgaattttcctttctttttctccacatgattcggcattcaagcttcacattcaatgaggagcccggcccccgtcgctgtggaccaaggcagctagctcctcggtccactgtagccacctgctcacttgccgttttgactcacagttgctgtcactttctgcatcgcctctgtgctcggccatgcgccccgttaaccttcgccgcaactgcggttgtttactctggctagcttctggtgcagatttctctccgtgttcatctctgaggatctcatggcgtccgccgcccgttttgtgcacgcaggtggtcggcgatcgcgacgcacctgccgaagcgcaccgacaacgagatcaagaactactggaacacgcacctcaagaagcggctggccaagatgggcatcgacccggtcacgcacaagccgcgctccgacgcggtcggcgcgggcggcggcggcggcgccgcgggcgcgcagcacgcccgggccgccgcgcacctcagccacacggcgcagtgggagagcgcgcggctcgaggccgaggcgcgcctggcgcgcgaggccaggctgcgcgcgctcgccgcgtccgcctccgtctcggcgccgccgggcccctccgcccgcgg

SEQ ID NO: 38188 - protein, 76 aa, Panicum virgatum
  misc_feature: Ceres CLONE 1992784
  misc_feature: The sequence is a functional homolog of SEQ ID NO 296 in the 11/479,226 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
MGIDPVTHKPRSDAVGAGGGGGAAGAQHARAAAHLSHTAQWESARLEAEARLAREARLRALAASASVSAPPGPSAR

SEQ ID NO: 38189 - DNA, 681 bp, Panicum virgatum
  misc_feature: Ceres CLONE 1992789
  misc_feature: Encodes the peptide sequence at SEQ ID NO. 38190
actgagccaccgctactgctgctgctgctgcgagctcggctgcagctcctctacctcctccggccccccgccctctctcctcccagcagccttgcacttgcagcgacttgctaacagtgcgctccccgggcagaatgaccaaagatgaggagttcaagctggtcaagatccagaaccatgtgctgagggtgaacatacactgcgacgggtgcaagcacaaggtcaagaagctgcttcagaagattgaaggcgtgtactcggtggccatcgatgtggacaaccacaaggtctcggtgacgggggacgtggacgccgagaccttgatccggaagctcaccaggggtggcaagcacgccgagctgtggtcacagcacaagggcggcggcaaccagggccacaagggcaataaccagcagaagcagcagcagaaccagcagaagcagcagcagaaccaccaccagcaccagcagcatcagcagcagcagaagcaaggtgccaatctgagcaaggatgtccacaacaacaagaacaacaatggcgggcagaaggagcagggcaagcaggggggaggagttggaagcctcatgcagggcctcaaggcgttcaagagccagcacaacaacaagcaccagcttgctgacctcagctccgaggatgatgacatgtatgatgatgaggatg

SEQ ID NO: 38190 - protein, 182 aa, Panicum virgatum
  misc_feature: Ceres CLONE 1992789
  misc_feature (16)..(76): Pfam Name: HMA Pfam Description: Heavy-metal-associated domain
MTKDEEFKLVKIQNHVLRVNIHCDGCKHKVKKLLQKIEGVYSVAIDVDNHKVSVTGDVDAETLIRKLTRGGKHAELWSQHKGGGNQGHKGNNQQKQQQNQQKQQQNHHQHQQHQQQQKQGANLSKDVHNNKNNNGGQKEQGKQGGGVGSLMQGLKAFKSQHNNKHQLADLSSEDDDMYDDED

SEQ ID NO: 38191 - DNA, 688 bp, Panicum virgatum
  misc_feature: Ceres CLONE 1992802
  misc_feature: Encodes the peptide sequence at SEQ ID NO. 38192
aagtcctaacgacacagttcgcgcacagctgggtgctgctctgcctggtctggtcctcgattcgtggcaccaccacggaccaaggcggcggatccgaccggctccggcggggtctggggaggcgagggcggcgaccaaacgggcccgtggaggtatggccggcggcgacgaggtactctcgaccgccggagatggggaggcgggagtttgcgcgcgcgcaccacgtggcgttcttcgatgccagggccaccgagctccccgacgactacgccccgcaggaggtcaaccacctcaccctcggctacttcgcagtcggcggcctctcgctccttcgggagctcgaccgggttaacaaggatgaaatagccaaatgggttttgtcttttcaagttcatcctgaagcacgtggtgatgaggataatgggtcattttatggattctgtggttatagatcaactcaatttcctttgcctaatgtgaaggacccttgccacaacggtagtcatcttgcaagcacatattctggcctcgctatcctgaagattgtaggttacgatctatcaaatattgatagcaatgcacttttatcgtctacgaaaaagctccaacaaccagatggaagcttcacacctattcatattggtgcggaaacggacttgcgctttgtatactgtgcagctgcaatctg

SEQ ID NO: 38192 - protein, 165 aa, Panicum virgatum
  misc_feature: Ceres CLONE 1992802
  misc_feature: SWISSPROT Homolog: EC 2.5.1.59 Protein geranylgeranyltransferase type I
MGRREFARAHHVAFFDARATELPDDYAPQEVNHLTLGYFAVGGLSLLRELDRVNKDEIAKWVLSFQVHPEARGDEDNGSFYGFCGYRSTQFPLPNVKDPCHNGSHLASTYSGLAILKIVGYDLSNIDSNALLSSTKKLQQPDGSFTPIHIGAETDLRFVYCAAAI

SEQ ID NO: 38193 - DNA, 710 bp, Panicum virgatum
  misc_feature: Ceres CLONE 1992803
  misc_feature: Encodes the peptide sequence at SEQ ID NO. 38194
ctctacatggccacgaactgactaccacaccagttgggccggctgctgcccatgagcaccgccatgcctacgtgttccgcctgacttctcctctgcttctctcaagccctaacccatggcgccgccgggcccctccgccggcgtccgcctgctcctcctccgccgcctcctctccacgggtaccgaagcggcggcggaggctgctgctgcgcccgccgccgccgccgccgccaccgccgcgaaggcggggaataagggggactcgctggcgctctaccgccgtctggtggcgctgggccgctccggggaggggagcgtgtcgcgggcgctcaacaagtgggtgcggcagggtggcgcgctgcccgtccaagatctcgtcgagcacgtcaaggagctccgcaagtacaagcgctatggccacgccctcgagcagatggactggatggtcaatgcaaggggcatgaccatgtcacacgctaaccatgcaatacgactagatcttatctataaagtgcgtggcattgaggcagctgaggcttattttgctgatctccctgatccagccaagaaccatcgaacttatggtgcacttcttaattgttattgctcagcaaaaatggaagagaaagcaacagatctctacaacaagatggatgagcttggcatctgttccagtgagctactcttcagtaatctgatgtccatttaca

SEQ ID NO: 38194 - protein, 198 aa, Panicum virgatum
  misc_feature: Ceres CLONE 1992803
  misc_feature (154)..(188): Pfam Name: PPR Pfam Description: PPR repeat
MAPPGPSAGVRLLLLRRLLSTGTEAAAEAAAAPAAAAAATAAKAGNKGDSLALYRRLVALGRSGEGSVSRALNKWVRQGGALPVQDLVEHVKELRKYKRYGHALEQMDWMVNARGMTMSHANHAIRLDLIYKVRGIEAAEAYFADLPDPAKNHRTYGALLNCYCSAKMEEKATDLYNKMDELGICSSELLFSNLMSIY

SEQ ID NO: 38195 - DNA, 568 bp, Panicum virgatum
  misc_feature: Ceres CLONE 1992806-R
  misc_feature: Encodes the peptide sequence at SEQ ID NO. 38196
atatttgatctgcacaatgttatcatatctatacctctgccagcacttcgggaggctccaagtgttagacagatagatggagagtggaagtttgactcaagaaactctgtgttggaatggtctattctccttattgatcagtcgaatcgcagtggttccatggaatttgtcgttcccccagctgatccatcatcatttttccccatctctgttgggttttcagcatctagtactttcagtgatttgaaggttactggaatccatcctctgaaggaaggcaaccctcccaagttttcacagcgggctcgtttgctcactgctaactaccaagtggtttaatgctctgatcaaggtcgagtgttgtttcacttaaaatacttccaacagcacatgatagtgacataatgtattttgccatgaacttctgcgagccatggcagggaggatcactttgcatttggagaatattctttttggtccctttcgtttttagcatgttgcacaaattgatgttctgatgtattgctacccaagaaataagcatgtgtgttcttgcgtttcgattgcc

SEQ ID NO: 38196 - protein, 112 aa, Panicum virgatum
  misc_feature: Ceres CLONE 1992806-R
  misc_feature (1)..(102): Pfam Name: Adap_comp_sub Pfam Description: Adaptor complexes medium subunit family
IFDLHNVIISIPLPALREAPSVRQIDGEWKFDSRNSVLEWSILLIDQSNRSGSMEFVVPPADPSSFFPISVGFSASSTFSDLKVTGIHPLKEGNPPKFSQRARLLTANYQVV

SEQ ID NO: 38197 - DNA, 1322 bp, Panicum virgatum
  misc_feature: Ceres CLONE 1992806
aaaaacgcccaggcagggggaaggggagatctatctattccgttgcccggtggagtcagtcggccaactccagtggatgtggacccgcgttcggatctccacctctccgcggcgacgtctgggcgagcggcgccgcccttccttcgttgggacctttgccggcgaggtgcatagtttgtgggcttggtgattgatcgatcgagtgatcaacaaagcgattgaaaatggtggtccttgcagcttccatcgtttcaaagtcgggaaaagcactagtgtcaagacagtttgttgacatgcctcgcataagaatcgaaggattactcgctgcattcccgaaactggttggaactgggaagcagcacacatatgttgaaacagaaaatgtgcgttatgtttatcaacctattgaaggtttatatcttctacttatcacaaacaagcagagcaacattcttgaagatctggacactttgaggctgctctccaagcttgtacctgaatactccccttccttggatgaggaaggtgtctgtaaaacagcatttgagcttatatttgctttcgatgaagccatatctcttggaaataaggaaaatgttacagtgcaacaagtaaaacaatattgtgagatggagagccatgaagagaaggcacacaagctgatgatgcaagccaaaatcaatgaaaccaaggatgtcatgaaaaagaaggctaatgagcttgacaaaatgaggatggaaagaggtaaacttgacaaaggaggatactcttcaatatctggtccacgtgtgattgaaaaaactttcaatgatatgagcatcagtggttctcgatttggtagtggttctggattaggtggactgagcactgacatggactcatttgctagcaagcccaaaggtcgtccgtctcaacctgctgctgcacctggtaaagggtttggcatgaaattgggcaagacacagaagacaaatcaattcctcgaatcattgaaagctgaaggagaagtcattttggaggatgtacaaccaagtacagttccttcaagatcggctactctcccgccaagtgatcctgtcacagtgactatagaagagaagctcaatgttgttgtcaaaagagatggaggtattaataacttcgatgttcaaggaacccttgctcttcaggttcttaatgatgctgatggtttcatccaattgcagattgaaaaccaagatattcctggacttagcttcaaaacacacccaaatatcaacaaaggagctgtttaacaggtcagcaaattttggggagcaaaaagatcccaacaggcccttccc

SEQ ID NO: 38198 - DNA, 1144 bp, Panicum virgatum
  misc_feature: Ceres CLONE 1992813
  misc_feature: Encodes the peptide sequence at SEQ ID NO. 38199
atattcatctagctttgaaatcacatgcatggatcctgcaatattgctcgaagacttaactaccactttcctttttcttaaacttgacagcttggatttatgctccttgccctcatttggaaatttgatttcccaccattcatggtcctaatcatagcaattctaaatgatggtaccataatgactatatcaaaggatcgtgtaaaaccatccccactacctgacagctggaagctggctgaaattttcacaactggagttgtcctcggtggatatcaggcaatgatgactgttatcttcttttgggctgcatacaagacagactttttcccaagaatatttcatgttgaaagccttgagaagactgctcaagatgatttccagaagcttgcctctgctgtttacctgcaagtcagcaccatcagccaagctctcatcttcgtgacgaggtcccggagctggtcatttgttgagcgaccagggtttctactggtctttgcattcttggttgcgcagctgattgctacgctgattgctgtgtacgctgactgggcattcacttcaatcaaaggcattgggtggggctgggctggtattgtgtggctttacaacatcatcttctacttcccgctcgatatcatcaagttcctcatccgatatgctctgagtgggaaagcatgggatctggtcattgagcaaaggattgcattcacaaggaagaaggactttggcaaggaggagagggagctgaagtgggcacatgcacagaggaccctccatgggctgcagacaccggatgccaagatgttcccagagaaggctgggtacaatgagctgaaccagatggctgaagaggcgaagaggagggctgagattgcaagactgcgggagcttcacacactcaagggacatgtggagtctgttgtgaagctgaaggggctcgacattgagaccatccagcagtcctacacggtttgatatcgcctgtccccagaagaagttttttttttaaaaaaaaatctttctctctttttggccaccgaagtgtgaattttacggtggctggcctctctttgttttatttaactgaatggagtcacatccccagacaagtacttgaaatgagacggaatcgcttgatctc

SEQ ID NO: 38199 - protein, 292 aa, Panicum virgatum
  misc_feature: Ceres CLONE 1992813
  misc_feature: SWISSPROT Homolog: EC 3.6.3.6 Proton-exporting ATPase
MLLALIWKFDFPPFMVLIIAILNDGTIMTISKDRVKPSPLPDSWKLAEIFTTGVVLGGYQAMMTVIFFWAAYKTDFFPRIFHVESLEKTAQDDFQKLASAVYLQVSTISQALIFVTRSRSWSFVERPGFLLVFAFLVAQLIATLIAVYADWAFTSIKGIGWGWAGIVWLYNIIFYFPLDIIKFLIRYALSGKAWDLVIEQRIAFTRKKDFGKEERELKWAHAQRTLHGLQTPDAKMFPEKAGYNELNQMAEEAKRRAEIARLRELHTLKGHVESVVKLKGLDIETIQQSYTV

SEQ ID NO: 38200 - DNA, 690 bp, Panicum virgatum
  misc_feature: Ceres CLONE 1992815
  misc_feature: Encodes the peptide sequence at SEQ ID NO. 38201
atcatcacccaccgccgccgacacagccgccgcccgccggagcaccttgactgcttgagcgtagtttaggagagaggattcgaggagtgatgtcggccgaggaggctgccgctgcggcgaccgaggtccccgtgaccgaggtcgagttcgaggcgccggccgccgaggaggcggaggcgaagcccgccaaggccaagaaggcagcgcccaaggagaagaaggcggccaaggagaagaagcccgccgcggcgaggaagccggccgcccacccgccgtacgccgagatgatctcggaggcgattgcggcgctcaaggagaggaccgggtcgagctcggtggccatcggcaggtacgtggaggagaagcacggcgggcagctgccacccaacttccgcaagctgctggccgggcagctcaagaagctcgccgccgcggggaagctgacccgcgtcaagaactcgttcaagctgccggccgccgccgacgccaagtccaaggcgcccaagcccgccgccgcggccaagtcgaagccagccaaggccgccaagcccgccgtcaagcccaaggcgtccccgaaggcgaagaccaagaccgccgccaagcccaaggcggccgccgcctcccccaagcgcaaggccaaggcccccgccgccgccgcccccgccgcggcgccccagccccgcggccgcc

SEQ ID NO: 38201 - protein, 200 aa, Panicum virgatum
  misc_feature: Ceres CLONE 1992815
  misc_feature (59)..(129): Pfam Name: Linker_histone Pfam Description: linker histone H1 and H5 family
MSAEEAAAAATEVPVTEVEFEAPAAEEAEAKPAKAKKAAPKEKKAAKEKKPAAARKPAAHPPYAEMISEAIAALKERTGSSSVAIGRYVEEKHGGQLPPNFRKLLAGQLKKLAAAGKLTRVKNSFKLPAAADAKSKAPKPAAAAKSKPAKAAKPAVKPKASPKAKTKTAAKPKAAAASPKRKAKAPAAAAPAAAPQPRGR

SEQ ID NO: 38202 - DNA, 689 bp, Panicum virgatum
  misc_feature: Ceres CLONE 1992825
  misc_feature: Encodes the peptide sequence at SEQ ID NO. 38203
aagtatcatctcaggggagttccctgctggctgggctgatgctcttcctaaatacactccagagagtccaggagatgccaccaggaacctctcccagcagtgcttgaacgcacttgctaaagttgtgccgggtcttattggaggtagtgctgatcttgcgtcttccaacatgacactgcttaagatgtttggtgacttccagaaggatacgcctgaggaacgcaatgtccgctttggagtcagggagcacggaatgggcgccatttgcaatggcattgctctgcacagcccagggtttgttccatactgtgctactttctttgtcttcaccgattacatgagaggtgccatgaggatctcagctttgtctgaagctggagttatctatgttatgacccacgactctattggtctcggagaagatggtccgacccatcagcccattgagcacttggtgagtttccgcgcaatgcccaacatattgatgctccgtcctgctgatggtaatgagaccgccggagcatacaaagttgcagttctcaacaggaagaggccatctatcctcgctctctccaggcaaaagcttcctcacctgcctggtacctcaattgagggtgttgcgaaaggtggatatactatctctgacaactcaaccggcaacaagcctgacctcattgtattgagtaccg

SEQ ID NO: 38203 - protein, 229 aa, Panicum virgatum
  misc_feature: Ceres CLONE 1992825
  misc_feature (23)..(198): Pfam Name: Transket_pyr Pfam Description: Transketolase, pyrimidine binding domain
  misc_feature: SWISSPROT Homolog: EC 2.2.1.1 Transketolase
  misc_feature: Useful for making plants with modulated biomass
SIISGEFPAGWADALPKYTPESPGDATRNLSQQCLNALAKVVPGLIGGSADLASSNMTLLKMFGDFQKDTPEERNVRFGVREHGMGAICNGIALHSPGFVPYCATFFVFTDYMRGAMRISALSEAGVIYVMTHDSIGLGEDGPTHQPIEHLVSFRAMPNILMLRPADGNETAGAYKVAVLNRKRPSILALSRQKLPHLPGTSIEGVAKGGYTISDNSTGNKPDLIVLST

SEQ ID NO: 38204 - DNA, 972 bp, Panicum virgatum
  misc_feature: Ceres CLONE 1992843-R
  misc_feature: Encodes the peptide sequence at SEQ ID NO. 38205
gagcgtgcgttgcgaggagatgtggtggaggcggctgggagctctccttctccgatccccgccgtcttcctcctccacagccgcctcttcttgccagcatcgccgccgccacctcctccccagcgaggaacctcttgctgtcaatcgtcttgcacggctcttcacgtcccaagctggaagtgatggtggcaattcccagaagccgttcattgctttcgtcttagggggtcctggtagtggcaaaggaacacaatgcaccaaaattgcttcggatttcggatttgcccatttgagcgctggtgaccttctgcgccatgaaatagcatctggcagtgagaaaggggagttgatcctggacaccattaaggaagggaggatcgtcccatcagagataaccgtggaactcataaggaaagctatggaaacgagcaatgccaataaggttcttattgatggcttcccaaggtgtgaggaaaacagaatcgcttttgaaagaattgttggaagagaaccagatgttgtggttttctttgactgtcctgaggatgagatggtaaaacgccttctaggccgtaaccaggggcgggttgatgataacattgagacaatcaagaagcgtctaaaagtgtttgagagtttgaatattcctgttattgactactattcttctaggggaaaggttcgcaagataaatgccacgggcactgcagatgaaatttttgatgcagtccacaagctcttttcgtccttaaggttctgatgaggatcttccaaggaatcccgggagtttgcttagcaattatctgttatttatttttcttaaagccagtgctcactttgtgccgtctaaatcttttgtgcagtaattgtatatacatgctatgccttcacgaaataatacccagggaaacacatataactttgtgacacatctaacctgaagctcgtcctgcatggcaggcattatttgtt

SEQ ID NO: 38205 - protein, 246 aa, Panicum virgatum
  misc_feature: Ceres CLONE 1992843-R
  misc_feature (67)..(220): Pfam Name: ADK Pfam Description: Adenylate kinase
  misc_feature: SWISSPROT Homolog: EC 2.7.4.3 Adenylate kinase
MWWRRLGALLLRSPPSSSSTAASSCQHRRRHLLPSEEPLAVNRLARLFTSQAGSDGGNSQKPFIAFVLGGPGSGKGTQCTKIASDFGFAHLSAGDLLRHEIASGSEKGELILDTIKEGRIVPSEITVELIRKAMETSNANKVLIDGFPRCEENRIAFERIVGREPDVVVFFDCPEDEMVKRLLGRNQGRVDDNIETIKKRLKVFESLNIPVIDYYSSRGKVRKINATGTADEIFDAVHKLFSSLRF

SEQ ID NO: 38206 - DNA, 468 bp, Panicum virgatum
  misc_feature: Ceres CLONE 1992843
ctaattccccatttgtccttccacaaccaccagccgccatcccctggccgccggcgcacgctgcacgcgcgcaggcagcagccaggcaagccgccccctctctcctctctggcaagccgacccgtcgcaacgccggcaagccacctcctccccctcttcggcaagcccctccccttcctgttgcccactctcctggcagacagcagggcaccacgtcatagggaaatagatagacagagaaaagaagagaaacgaaacgagaaaaagaggggaggagccggaggaggaaacgaggaaggaggagacggcagccagcgagcgaaagccggaaggggaagagctccactagagcgtgcgttgcgaggagatgtggtggaggtctttggcttccggctttcgctcgctggctgccgtctcctccttcctcgtttcctcctccggctcctctcctctttttctcgtcctccc

SEQ ID NO: 38207 - DNA, 709 bp, Panicum virgatum
  misc_feature: Ceres CLONE 1992844
  misc_feature: Encodes the peptide sequence at SEQ ID NO. 38208
aacaaagataagacagatgaagaaaagagtgaaatggcggagaagaagggccagtatgccaagttctggaacgagtttggcaaatcaatcaagctgggtatcattgaggatgcgactaacaggaacagacttgctaagcttcttagatttgaaagtaccaagtcggatggcaagcttgcatctcttgacgagtacatttcaaggatgaagccaggacagaaagacatcttttacatcaccggaagcagcaaagaacagctggagaagtctccgttcttggagaggctaaccaagaagaactacgaggtcatcttcttcactgaccctgtggacgagtacctgatgcaatacctgatggactacgaggacaagaagttccagaacgtgtccaaggagggtctgaagctgggcaaggactcgaagctcaaggacctcaaggagtcgttcaaggagctgacagactggtggaagaaggccctggagagcgagaatgtggtctcggtgaagatcagcaaccggctgcacgacaccccctgcgttgttgtcacctccaagtacgggtggagcgccaacatggagaagatcatgcaggcgcagaccctctcggactcgagcaagcaggcctacatgcgcggcaagcgggtgctcgagatcaaccccaggcaccccatcatcaaggagctccgcgacaaggtggcccaggacaacg

SEQ ID NO: 38208 - protein, 236 aa, Panicum virgatum
  misc_feature: Ceres CLONE 1992844
  misc_feature (1)..(236): Pfam Name: HSP90 Pfam Description: Hsp90 protein
NKDKTDEEKSEMAEKKGQYAKFWNEFGKSIKLGIIEDATNRNRLAKLLRFESTKSDGKLASLDEYISRMKPGQKDIFYITGSSKEQLEKSPFLERLTKKNYEVIFFTDPVDEYLMQYLMDYEDKKFQNVSKEGLKLGKDSKLKDLKESFKELTDWWKKALESENVVSVKISNRLHDTPCVVVTSKYGWSANMEKIMQAQTLSDSSKQAYMRGKRVLEINPRHPIIKELRDKVAQDN

SEQ ID NO: 38209 - DNA, 504 bp, Panicum virgatum
  misc_feature: Ceres CLONE 1992862
  misc_feature: Encodes the peptide sequence at SEQ ID NO. 38210
acagcataaacgccgccgcccacacaaaagtcgtcgagtctgtgaacgacggacaccctgacaagctctgcgatcaggtctcagatgctgtgctcgatgcttgccttgctgaggaccccgacagcaacgttgcttgcgagacctgcacccagactaacatggtcatggtctttggtgagatcaccaccaaggccaatgtcaactacgagaagattgtcacggagacttgccgcaccattggtttcgtgtctcctcatgcccggcttgatgctgaccactgcaaggtgctcgtgaacattgagcagcagtcccctgatattgctcacggtgtgcatggccacttcacaaagcgccctgaggagattggagctggtgaccacggacacatgtttgggtatgctcctgatgaaacccctcacctgatgcccctcagccatgtccttgccaccaagcttggtggtcgtctcactgaggtgctcaagaaccggacctgccccctggctc

SEQ ID NO: 38210 - protein, 167 aa, Panicum virgatum
  misc_feature: Ceres CLONE 1992862
  misc_feature (5)..(104): Pfam Name: S-AdoMet_synt_N Pfam Description: S-adenosylmethionine synthetase, N-terminal domain
  misc_feature (119)..(167): Pfam Name: S-AdoMet_synt_M Pfam Description: S-adenosylmethionine synthetase, central domain
  misc_feature: SWISSPROT Homolog: EC 2.5.1.6 Methionine adenosyltransferase
SINAAAHTKVVESVNDGHPDKLCDQVSDAVLDACLAEDPDSNVACETCTQTNMVMVFGEITTKANVNYEKIVTETCRTIGFVSPHARLDADHCKVLVNIEQQSPDIAHGVHGHFTKRPEEIGAGDHGHMFGYAPDETPHLMPLSHVLATKLGGRLTEVLKNRTCPLA

SEQ ID NO: 38211 - DNA, 745 bp, Panicum virgatum
  misc_feature: Ceres CLONE 1992898
  misc_feature: Encodes the peptide sequence at SEQ ID NO. 38212
accgaagcacacgtctccactccagctagtccggcgcagggtctccctctgttccgccgctgttgttcgaccaggccaccggcggcggcgcgcccatagtatccggcaatgtcggcgcaggcggggacagggacgtactccccagcggctgccgcggggggcaagcggcgggagaagagggaggagctgcggcgccacctcgccgaggatgccaactggccccgcgccgacggacgctccttccacgactgccggccagcgtttatgcaaacagggccaactacggctgcatcaggatctgcttatgcggaatttgggaagacaaaggtcattgtatcagtgtttgggccaagagaaagtaagaaagcaatgctgtacagtgatgtcggtaggctcaattgcaacgtgagctatacaacatttgccactccagtgcgtggacagggagcagacaacaaagagtactcatcaatgcttcataaagctttggaaggcgcagtaatgctacacacttttccaaagaccactgttgatgtttttgccttggttcttgagtctggtggcagtgatctacccatcattatatcatgtgctagtcttgcactggcagatgctggaatcatgatgtatgaccttgttacatctgtatccgtgtcttgttttggaaagaacatcatcatcgatccaacctcagatgaggaagcatggcaagatggaagcctcgtggtagctttcatgccagccc

SEQ ID NO: 38212 - protein, 212 aa, Panicum virgatum
  misc_feature: Ceres CLONE 1992898
  misc_feature (47)..(172): Pfam Name: RNase_PH Pfam Description: 3' exoribonuclease family, domain 1
  misc_feature: SWISSPROT Homolog: EC 2.7.7.56 tRNA nucleotidyltransferase
MSAQAGTGTYSPAAAAGGKRREKREELRRHLAEDANWPRADGRSFHDCRPAFMQTGPTTAASGSAYAEFGKTKVIVSVFGPRESKKAMLYSDVGRLNCNVSYTTFATPVRGQGADNKEYSSMLHKALEGAVMLHTFPKTTVDVFALVLESGGSDLPIIISCASLALADAGIMMYDLVTSVSVSCFGKNIIIDPTSDEEAWQDGSLVVAFMPA

SEQ ID NO: 38213 - DNA, 726 bp, Panicum virgatum
  misc_feature: Ceres CLONE 1992908
  misc_feature: Encodes the peptide sequence at SEQ ID NO. 38214
agaaagggaccgaagccaaatcgaatccctggtgcccctccccttcctcgccccgcacgccgccgcctccgccgtgaggactccggcgaatggcgtcccgcgtcgcctcgggcctcctccgccgccgcgccggcgcgacactaggcctcttaaggagttatacacgtgtcagaaactacagcagccaactttcagctttgattccagctacgtcccagtgctcgaagctgacaagaagacgttattacatgccgaatgcctctccgtaccaagtatggagtcggtcatttgcttcagacaatggagacaaggttgaggctgttgtgcccttcatgggtgaatctgtaactgatggaacccttgctaactttttgaagaaacccggtgagagagtcgaagctgatgaggctatagcacagatcgaaactgataaggttactatagatgttgctagtcctgaagctggtgttattgaaaagttcattgctagtgaaggtgatacagttactccaggcaccaaaattgcaatcatatcaaagtctgctcaacctgctgaaacacatgttgctccatccgaggaatcaactccaaaagaaccctctccgccaaaagttgaagagaaaccaaaagtagtgacagcaccaaaggtagaacctccgaagacacaagcacctaagcctactgcaccatcaaaaacgtccccctcagaaccacagctccctccaa

SEQ ID NO: 38214 - protein, 212 aa, Panicum virgatum
  misc_feature: Ceres CLONE 1992908
  misc_feature (75)..(148): Pfam Name: Biotin_lipoyl Pfam Description: Biotin-requiring enzyme
  misc_feature: SWISSPROT Homolog: EC 2.3.1.61 Dihydrolipoyllysine-residue succinyltransferase
MASRVASGLLRRRAGATLGLLRSYTRVRNYSSQLSALIPATSQCSKLTRRRYYMPNASPYQVWSRSFASDNGDKVEAVVPFMGESVTDGTLANFLKKPGERVEADEAIAQIETDKVTIDVASPEAGVIEKFIASEGDTVTPGTKIAIISKSAQPAETHVAPSEESTPKEPSPPKVEEKPKVVTAPKVEPPKTQAPKPTAPSKTSPSEPQLPP

SEQ ID NO: 38215 - DNA, 745 bp, Panicum virgatum
  misc_feature: Ceres CLONE 1992932
  misc_feature: Encodes the peptide sequence at SEQ ID NO. 38216
catgtctgcccaacccactttatagagggccctccattgaaaacaatatcaaacattggcggtttgcaccgtatgctgggtttgcctgatcacattcttgtagccgcggcaggtgattctatcgagagtctgccatcaagtgaagccaccaataaattcggtgcctcctttgatacaccttctggccgtagactggtcaaaccatcagattatatggagttggtttcctgcatgaagcctaatgtatgggccagtttggcggatgaggtgcctgcttgggtaactgagaaacggaacaaaatctctgttgacaggacattgcggtggcttgatgcatgcattgctttggatacagcttccggagaaaatagttttggtgttgttgtaggaggatcaagcatagaacaacgaaggctatgtgccacagaagtatcaaagcggaatgtttcaggcttttggattggcggatttggccttggagagaataccgaagaacgctgcagtttactcaatgcagtaactgattgcttgccaccagaaaaacctcggcttgtgtctaggcttggtctcccaggtgccagtgatgtaacttgtattgtagcattgaattttcttatataatttccagaggatcatgaccagaatttttgctttgttttatttattatctcattagtgactttgtacatttagcctcatccccattcacaaatcaaaagctagagttgtgctgatagacttatgg

SEQ ID NO: 38216 - protein, 206 aa, Panicum virgatum
  misc_feature: Ceres CLONE 1992932
  misc_feature: SWISSPROT Homolog: EC 2.4.2.29 Queuine tRNA-ribosyltransferase
HVCPTHFIEGPPLKTISNIGGLHRMLGLPDHILVAAAGDSIESLPSSEATNKFGASFDTPSGRRLVKPSDYMELVSCMKPNVWASLADEVPAWVTEKRNKISVDRTLRWLDACIALDTASGENSFGVVVGGSSIEQRRLCATEVSKRNVSGFWIGGFGLGENTEERCSLLNAVTDCLPPEKPRLVSRLGLPGASDVTCIVALNFLI

SEQ ID NO: 38217 - DNA, 698 bp, Panicum virgatum
  misc_feature: Ceres CLONE 1992940
  misc_feature: Encodes the peptide sequence at SEQ ID NO. 38218
ctcttcctccttcctcaccccctttctcacctcagcctcagcgagaaccttccaaagcttcccgagaggttccctcgccagtccgacccttcgggaagcgctcgcgcgcgccgcgcccgaccccgagctcgccggagtcatggagaagtacgagctgctcaaggacatcggcgccgggaacttcggcgtggcgcggctgatgcggaacaaggagaccaaggagctcgtcgccatgaagtacatcccccgcggccaaaagattgacgagaatgtggcgagggagatcatcaaccaccgctcgctgcggcaccccaacatcatcaggttcaaggaggtggtgctcacgccgacgcatctggcgatcgtgatggagtacgccgccggcggcgagctgttcgaccggatctgcaacgccggcaggttcagcgaagacgaggcgaggtacttcttccagcagctgatttgcggcgtgagctactgccacttcatgcaaatttgccatcgcgacctgaagctggagaacacgctgctggacggcagcccggcgccccgcctcaagatctgcgacttcggttactccaagtcgtcgctgctgcactcgaagcccaagtcgacggtgggcacgccggcgtacatcgccccggaggtgctctcccgccgggaatacgacggcaagacagccgacgtctggtcctgtg

SEQ ID NO: 38218 - protein, 186 aa, Panicum virgatum
  misc_feature: Ceres CLONE 1992940
  misc_feature (4)..(186): Pfam Name: Pkinase Pfam Description: Protein kinase domain
  misc_feature: SWISSPROT Homolog: EC 2.7.11.1 Non-specific serine/threonine protein kinase
  misc_feature: Useful for biocontainment applications
  misc_feature: Useful for making plants with modulated biomass
  misc_feature: Useful for making plants with modulated time to senescence
  misc_feature: Useful for making plants with modulated water use efficiency
MEKYELLKDIGAGNFGVARLMRNKETKELVAMKYIPRGQKIDENVAREIINHRSLRHPNIIRFKEVVLTPTHLAIVMEYAAGGELFDRICNAGRFSEDEARYFFQQLICGVSYCHFMQICHRDLKLENTLLDGSPAPRLKICDFGYSKSSLLHSKPKSTVGTPAYIAPEVLSRREYDGKTADVWSC

SEQ ID NO: 38219 - DNA, 723 bp, Panicum virgatum
  misc_feature: Ceres CLONE 1992945
  misc_feature: Encodes the peptide sequence at SEQ ID NO. 38220
gaatccaaactccaaagcgcttcggaccttcggttcttcttcccacctcgcaaccaaatcattcctccccgaataatccgatcagcttcttcctgggtgtagggaggatggcgaccaagaggagcgtgggcaccctgtcggaggcggatctgaaggggaagaaggttttcctccgcgccgacctcaacgtgccgctggacgacagccagaagatcaccgacgacacccgcatccgcgcgtccgtgcccaccatcaagttcctgatggagaagggcgccaaggtcatcctggccagccatctgggacgtccaaaaggtgtcactcccaagtacagcttgaagcctcttgtcccactcttgtctgagctccttggagttaatgttgttatggccaatgactgcattggtgaggaagttcagaagttggctgcttctttaccagatggaggtgttctgcttttagaaaacgttaggttctacaaggaggaagagaagaacgaccctgagtttgccaagaagctggcatctgttgctgatctctatgtaaatgatgcctttggcactgcacacagagcccatgcttcaacagagggagttaccaagtatttgaagcctgctgttgctggcttcctcatgcagaaggaacttgactatcttgttggcgctgttgccaacccgaagaagccgtttgctgcaattgttggtggatcaaaggtgtcgacga

SEQ ID NO: 38220 - protein, 205 aa, Panicum virgatum
  misc_feature: Ceres CLONE 1992945
  misc_feature (3)..(205): Pfam Name: PGK Pfam Description: Phosphoglycerate kinase
  misc_feature: SWISSPROT Homolog: EC 2.7.2.3 Phosphoglycerate kinase
MATKRSVGTLSEADLKGKKVFLRADLNVPLDDSQKITDDTRIRASVPTIKFLMEKGAKVILASHLGRPKGVTPKYSLKPLVPLLSELLGVNVVMANDCIGEEVQKLAASLPDGGVLLLENVRFYKEEEKNDPEFAKKLASVADLYVNDAFGTAHRAHASTEGVTKYLKPAVAGFLMQKELDYLVGAVANPKKPFAAIVGGSKVST

SEQ ID NO: 38221 - DNA, 755 bp, Panicum virgatum
  misc_feature: Ceres CLONE 1992950
  misc_feature: Encodes the peptide sequence at SEQ ID NO. 38222
aaaccaccagccaatcccaaaaaaccttcttttcaaaaaaaaaaaaactcacgagcagcaagaacgcccgccggcactcgccgccgatgggggtggactactacaaggtgctcggcgtcggccgcagcgccaccgacgacgagctcaagaagtcctaccgccgcctcgccatgaagtaccacccagacaagaacccctcgccgcaggctgattccctcttcaaggaggtctccgaagcctacgacgtgctcagcgacccgcagaagcgcgccatctacgaccagttcggggaggacggcctcaaggccggcacgcccccaccctccgcctccacgcacggcgccggcgcccacgggttccgcttcaacccgaggagcgccgaggagatcttctcggagatattcggcggcgcgttccccggggcgggtccccgaaccccaggcggaggcgttccccccgggttcccggggttcggcggcaccgctgggccaggggaggcgtctagcgcggggttgcagaggaaggcgccgccgatcgagcggcagctggcttgcagtctggaggacctgtacaagggcgccactaagaagatgaagatctccagggatgtccttgacgccaccgggaaaccaacaaacgttgaggagatcctgacgattgatatcaaacctggatggaagaagggcacaaaaatcacatttcctgagaaaggcaacgagatgcgcaatgttgtaccatcagatctagtggtcatt

SEQ ID NO: 38222 - protein, 222 aa, Panicum virgatum
  misc_feature: Ceres CLONE 1992950
  misc_feature (4)..(65): Pfam Name: DnaJ Pfam Description: DnaJ domain
MGVDYYKVLGVGRSATDDELKKSYRRLAMKYHPDKNPSPQADSLFKEVSEAYDVLSDPQKRAIYDQFGEDGLKAGTPPPSASTHGAGAHGFRFNPRSAEEIFSEIFGGAFPGAGPRTPGGGVPPGFPGFGGTAGPGEASSAGLQRKAPPIERQLACSLEDLYKGATKKMKISRDVLDATGKPTNVEEILTIDIKPGWKKGTKITFPEKGNEMRNVVPSDLVV

SEQ ID NO: 38223 - DNA, 1132 bp, Panicum virgatum
  misc_feature: Ceres CLONE 1992959
  misc_feature: Encodes the peptide sequence at SEQ ID NO. 38224
gtcacactgagctctattgcagcgcgttggttgcgtgcgcggagcctctcacagctcacaagccgatccgccgagatcaccaagagtacaccatgcacgccatgcagagggttgtgcttctcctcttggtgttctctttagccatcacggcgtctgcacaggccccgacggcggcgccaaccacgccgacgccgacccctgctgcgccggcgcccgcggccgagacgacgaacatcacgggcgtgctggccaaggccgggcagttcaacacattcatccggctgcttcggacgacgggcgtgtcgcagcagatcgacaaccagctcaacagctccggcaacgggctgacgatcttcgcgccgaccgacaacgccttcacgtcgctcccctccggcacgctcaactcgctgtcggaccagcagaagaacgcgctggtccagttccacgtcctgtccacgctgatccccatgtcgcagttcgacaccgtcagcaacccgctccggacgcaggccggcaacaactcgccggggcagtacccgctcaacatcaccgccgagggccagcaggtgaacatctccacgggggtcgtcaacgccaccgtggacaactcgctctactccggcgacacctcgtggtctaccaggtgaacaaggtgctgctgcctgccgcgctcttcgggccggcgaccgcaccggcccccgcgccgctcgcgccgctcaagaagaaggggaagacgccggcgtccgtcgcggacgcgcccgacggcgccaacgacgcgtccccggacgcgaccgcgtcgcttgcggcggcgagggtgacggggcgtggcgtcgcggccgtgctcgcgttggccggcgtgtggtggggactttgatccaggcggtgcttcgcgttgtgctgtgccgggcctgcccgcattgtccctagtccgcagtccgcacctcatgccatcattttgttcacttttcagaggtgttgtcagtcttttttttttaatttttcgttgttcatttggccattttggcctttttctttcttcacccccattgtaattgctagaactgaatcgatattgttggcgtcccattttgatgtgttggtactaaataaatatatgagttgtgtatattgc

SEQ ID NO: 38224 - protein, 181 aa, Panicum virgatum
  misc_feature: Ceres CLONE 1992959
  misc_feature (54)..(173): Pfam Name: Fasciclin Pfam Description: Fasciclin domain
  misc_feature: Useful for making plants with altered carbohydrate content
  misc_feature: Useful for making plants with altered cell wall content and/or composition
MQRVVLLLLVFSLAITASAQAPTAAPTTPTPTPAAPAPAAETTNITGVLAKAGQFNTFIRLLRTTGVSQQIDNQLNSSGNGLTIFAPTDNAFTSLPSGTLNSLSDQQKNALVQFHVLSTLIPMSQFDTVSNPLRTQAGNNSPGQYPLNITAEGQQVNISTGVVNATVDNSLYSGDTSWSTR

SEQ ID NO: 38225 - DNA, 736 bp, Panicum virgatum
  misc_feature: Ceres CLONE 1992970
  misc_feature: Encodes the peptide sequence at SEQ ID NO. 38226
actccagatccgcccgccaccgcaatccaccacgcccagccccaaatccgccgcaagagcgagaggaccgggcccgcgcgatggcgacgctccagcaccagccgaagccggcggcggcgccgtcgacgaccacgggcggcgggctgcgcgccatggacctgtacgagaagctggagaaggtgggcgagggcacgtacgggaaggtgtacaaggcccgggagaaggcgacgggccggatcgtggcgctcaagaagacgcggctccccgaggacgacgagggcgtgccccccaccgcgctgcgggaggtctcgctgctgcggatgctgtcgcgggacccgcacgtggtgcgcctgctcgacctcaagcagggcgtcaacaaggagggccagaccatcctctacctcgtcttcgagtacatggacaccgacctcaagaagttcatccgggggcaccgcgccaaccacgagaagatccccgcgctcaccgtcaagatcctgatgtaccagctgtgcaagggcgtggccttcgtccacggccgcggggtgctgcaccgcgacctcaagccgcacaacctgctcatggaccgcaagaccatggcgctcaagatcgccgacctcggcctcagccgcgccatcaccgtccctctcaagaagtatacccatgagatcctgacgctgtggtacagggcacccgaggttctgcttgggcgcacgcactacgccacgccggttgacat

SEQ ID NO: 38226 - protein, 218 aa, Panicum virgatum
  misc_feature: Ceres CLONE 1992970
  misc_feature (28)..(218): Pfam Name: Pkinase Pfam Description: Protein kinase domain
  misc_feature: SWISSPROT Homolog: EC 2.7.11.22 Cyclin-dependent kinase
  misc_feature: Useful for making plants with modulated nitrogen use efficiency
  misc_feature: Useful for making plants with modulated growth rate
MATLQHQPKPAAAPSTTTGGGLRAMDLYEKLEKVGEGTYGKVYKAREKATGRIVALKKTRLPEDDEGVPPTALREVSLLRMLSRDPHVVRLLDLKQGVNKEGQTILYLVFEYMDTDLKKFIRGHRANHEKIPALTVKILMYQLCKGVAFVHGRGVLHRDLKPHNLLMDRKTMALKIADLGLSRAITVPLKKYTHEILTLWYRAPEVLLGRTHYATPVD

SEQ ID NO: 38227 - DNA, 686 bp, Panicum virgatum
  misc_feature: Ceres CLONE 1992973
  misc_feature: Encodes the peptide sequence at SEQ ID NO. 38228
attccccatccttccagaggagagagagagaagaaaagataagctcagctcaggctcaggctcaggctcaggctcagctcgcaagcaagtggagatgcggagcccacgaggaccagcagcagccgggcgctgcggcgcccaggagcacgtcgacctgatcccgggcatccccgacgacgtcgccgtcgactgcctggcgcgcgttccccacgcgtcccaccgcgcgctccgccgcgtctgccgcggctggcgcagcgccgccgccgcgccggcctttgcctcggcgcgcgccgccgcgggcgccaccgaggacctcgtctacctcctgcagttcggcaacccctccgccgccgccgacgacgacggggcgcctaaggacggtgccgacgcgccgccgcccagcgcgccggcctacggcgtcgccgtctacaacgtgaccacgggcgagtggcgccgggagcgcggcgcgccgcccgtgctccccgtcttcgcgcagtgcgccgcggttggcacccgcgtggccgtgctcggcggctgggacccgcgcaccttcgagcccgtcgccgacgtgcacgtcctcgacgccgccaccggcgcgtggcgccgcgccgcgccgatgcggtccgcgcggtccttcttcgcgtgcgccgaggccggcggcaagatctacgtcgccggcgggcacg

SEQ ID NO: 38228 - protein, 197 aa, Panicum virgatum
  misc_feature: Ceres CLONE 1992973
  misc_feature (20)..(67): Pfam Name: F-box Pfam Description: F-box domain
MRSPRGPAAAGRCGAQEHVDLIPGIPDDVAVDCLARVPHASHRALRRVCRGWRSAAAAPAFASARAAAGATEDLVYLLQFGNPSAAADDDGAPKDGADAPPPSAPAYGVAVYNVTTGEWRRERGAPPVLPVFAQCAAVGTRVAVLGGWDPRTFEPVADVHVLDAATGAWRRAAPMRSARSFFACAEAGGKIYVAGGH

SEQ ID NO: 38229 - DNA, 1384 bp, Panicum virgatum
  misc_feature: Ceres CLONE 1992975
  misc_feature: Encodes the peptide sequence at SEQ ID NO. 38230
accgattcacttcgccactcccaagtcacacactcgccacacgagcccatggccttggcgacgccgctccgccacctcctccccgtggcggcggcgccgtccacggcccccgaccccgccgggccctccctgaccacccgccgcgccctctcgccccgccggacccacctccgcttcagcctcgccgcgtccccgtcccccgaccccaggcccaggcccaggcccaggtccgccgtgacggcggcggcgtccgcggcggccgggcggccgacggtgcttgtcacggagaagctgggccccgccgggctggacctgctgcgcgcgttcgcgaacgtggactgctcctacgagctcacggcggaggagctccgcgccaaggtctcgctcgtcgacgcgctggtggtgcgcagcgggacgcgcgtcacgcgtgaggtgttcgaggccgcgcgcggcaggctccgggtcgtcggccgcgccggcgtcgggatcgacaacgtcgacctccaggcggccaccgaggccgggtgcctcgtcgtcaacgcgcccaccgccaacacggtcgccgccgccgagcacgccgtcgcgctcctcgccgccatggcgcgcaatgtcgcccaggccgacgcgtcgctcaaggccggcaaatggcaacggagcaaatatgttggtgttaccttggtggggaaggtactagcagttatgggctttggaaaggtaggctcggaagtagctcgacgcgcaaaaggactcgggatggatatcattgctcatgacccatatgccccagttgatagagcccgggcaattggtgtagatcttgtatcatttgacgaggccatttctacatcagacttcatatcactgcatatgcctttaactccatccacggcaaagattttcaatgatgaaacttttgcaaaaatgagaaagggtgttagaattatcaatgttgcaaggggtggagttgttgatgaagatgcattgctgagagcacttgacaatggaacagttgcccaggctgcacttgatgtatttactgaggagccaccaccgagagacagcaagttggtgcagcatgaaaatgtcaccgtcacaccgcaccttggagctagcacaacagaagcgcaggtttactagtcttttcctagaaaaattatttatcctcttcactgaaagaactcttgtactgcacctctacaggaaggtgtagcccttgaaattgcagaggctgttattggtgcactgagaggagatctggctgccacagctgtgaatgccccaatggtccctgctgaggttttatcagagctgtctccctacgttgtccttgctgagaagctgggccgacttgttgtgcaacttgtagctggtgggagtggggtta

SEQ ID NO: 38230 - protein, 362 aa, Panicum virgatum
  misc_feature: Ceres CLONE 1992975
  misc_feature (178)..(353): Pfam Name: 2-Hacid_dh_C Pfam Description: D-isomer specific 2-hydroxyacid dehydrogenase, NAD binding domain
  misc_feature (76)..(339): Pfam Name: 2-Hacid_dh Pfam Description: D-isomer specific 2-hydroxyacid dehydrogenase, catalytic domain
  misc_feature: SWISSPROT Homolog: EC 1.1.1.95 Phosphoglycerate dehydrogenase
MALATPLRHLLPVAAAPSTAPDPAGPSLTTRRALSPRRTHLRFSLAASPSPDPRPRPRPRSAVTAAASAAAGRPTVLVTEKLGPAGLDLLRAFANVDCSYELTAEELRAKVSLVDALVVRSGTRVTREVFEAARGRLRVVGRAGVGIDNVDLQAATEAGCLVVNAPTANTVAAAEHAVALLAAMARNVAQADASLKAGKWQRSKYVGVTLVGKVLAVMGFGKVGSEVARRAKGLGMDIIAHDPYAPVDRARAIGVDLVSFDEAISTSDFISLHMPLTPSTAKIFNDETFAKMRKGVRIINVARGGVVDEDALLRALDNGTVAQAALDVFTEEPPPRDSKLVQHENVTVTPHLGASTTEAQVY

SEQ ID NO: 38231 - DNA, 677 bp, Panicum virgatum
  misc_feature: Ceres CLONE 1992975-R
  misc_feature: Encodes the peptide sequence at SEQ ID NO. 38232
caaaggcatcattgaacctattccaagtgcgttcatcaatattgtcaatgcggactatgtcgccaggcaaagaggccttcagatcatcgaggagagaattctcctttacggttcacctgaaatccccctagactccatccaagtccacctcaccaatgtggagtccaagtttgctggtgccttgtctgatgaaggtgacatcagagttgaaggcaaggttaaggatggctccgcgcatctcacgcttgtcgggtctttcagtgttgacgttagccttgagggcaacctgatactgtgctgccaaattgatcaggcaggtatcattgggaaggtgggatcgatcttgggacagatgaatgtgaatgtgagtttcatgagcgttggaaggactgctcctggaaagcaggcgataatggccattggggttgatgaggagcccgagaaggaagctctcaagctgattggtgacataccgtgtgtcgaggagtttgtctttcttaagctttagagaggaagtaaccgagtaggtaggtaccttagataacatttgtgctatgttagcacgatattgattttttcaagctgctaggagctagttttggggtactgtacaatgacattctttgtatgtgtcaagaagtgcatgtaaaaatgcaatttttcctcttgggcgtgcc

SEQ ID NO: 38232 - protein, 168 aa, Panicum virgatum
  misc_feature: Ceres CLONE 1992975-R
  misc_feature (94)..(159): Pfam Name: ACT Pfam Description: ACT domain
  misc_feature: SWISSPROT Homolog: EC 1.1.1.95 Phosphoglycerate dehydrogenase
KGIIEPIPSAFINIVNADYVARQRGLQIIEERILLYGSPEIPLDSIQVHLTNVESKFAGALSDEGDIRVEGKVKDGSAHLTLVGSFSVDVSLEGNLILCCQIDQAGIIGKVGSILGQMNVNVSFMSVGRTAPGKQAIMAIGVDEEPEKEALKLIGDIPCVEEFVFLKL

SEQ ID NO: 38233 - DNA, 1422 bp, Panicum virgatum
  misc_feature: Ceres CLONE 1992977
  misc_feature: Encodes the peptide sequence at SEQ ID NO. 38234
atcgatgctgagcgcagccaaatccagccatcagccacaggaatatcaccaggaattccccgtccgtctccctctctctcctcccgcgctacctcctcgtcctcgctacggagtacggacccacccgccgcttcctccgacgctcctgccggcggcggcgggggcggctggccgcgtagagccgccgtgaggaggagcgtgcgcggcctggttctgtggttgtcttgtcggatcttccttcattctcgtgcggcgcggcggcgggtccggggcgcgtgcgcgtctagccggcccgggagatggaccgcgacgagcgcctccgccgcgcgctcgctgccttcgggggcgacgcgtgggcgctggtggacgccgcgctggccgcggccgcgcgggaccgcccgggcgagctgcgcgcgcgccgcgatgccatcgtcgagcggctctacgccgccgccgccggctgcagcagctgtgacgagcgcccgccgccgccgcgcgccgctttggcggcggcggggctggatgaggaggcggctgctccggcctctcctgtggccgaggctgacgcagcggaagccggtgccgcggaggaggccgaggagctcggcgccggcgccggcggcgagcccgggctggagagcaggatcgtggccatcagggacttcttggaggaccccgaccagcccgaggacgagctggcgagcttgctgcagaacctggcagacatggacgtcacctacaaggcgctgcaggagactgacatcggtcggcgtgtgaatggtctgcgcaagcacccctcggatgaagtcaggagactggtgaagcagctcatcaggaagtggaaggagatagtggacgaatgggtgcgcctgcacaattccggcgttgacggtggctcctcgatcatagctgatggctactccccggagaaaatccaaggcaggagccatcgaagccctcgggtttcagggtttcagtattctcccagcccgcagcgacatgatggctctactacagagaagactaacaacggacttgagccaacaatggatatgaagcgcaggcccagcccggtacccacacatcataactccaggcagatgaacaacaaccatcattctactactatgtcatctgctccagctaaagtgacaagggaccataaggacagtctcctggaccttgataggcttgattctgcaagaaagaggctccaggagaattatcaggaagaacaaaatgccaaaaagcagaggacaatccaagtgatggacatcaatgagataccaaagccgaagaacagaaatgctctcatccgcaagagcggcatcggcgggctcccggcaaggcaccaataacctacctagccttcaccggctcgacattgcgtcagttgcaaacttgtgccctaaaactatgacg

SEQ ID NO: 38234 - protein, 352 aa, Panicum virgatum
  misc_feature: Ceres CLONE 1992977
  misc_feature (109)..(195): Pfam Name: TFIIS Pfam Description: Transcription elongation factor S-II protein N terminal
MDRDERLRRALAAFGGDAWALVDAALAAAARDRPGELRARRDAIVERLYAAAAGCSSCDERPPPPRAALAAAGLDEEAAAPASPVAEADAAEAGAAEEAEELGAGAGGEPGLESRIVAIRDFLEDPDQPEDELASLLQNLADMDVTYKALQETDIGRRVNGLRKHPSDEVRRLVKQLIRKWKEIVDEWVRLHNSGVDGGSSIIADGYSPEKIQGRSHRSPRVSGFQYSPSPQRHDGSTTEKTNNGLEPTMDMKRRPSPVPTHHNSRQMNNNHHSTTMSSAPAKVTRDHKDSLLDLDRLDSARKRLQENYQEEQNAKKQRTIQVMDINEIPKPKNRNALIRKSGIGGLPARHQ

SEQ ID NO: 38235 - DNA, 653 bp, Panicum virgatum
  misc_feature: Ceres CLONE 1992982
  misc_feature: Encodes the peptide sequence at SEQ ID NO. 38236
atccgtctacgcaaaagttcgaagataccaagcaccggacgaatacccctttttcccggttgtcaaatccatcgaaccgattttaaaaccgttggcttatccgaaattgttacatccgaatgatgttaatataaatcccaggattaaggaggtttacgttaatagtattttgccggcgatatgtcgtcgtagtgcggtagagcaggaggaggaggataaggaggatagtaaatccggggatagaggcgaacagatggagaattatgggtcgacggctgtagccgatgtggcggttttgcaagcgttatcgagaagaatacactttgggaagtttgtcgccgaagcgaagtttttggatgatactgaggggtttacgaagttgatcaaggagaggaattcggaggaaattgggaataggattacgaagaagaaagttgaagaggaggttttgaggaggttgaggtataaggctaagatctatgggagggatccgactctaaaacctggtgaaggagggttggatgatgatgttggagttaagaagattgatgttgaagctgtggttaggatgtatagggacttcgtgattcctctaacaaaagacgttgaaatagattaccttctaacacgactagaaactccccaaaccaatg

SEQ ID NO: 38236 - protein, 217 aa, Panicum virgatum
  misc_feature: Ceres CLONE 1992982
  misc_feature: SWISSPROT Homolog: EC 5.4.99.5 Chorismate mutase
SVYAKVRRYQAPDEYPFFPVVKSIEPILKPLAYPKLLHPNDVNINPRIKEVYVNSILPAICRRSAVEQEEEDKEDSKSGDRGEQMENYGSTAVADVAVLQALSRRIHFGKFVAEAKFLDDTEGFTKLIKERNSEEIGNRITKKKVEEEVLRRLRYKAKIYGRDPTLKPGEGGLDDDVGVKKIDVEAVVRMYRDFVIPLTKDVEIDYLLTRLETPQTN

SEQ ID NO: 38237 - DNA, 1489 bp, Panicum virgatum
  misc_feature: Ceres CLONE 1993004
  misc_feature: Encodes the peptide sequence at SEQ ID NO. 38238
aaaaattcgaatccagaattccccaagattttcttaaaccgtccgctccgcatcgacctccccctcgtgctcgcctcgtccgttgcgcgttcaaatttcgaatccctcctcctcctcctcgaccgcctgccatcatgagcgccgccgccgcgccagccgctatgggcagcggcaaggagctcgccaacccgccctccgacgggatctccaacctccgcttctccaaccacagcaacaacctcctcgtctcctcgtgggacaagacggtgcggctgtacgacgccgacgccaacgtgctcaagggggagttcgtgcaccccggggccgtcctcgactgctgcttccacgacgactcgtcggggttcagcgctggagccgaccacaccgtgcggaggctagtatttagttcatccaaagaagatgttctggggagacacgatggtccagttcgttgtgtggaatactcgtatgctgcaggacaagtcatcactggcagctgggataaaactgttaaatgctgggatccaagaggagtgagtggaccagagcgtacacttgttgggacatacacccaaccagaacgtgtatattctctgtcattagtaggaaataggttggttgttgcaacggcagggaggcatgtcaatatttatgatttgcgcaatatgtctcaacctgagcaaaagagagactcgtctttgaaatatcaaacacgatgcgttcgatgtttcccaaacggaacaggatatgctctcagttctgtagaagggcgagtttctatggaattctttgatctatctgagtccgcacaatctaaaaagtatgctttcaagtgtcaccggaaatctgaagctgggagggacactgtttatcctgttaatgcaattgccttccatccgatatatggaacatttgccactggaggttgtgatggatttgtgaatgtgtgggatggcattaacaagaaaagactgtatcagtactcaaagtacacatcaagcatcgctgctctttcattcagtaaggatggtcatttgcttgctgtggcatccagctacacttacgaagagggagaaaaaacgcatgagcccgatgcaatattcatcagaacagtgaatgaagtggaggtaaaaccgaagcccaaggcattggccgcgccccagtagtattgtgatcggttggtgacagtatcagtcggatggttagatgatccttacttctcttggtgtcaattacgttagttgacgcagagcttgactgtgttgaggtgaaatgtcagtatcttagtccatctactgccgaattgtgtctgtggaaacatttcatgttccagctgattgtatatctcgttagagattatgttttagttcattatgactctatgttgacttggaacttatttgtttctccatttgagtaagtttggaactctggaggaaagaagaatactgccatgtagcatctatgtcaatttagtgttagttcagcc

SEQ ID NO: 38238 - protein, 343 aa, Panicum virgatum
  misc_feature: Ceres CLONE 1993004
  misc_feature (92)..(130): Pfam Name: WD40 Pfam Description: WD domain, G-beta repeat
  misc_feature (235)..(273): Pfam Name: WD40 Pfam Description: WD domain, G-beta repeat
  misc_feature: SWISSPROT Homolog: EC 2.3.1.48 Histone acetyltransferase
MSAAAAPAAMGSGKELANPPSDGISNLRFSNHSNNLLVSSWDKTVRLYDADANVLKGEFVHPGAVLDCCFHDDSSGFSAGADHTVRRLVFSSSKEDVLGRHDGPVRCVEYSYAAGQVITGSWDKTVKCWDPRGVSGPERTLVGTYTQPERVYSLSLVGNRLVVATAGRHVNIYDLRNMSQPEQKRDSSLKYQTRCVRCFPNGTGYALSSVEGRVSMEFFDLSESAQSKKYAFKCHRKSEAGRDTVYPVNAIAFHPIYGTFATGGCDGFVNVWDGINKKRLYQYSKYTSSIAALSFSKDGHLLAVASSYTYEEGEKTHEPDAIFIRTVNEVEVKPKPKALAAPQ

SEQ ID NO: 38239 - DNA, 689 bp, Panicum virgatum
  misc_feature: Ceres CLONE 1993011
  misc_feature: Encodes the peptide sequence at SEQ ID NO. 38240
gcagccgtggccttcctggctcctctcccttccccgtctcgcctcacaccattaaaccccacccgcgcgcgcggcggccggcggcgagccccacccacccaggcacgcggaggagggagcgggcgcgcggcaccaccaggggcggcatggggaccctcgggcgcgcgatcttcacggtcggcaagtggatccgcggcacggggcaagccatggaccgcctcggatccaccatccagggcggcctccgcgtcgaggagcagctttcaaggcatcttacagtcatgaacatttttgagaaagagccaaggatccatagagatgtgtttgttgctcccagtgcagcagtcattggtgatgttgagattggacatggatcatcaatctggtatggctccattttgagaggtgacgtcaacagcattcacatcggatctggaacaaatatccaagacaattcccttgtacatgtttcaagagctaacatcagcgggaaggtcctcccaaccataattggaagcaacgttacagtaggtcatagtgctgttttacatgcgtgcaccattgaggatgaagcttttgttggtatgggtgccactctgcttgatggagtggtggttgaaaaacacagcatggttggcgcaggatctcttgttaagcagaatacaaagattccttctggagaggtctgg

SEQ ID NO: 38240 - protein, 180 aa, Panicum virgatum
  misc_feature: Ceres CLONE 1993011
  misc_feature: SWISSPROT Homolog: EC 2.3.1.129 Acyl-[acyl-carrier-protein]--UDP-N-acetylglucosamine O-acyltransferase
MGTLGRAIFTVGKWIRGTGQAMDRLGSTIQGGLRVEEQLSRHLTVMNIFEKEPRIHRDVFVAPSAAVIGDVEIGHGSSIWYGSILRGDVNSIHIGSGTNIQDNSLVHVSRANISGKVLPTIIGSNVTVGHSAVLHACTIEDEAFVGMGATLLDGVVVEKHSMVGAGSLVKQNTKIPSGEV

SEQ ID NO: 38241 - DNA, 729 bp, Panicum virgatum
  misc_feature: Ceres CLONE 1993026
  misc_feature: Encodes the peptide sequence at SEQ ID NO. 38242
actcactctccgcactacctgtccagtccagctctcgagcttccaagctcccttcacccttgcctgccattataatcccccacaaaccacaccactgccagagacacacaccgctgcttgaagaaaccaccgaggccaagcgcgcaagggagagagggagagagggagagagagagagagagagagagagaggccaaggagaagagatggagggcaaggaggaggacgttcgcctgggcgccaacaagttctcggagcggcagcccatcgggacggcggcgcagggcgccggggatgacaaggactacaaggagcccccgccggcgccgctgttcgagcccggggagctcaagtcctggtcgttctaccgcgcgggtatcgccgagttcgtcgccaccttcctcttcctctacatcaccatcctcaccgtcatgggcgtctccaagtccaactccaagtgcgccaccgtcggcatccagggcatcgcctggtccttcggaggaatgatcttcgcgctcgtctactgcaccgccggcatctccggagggcacatcaacccggcagtgacgttcgggctgttcttggccaggaagctgtccctgactagggccgtcttctacataatcatgcaatgcctcggtgctatctgtggagctggagtggtgaagggcttccagcagggactttacatgggcaacggtggtggtgccaacgctgtcgctcccggct

SEQ ID NO: 38242 - protein, 174 aa, Panicum virgatum
  misc_feature: Ceres CLONE 1993026
  misc_feature (47)..(174): Pfam Name: MIP Pfam Description: Major intrinsic protein
  misc_feature: Useful for making plants with modulated water use efficiency
  misc_feature: Useful for making plants with modulated drought sensitivity
  misc_feature: Useful for making plants with modulated cold sensitivity
MEGKEEDVRLGANKFSERQPIGTAAQGAGDDKDYKEPPPAPLFEPGELKSWSFYRAGIAEFVATFLFLYITILTVMGVSKSNSKCATVGIQGIAWSFGGMIFALVYCTAGISGGHINPAVTFGLFLARKLSLTRAVFYIIMQCLGAICGAGVVKGFQQGLYMGNGGGANAVAPG

SEQ ID NO: 38243 - DNA, 730 bp, Panicum virgatum
  misc_feature: Ceres CLONE 1993028
  misc_feature: Encodes the peptide sequence at SEQ ID NO. 38244
aactcatgttcttcttcttcctccgagcttctgcatccaccagcaatggagagtcaacgcagcagcagcggtagagaagaacccctcaacggtagtcctcacctcaaagccccactcaacacgctccatgtcgaccgctgcacccccgcgcaccgcgtgcacgcgctcctctacgccggcgccatcctcggcctggtgtgccaccggctgacctccattctagcctcctcctcgctcgccgagggatggatgctgctggcggagctcgtcctggccttcatgtggggctgctcgcgggcgttcaagtggcggccggtgcgtcgccgggagttccccgacagactgccggagggtggcgcctggccgaagctcgacgtgttcgtgtgcacggctgatccgaggaaggagcccccggtcggggttgtgagcacagccctctcggccatggccttcgagtaccccgcgggcaagctgtcggtgtatgtttccgacgacggcggcgcggatgtgacgctgttcgcgttcatggagggcgccaggttcgcgcggcactggctgccgttttgcagggagaatggcgtgcaggtgcggtcgccggaggtgttctttgcttcttcttcttcttcttctggatgttctgccggtggcggcgatgcggataagctgaaagtgatgtaccaaaacatggtacagagggtggaggatgtgatgggagaaaggcatccatgtc

SEQ ID NO: 38244 - protein, 228 aa, Panicum virgatum
  misc_feature: Ceres CLONE 1993028
  misc_feature: SWISSPROT Homolog: EC 2.4.1.12 Cellulose synthase (UDP-forming)
MESQRSSSGREEPLNGSPHLKAPLNTLHVDRCTPAHRVHALLYAGAILGLVCHRLTSILASSSLAEGWMLLAELVLAFMWGCSRAFKWRPVRRREFPDRLPEGGAWPKLDVFVCTADPRKEPPVGVVSTALSAMAFEYPAGKLSVYVSDDGGADVTLFAFMEGARFARHWLPFCRENGVQVRSPEVFFASSSSSSGCSAGGGDADKLKVMYQNMVQRVEDVMGERHPC

SEQ ID NO: 38245 - DNA, 722 bp, Panicum virgatum
  misc_feature: Ceres CLONE 1993047
  misc_feature: Encodes the peptide sequence at SEQ ID NO. 38246
atttcctccccaactcccgtgacccagcctccgcctccctttcctcttgtcccgcagccgccagccgccgctcctcgcggtcccgctcaccaccgcgcctcctcgcgtcgcgtccctccgccgcgccgccgcgcctcctcgcgtccctccgtcgcgccgccgagccgcctcgcatctcgacgccgcccgtcccgccgccgcccgtcccgacgccgccaccgagcgtcctggttcctgatccgcctcggctttgacggttcaaccttcaacagaatgaagatctttgtgaggagccccatcggcaggacaatgtgtctcagagtccaaccatcagataccttgcatagtgttaaggcaaaaattctagaagaacagtgccttgtctttgatggaaagcaactagatgacaaccttacattggcagattatgacatccaccatcaatctactcttgacctccaagaaaagatgcagatctatgtaacagatacactagccggaaagaacatcacgcttaaggttcatagcttagatactattgacaatgtgaaggccaagcttgaatatagtgaaggatttcctaagggtcagcaatgcctcatttttggcaacaaacagctagaggacaattccaccttagtagaccacaacatttgcaaggagtccacccttctccttgttctccacccaattccaggcctgatgcggatcttcgtgaagac

SEQ ID NO: 38246 - protein, 149 aa, Panicum virgatum
  misc_feature: Ceres CLONE 1993047
  misc_feature (72)..(140): Pfam Name: ubiquitin Pfam Description: Ubiquitin family
  misc_feature (6)..(67): Pfam Name: ubiquitin Pfam Description: Ubiquitin family
  misc_feature: Useful for making plants with modulated cold sensitivity
MKIFVRSPIGRTMCLRVQPSDTLHSVKAKILEEQCLVFDGKQLDDNLTLADYDIHHQSTLDLQEKMQIYVTDTLAGKNITLKVHSLDTIDNVKAKLEYSEGFPKGQQCLIFGNKQLEDNSTLVDHNICKESTLLLVLHPIPGLMRIFVK

SEQ ID NO: 38247 - DNA, 702 bp, Panicum virgatum
  misc_feature: Ceres CLONE 1993089
  misc_feature: Encodes the peptide sequence at SEQ ID NO. 38248
gagtccgcccccaccccacgccgccgcccatgtccgccgcgccggccgccgccgccccgccccgccgcgtggtcatctgcggcggcggcgtggtgggcgcgtgcacggcctacttcctctcgacccacgccgcgtcgcccaccgtcccgaccctcgtcgagaggtgcgccccggcgtgcgccgcctcggggaaagccggcggcttcctcgccctcgactggtgcgactccaccccggggctctccgcgctcgcgcgggcctcctacgcgctccaccgccgcctcgccgccgacctcggcggcgccgacgcctacggctaccgccccgtccacaccctctccgtccgcgtcccctccgttcccaagcccgcctcgccgcacccgatgctcccggcctgggtcgacccgtcggcgtccgcggccccgccgcgggagctcggcaccccggacaccaccgcgcaggtccacccgggcctcttcaccagggccgtcctcgccgcgtccggcgccgaggtcgtcatcggcgaggtggagcgcgtcgtggtgcgggacggccgcgccgccggcgtcgccgtgaaggggcgcgacggcgtggtggacgccgacgccgtggtgctcgcgctcggcccgtggtccgggcggctcgaggtagtcagcgaggtgttcgacgtgtccgggctcaaggcgcacagcatcgtgctgc

SEQ ID NO: 38248 - protein, 224 aa, Panicum virgatum
  misc_feature: Ceres CLONE 1993089
  misc_feature (13)..(224): Pfam Name: DAO Pfam Description: FAD dependent oxidoreductase
MSAAPAAAAPPRRVVICGGGVVGACTAYFLSTHAASPTVPTLVERCAPACAASGKAGGFLALDWCDSTPGLSALARASYALHRRLAADLGGADAYGYRPVHTLSVRVPSVPKPASPHPMLPAWVDPSASAAPPRELGTPDTTAQVHPGLFTRAVLAASGAEVVIGEVERVVVRDGRAAGVAVKGRDGVVDADAVVLALGPWSGRLEVVSEVFDVSGLKAHSIVL

SEQ ID NO: 38249 - DNA, 678 bp, Panicum virgatum
  misc_feature: Ceres CLONE 1993091
  misc_feature: Encodes the peptide sequence at SEQ ID NO. 38250
acttttacaatgttcggaaggttgatactcatgttcatcactctgcatgcatgaaccagaagcatttgttgagatttatcaagtcaaagttgaggaaggaacctgacgaggtcgtaatctttagagatgggacctatttgactctcaaggaggttttcgagagtttggacttgactgggtatgacctcaatgttgatctcttagatgtccatgctgataagagcacatttcatcgttttgacaagtttaatctgaaatacaacccatgtggccaatctcgcctgagggagatcttcttaaaacaggataatcttattcaaggtcgcttccttgctgagctcacaaaagaagtgttttctgaccttgaagcaagtaaatatcagatggctgagtatcggatatctatttacgggaggaaaaaaagtgaatgggaccagatggctagttggattgtgaacaatgagttatacagtgagaatgttgtttggttaattcagattcctcggatatacaatgtatacagggagatgggcacaatcaattcgttccaaaacctccttgacaacatttttctccctctttatgaagtaactattgaccctgcttcacatcctcagctccatgttttcttggaacaggttgttgggttggatttggtggatgatgaaagcaaacctg

SEQ ID NO: 38250 - protein, 225 aa, Panicum virgatum
  misc_feature: Ceres CLONE 1993091
  misc_feature (3)..(225): Pfam Name: A_deaminase Pfam Description: Adenosine/AMP deaminase
  misc_feature: SWISSPROT Homolog: EC 3.5.4.6 AMP deaminase
FYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKEVFSDLEASKYQMAEYRISIYGRKKSEWDQMASWIVNNELYSENVVWLIQIPRIYNVYREMGTINSFQNLLDNIFLPLYEVTIDPASHPQLHVFLEQVVGLDLVDDESKP

SEQ ID NO: 38251 - DNA, 599 bp, Panicum virgatum
  misc_feature: Ceres CLONE 1993113
  misc_feature: Encodes the peptide sequence at SEQ ID NO. 38252
ggcgaggccaggctagtcaaggccgacgccacccgcctccacctccgcgccacacacgctcccggctgccccttcccccggcgacccggagatcccgcgcccgcgccgccggctagctcccccgccgagaccttccgcctcccggagcacccaggtgagcggagagggagggtctggttgtgccgtcgccgctgctgatccatggagcccagccggacgcggcgcggatagctctgcgccggtagatcgcgaggagtccccgcccgctgttgttttgtttgtctagccgtcgtttggcgtggaggatatggccgtggcgatggacgtggcgaaccccggagcggctgccggcgcaggaatgtcaagcgatgagctgtaccgggagctctggcatgtctgtgccggtccgttggtcaccgttcctagactaggcgagcgagtctattactttccccagcgccatatggagcagctcgaggcatccacacaccagcagcttgaccagtacctacccacgtttaatctaccatccaagatcctatgcagagtagtcaacgtggaactacgggcggaagctgattcagatgaagtttatgctc

SEQ ID NO: 38252 - protein, 97 aa, Panicum virgatum
  misc_feature: Ceres CLONE 1993113
  misc_feature: The sequence is a functional homolog of SEQ ID NO 298 in the 10/412,699 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
  misc_feature: Useful for biocontainment applications
  misc_feature: Useful for making plants with modulated flowering time
  misc_feature: The sequence is a functional homolog of SEQ ID NO 300 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: Useful for making plants with modulated light quality sensitivity
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
MAVAMDVANPGAAAGAGMSSDELYRELWHVCAGPLVTVPRLGERVYYFPQRHMEQLEASTHQQLDQYLPTFNLPSKILCRVVNVELRAEADSDEVYA

SEQ ID NO: 38253 - DNA, 714 bp, Panicum virgatum
  misc_feature: Ceres CLONE 1993116
  misc_feature: Encodes the peptide sequence at SEQ ID NO. 38254
gagcgagccactgtcacatgctgcataattgtgcccgcccgccggcccccgggggcgtgacacatcgcgcgcacgaagctcgcctgcctgccgcttttggctccgcccgccgtgccgcccgtgaggccggcagctttgcatgaggaggcggaggatgggggcactgcacgtcgtcggtgagcctagggtcagcttccagcaccagcaccaccagcagcagcagcctgccgtcgtcgccgccggcaagagcggcggccacggccccgtcgtcgaggagatccacggcctcatacgcgtctacaaggacggccacgtcgagcggcccccggcgatccccgacgtgccctgcacgtggggcgccacggcgcccggcgcgccgggcggcgtcgcggcgagggacgtggtggtcgaccgcgccacgggggtgtgggcgcggctctacgcgccggtggctggaggcgggctccccgtcgtggtgtacttccacggcggcgggttctgcgtcggctccgcggcctggagctgctaccacgagttcctcgcgcagctcgccgcgcgggcgggctgcgccgtcatgtccgtggactaccgcctcgcgcccgagcaccgcctgcccgccgcgttcgacgacgggctcgcggcggtgcgctggctgcggcaccaggcgtccctggccaccggccgcggcgcggcccccgacgagggctcctgggt

SEQ ID NO: 38254 - protein, 186 aa, Panicum virgatum
  misc_feature: Ceres CLONE 1993116
  misc_feature (107)..(186): Pfam Name: Abhydrolase_3 Pfam Description: alpha/beta hydrolase fold
  misc_feature: SWISSPROT Homolog: EC 3.1.1.3 Triacylglycerol lipase
MGALHVVGEPRVSFQHQHHQQQQPAVVAAGKSGGHGPVVEEIHGLIRVYKDGHVERPPAIPDVPCTWGATAPGAPGGVAARDVVVDRATGVWARLYAPVAGGGLPVVVYFHGGGFCVGSAAWSCYHEFLAQLAARAGCAVMSVDYRLAPEHRLPAAFDDGLAAVRWLRHQASLATGRGAAPDEGSW

SEQ ID NO: 38255 - DNA, 1366 bp, Panicum virgatum
  misc_feature: Ceres CLONE 1993118
  misc_feature: Encodes the peptide sequence at SEQ ID NO. 38256
aacgacattcaccaccaccaccacccctatccctgctgcccccgtccaaagacagacgccaacgtgcatgacagacgacgccaccactgacgcagtgggggatcatctcccgctccgagcaggagcaatggcatcttctcgtctcctctgcgtcgtcctgctctgcctcctcttcctccacctcgcggccgccgccaccagggacaccatcacgccgggcagcccgctgggtgccaacgagacgatggtctccggcggcgacggcaacttcgccatgggcttcttcaccccgcagggcgccaacaacacctacctgggcgtgtggtacaacaaggtctcgctccgcaccgtggtgtgggtcgccaaccgcgagtcccccatcgcgggcgccgtcgaggacaacccgggcgccacgctctccgtctccgccgccggcgagctcgccattgccgccgggaacaggaccgtcgtgtggtccgtcaagccggagtcgtcgttcgcggcggggaagaagctgatggcgagccccgtcgcgcagatcctcgacaacggcaacctcgtggtctcggacggcgtcggcggcgccgtcgcgtgggaagggttcgactacccgacggacacgatgctcccggagatgaagatcgggatcgactacgtcaagcggaagaaccggacgctgacgtcgtggaaaagcccctctgacccttcgcccggccccgtcgccatgatcatggacaccaaaggtgacccccaggtgttcatctggaacggcggcgagaaagtctggcgatccggcccctgggacggcttccagttcaccggcgtccctgacaccgccacctactccggtttcaccttcagcttcatgaataacgctcaggaagtcacctacagcttccaggtgcacaacgcgtccatcatctcgcatctgggcgtggtgagcacgggcaactacgggctgttgcagcggtcgacgtgggtggaggcggccaagacatggaacctctactggtacgcgccaaaggaccagtgcgacgcggtgtccccgtgcgggcccaacggggtgtgcgacaccaacaacctgccggtctgctcctgcctccgtggcttcaccccgaggaccccggccgcgtgggcgctgcgcgacggccgggacgggtgcgtgcggtcgacgccgctcgactgccgcaacggcaccgacgggttcgtcacggtgcgacacgccaaggtgcccgacacggagcgcgccgtggtggactggaccctcacgctggaccagtgcaggcaggcctgcctccgcaactgctcctgcacggcgtacgccagcgccaacgtcagcgggcggcgccgccggggggcgcggcgt

SEQ ID NO: 38256 - protein, 412 aa, Panicum virgatum
  misc_feature: Ceres CLONE 1993118
  misc_feature (208)..(336): Pfam Name: S_locus_glycop Pfam Description: S-locus glycoprotein family
  misc_feature (72)..(194): Pfam Name: B_lectin Pfam Description: D-mannose binding lectin
  misc_feature (353)..(406): Pfam Name: PAN_2 Pfam Description: PAN-like domain
MASSRLLCVVLLCLLFLHLAAAATRDTITPGSPLGANETMVSGGDGNFAMGFFTPQGANNTYLGVWYNKVSLRTVVWVANRESPIAGAVEDNPGATLSVSAAGELAIAAGNRTVVWSVKPESSFAAGKKLMASPVAQILDNGNLVVSDGVGGAVAWEGFDYPTDTMLPEMKIGIDYVKRKNRTLTSWKSPSDPSPGPVAMIMDTKGDPQVFIWNGGEKVWRSGPWDGFQFTGVPDTATYSGFTFSFMNNAQEVTYSFQVHNASIISHLGVVSTGNYGLLQRSTWVEAAKTWNLYWYAPKDQCDAVSPCGPNGVCDTNNLPVCSCLRGFTPRTPAAWALRDGRDGCVRSTPLDCRNGTDGFVTVRHAKVPDTERAVVDWTLTLDQCRQACLRNCSCTAYASANVSGRRRRGAR

SEQ ID NO: 38257 - DNA, 1584 bp, Panicum virgatum
  misc_feature: Ceres CLONE 1993136
  misc_feature: Encodes the peptide sequence at SEQ ID NO. 38258
tggcttccgaggagagcgtagactaataccaaaccacaccagccatgggtaaggagaagactcacatcaaccttgtcgtgatcggtcacgtcgatgccggtaagtcgaccaccaccggccacttgatctacaagtgcggtggtatcgacaagcgaaccatcgagaagttcgaggctgaggccaaggagatgggcaagggctcgttcaagtacgcctgggtgctcgacaagctgaaggccgagcgtgagcgtggtatcaccatcgatatcgctctctggaagttcgagactgccaagtactacttcaccatcatcgatgcccccggtcaccgtgatttcattaagaacatgatcaccggtacctcgcaggctgacgtggctatcctcgtcatcgcctccggtgagggtgagttcgaggccggtatctccaagaacggtcagacccgtgagcacgctctgctcgccttcaccctcggtgtcaagcagatgatcgtggtctgcaacaagatggacaacgtcaactgggctgagaaccgttacaacgagatccagcgtgaggtgtcgggctacctgaagaaggtcggctacaaccccaagaacatcccgttcgtcccgatctccggcttccacggtgacaacatggttgacaagaccgacaagatgccgtggtacaagggccccacgctcctcgaggccctcgatgacatcaagccccccaagcgccccatggacaagcccctccgtgtgccccttcaggacgtctacaagatcggcggtatcggtaccgtgcccgtcggccgtgtcgagactggcgtgctcaagcccggcatggtggtgaccttcgcccccgtgaacgtgaccactgaggtcaagtccgtcgagatgcaccacgaggccctccccgaggccgtgcccggcgacaacgttggtttcaacgtcaagaacgtctccatcaaggacatccgtcgcggtaacgtcgccggtgactccaagaaggacccgccccaggagactgaggacttcaccgcccaggtgatcatccttaaccaccctggtcagatccacgctggctatgcccccgtgctcgattgccacaccgcccacattgcctgcaagttcaaggagctgctcgagaaggtggaccgtcgttccggtaagaagatggaggacaaccccaaggccgtcaagtctggcgacgccgccatggtgctcctcgtgccctccaagcccctttgcgtcgagaccttcaccgactacccgcccctcggccgcttcgccgtccgtgacatgaggcagaccgtcgccgtcggcgtcatcaaggccgtcacccgcaaggaccccaaggccggtaaggttaccgcctcggccaagaaggccggcaagaagtaaatggcctcgcccccgtccgtttaccagccctccgtttagtctacgctctgtcacatcctccgaaagcatgttcgactctgtgctgcttcggtcgcgaccccgctcgcgagcatgaccgcgcccctgcgcttgtgtttccttgcggccagtcgacaattttgtttcacaagatctaaaaacataaaaattcattcct

SEQ ID NO: 38258 - protein, 447 aa, Panicum virgatum
  misc_feature: Ceres CLONE 1993136
  misc_feature (5)..(223): Pfam Name: GTP_EFTU Pfam Description: Elongation factor Tu GTP binding domain
  misc_feature (320)..(428): Pfam Name: GTP_EFTU_D3 Pfam Description: Elongation factor Tu C-terminal domain
  misc_feature (246)..(313): Pfam Name: GTP_EFTU_D2 Pfam Description: Elongation factor Tu domain 2
  misc_feature: SWISSPROT Homolog: EC 2.7.7.4 Sulfate adenylyltransferase
MGKEKTHINLVVIGHVDAGKSTTTGHLIYKCGGIDKRTIEKFEAEAKEMGKGSFKYAWVLDKLKAERERGITIDIALWKFETAKYYFTIIDAPGHRDFIKNMITGTSQADVAILVIASGEGEFEAGISKNGQTREHALLAFTLGVKQMIVVCNKMDNVNWAENRYNEIQREVSGYLKKVGYNPKNIPFVPISGFHGDNMVDKTDKMPWYKGPTLLEALDDIKPPKRPMDKPLRVPLQDVYKIGGIGTVPVGRVETGVLKPGMVVTFAPVNVTTEVKSVEMHHEALPEAVPGDNVGFNVKNVSIKDIRRGNVAGDSKKDPPQETEDFTAQVIILNHPGQIHAGYAPVLDCHTAHIACKFKELLEKVDRRSGKKMEDNPKAVKSGDAAMVLLVPSKPLCVETFTDYPPLGRFAVRDMRQTVAVGVIKAVTRKDPKAGKVTASAKKAGKK

SEQ ID NO: 38259 - DNA, 680 bp, Panicum virgatum
  misc_feature: Ceres CLONE 1993137
  misc_feature: Encodes the peptide sequence at SEQ ID NO. 38260
aatcgtccccccatctcccagtcccatcttcgccgccgcgccgccaagccccgccggacaccgccatgccgacctccgccgccgccgcgtcctccctttccctcctcttctcgcacccccactcccgccactcgtccgcccgcggcggcccccacctccgcctccctgcccgcgccagccgcgcgcgctgcgcctcctccgacgcgcccgccacggccaccaagcaccgccgccccgcggaggagaacatccgcgaggaagccgcgcggctccggggccccgtgcagggcttctcggcctggtacgagcccttccccccggcgcccggcggcaatcccgacgagcgctactcgctcgacgaggtcgtctaccgctccagctcggggggcctcctcgacgtgcgccacgacatggacgcgctggcccgctacccgggctcctactggcgggacctcttcgactcccgcgtcggccgcaccgcctggccctacggctccggggtctggtccaagaaggagttcgtgctcccggagatcgactccgaccacatcgtctccctcttcgagggcaactccaacctcttctgggccgagcgcctcggccgcgagcacctcggcgggatgaacgacctctgggtcaagcactgcggcatctcccacacgggctccttcaaggacctc

SEQ ID NO: 38260 - protein, 204 aa, Panicum virgatum
  misc_feature: Ceres CLONE 1993137
  misc_feature: SWISSPROT Homolog: EC 4.2.3.1 Threonine synthase
MPTSAAAASSLSLLFSHPHSRHSSARGGPHLRLPARASRARCASSDAPATATKHRRPAEENIREEAARLRGPVQGFSAWYEPFPPAPGGNPDERYSLDEVVYRSSSGGLLDVRHDMDALARYPGSYWRDLFDSRVGRTAWPYGSGVWSKKEFVLPEIDSDHIVSLFEGNSNLFWAERLGREHLGGMNDLWVKHCGISHTGSFKD

SEQ ID NO: 38261 - DNA, 1626 bp, Panicum virgatum
  misc_feature: Ceres CLONE 1993146
  misc_feature: Encodes the peptide sequence at SEQ ID NO. 38262
accatcatccaccacttcttgcgagcaagcgtctgagcaagcgccacggatagtgactcggccacacacagcaagcaccaacgctacaagccagcccggctctcttcgtaccgaatagcaatcaccgccattggcaacggagtttgttcgcgcgatgtcgatgttcgggggcattgacggcagctttgccggcctcaaccgcttcatgcagaatggcatggatcctcgctttccgcgaccgccgcgagcgtacgacgagtacttcaaagcttacagcatggctatgctgccgggcaaggagcgactcaacgtcagctacggaggcaagatcatcatgccaccatcggcgctcgcacacctcactaatctcgagatcgagtcgccgtggttctttgagctgcgcagcacaggcgcctccgaggtccgccgcacccatgcaggtgtgctcgagttcattgccgacgaaggcaacgtccacctccccgcatggatgatgcgcacgcttggcctctccgagggagaccccattcgactcacgggtgcgacgctgcccaagggcaagatggtcaagatccagccgcagaccgtcgacttcctcgaaatcagcgatcccaaggcggtgctggaacaggccttccgcaacttttccgcactcactcctggcgacattgtcgagatcagctacaactgcctcacctttgagatcctcatcatggagatcactcccaacgccgacggcatctctatcatcgagaccgatctcgaggtcgacttcgctccaccaaagggctatgtcgagcccactccgcagccacgtcctccaccgcccacaatggcatccaagctcaacatcgacagcaatcgcgtagagtccatccctcccacgcgcacatccacaccaggctcgctcgcaggcacaagtgcagcaggcggttcgggcgtcgccacccccgccggtcccttccgcggcgcaggtcagacgctgagcggcaagaagagcaagggcaagaaggaccgccagatcgagcaactcgacccattcagcatgatccgacgcaccgacatgccgcgcatcgtcaccaacgacactcagctcaccgaaaagaagatccccgcagcactcaatctgcccttcggcaagctcttctttggctacgaggtgatccccgtcggcggcaagcccaccgaagctgcgaacgataagccggcagagacatttgcgggatcaggcactacactgtcgggacgcgcgcccagagcaaagccccaagagacgcaggacaccaagccaaagcctgagcagaccgcattcacgcttggcggcggccgcgttctcggcgagagctcccgcagcagccgctacggaactccctcgagttcggccggtcgaagtctcaacgactcccaccgcgacgtcatcgagatcgactcggactgacccgcttcctagcatgccgcaggcgctcgtccgcaagaggcggtcctcatcttgagctctatgcgccggcgatagcacgggtggaccacgctgccaggaacctccacgcccgatttcatccctgtacttgtatctgtttggcacctttgcatttcatgcgtgcaacgcaatcgcttctcattccttct

SEQ ID NO: 38262 - protein, 427 aa, Panicum virgatum
  misc_feature: Ceres CLONE 1993146
  misc_feature (30)..(210): Pfam Name: UFD1 Pfam Description: Ubiquitin fusion degradation protein UFD1
MSMFGGIDGSFAGLNRFMQNGMDPRFPRPPRAYDEYFKAYSMAMLPGKERLNVSYGGKIIMPPSALAHLTNLEIESPWFFELRSTGASEVRRTHAGVLEFIADEGNVHLPAWMMRTLGLSEGDPIRLTGATLPKGKMVKIQPQTVDFLEISDPKAVLEQAFRNFSALTPGDIVEISYNCLTFEILIMEITPNADGISIIETDLEVDFAPPKGYVEPTPQPRPPPPTMASKLNIDSNRVESIPPTRTSTPGSLAGTSAAGGSGVATPAGPFRGAGQTLSGKKSKGKKDRQIEQLDPFSMIRRTDMPRIVTNDTQLTEKKIPAALNLPFGKLFFGYEVIPVGGKPTEAANDKPAETFAGSGTTLSGRAPRAKPQETQDTKPKPEQTAFTLGGGRVLGESSRSSRYGTPSSSAGRSLNDSHRDVIEIDSD

SEQ ID NO: 38263 - DNA, 1250 bp, Panicum virgatum
  misc_feature: Ceres CLONE 1993153
  misc_feature: Encodes the peptide sequence at SEQ ID NO. 38264
ctttcccacatctcttcttctccacagtccacactgttcacctcgtctcccccctctctcctcgatccccaaatcccgaattgaccagcccaaatcggcgccccgcatggagtggacggccccgaagcccgccgcttcgccctcctcgcctcccctgctctgggactggggcgaccacgccgccgcgggctcaggctcctccggcgacgcgccagcgcggcgcggcgggaaggaacgggagccgaagcgaaccaagggcgaggagggcgggggagcggaagttaggtgccaggtcgaggggtgcgggctggagctcggcacggccaaggactaccaccggaagcaccgcgtctgcgaggcccacaccaagtgcccccgcgtcgtcgtcgccggccaggagcgccgcttctgccagcagtgcagccggtcgatgctgttcttgccttcgattgctccccggagctctttgctctgctctcgcttgctctgtttgacctccgcggagccgcaatcttgcggctctctgcgattgctctccttccttctttgatgattacttcctgcgaggatgggtcgcgctgttacgctgcaataatccgtgattagttgattgatttgcgcaagcatgtgttttacgagctctttagtgttgtggttatgctgtgcgtgtctgcgtgtgctggtgtgcgtttttttttgtacggagctgcgtttttcctgatctggcaacgaaagatgctgcctttccactaatcgtactgctgtacttgtggagaatcgtacgcatgggtaaaatggctgtgcaatgtttcccctttccagttttggtatggctctgtgtatgcttttggaatgaactttttggtggcctgtgtcttttgattctgttactgtatctaaattgcaggactatcttctgtttgcactattacatggctatctatgccaagaatgtatgttaggtttttctgattgcttgggttttgataatccaggttccatgctctgtcatagtttgatcagaagaagaggagctgggaggcgtctgtctgatcacaatgcccgccggcggaagcctcacccagatgcgtacacctttgcctctgcaaggctgccttcatcattgttggatgataagcggcaaataagttttgtctggaataaagctcctcttagccatgtaagacctttcagttcttcttgggatagctcatctgacttcaagcttgcacatgccaaggaaataagaa

SEQ ID NO: 38264 - protein, 147 aa, Panicum virgatum
  misc_feature: Ceres CLONE 1993153
  misc_feature (60)..(140): Pfam Name: SBP Pfam Description: SBP domain
MEWTAPKPAASPSSPPLLWDWGDHAAAGSGSSGDAPARRGGKEREPKRTKGEEGGGAEVRCQVEGCGLELGTAKDYHRKHRVCEAHTKCPRVVVAGQERRFCQQCSRSMLFLPSIAPRSSLLCSRLLCLTSAEPQSCGSLRLLSFLL

SEQ ID NO: 38265 - DNA, 106 bp, Panicum virgatum
  misc_feature: Ceres CLONE 1993153-R
agggcggaggaacagcaaaaagcaccccagccccagcagggacgggggaccagggaaacgaggagcaaaggcgaggaacccacccacgccgggggaaaccagaaaa

SEQ ID NO: 38266 - DNA, 684 bp, Panicum virgatum
  misc_feature: Ceres CLONE 1993157
  misc_feature: Encodes the peptide sequence at SEQ ID NO. 38267
atacaggtcgagtcgaactcaccatcgcactcgccggacaatgatggaggcggcggcgacgacgctgccgctgcttggcctgctgctcctgctacccctcttcctcatcatcaagctcatcgccaggagctacgccccggcgtcgccgtcgtcgcagcccgggaagaagccgccgctgcgcctgcccccggggccgtggcagctgccgctcatcggcagcctccaccacctcctcctgtccccgcacggcggcctcgcgcaccgcgccctgcgggacctgtccgctcggcacggcccgctcatgatgctccgcctcggcgccgtgcccacgctggtggtgtcctcggccgaggcggccagggaggtgatgaggacccacgacgccgcgttcgcgagccggagcctgacgccgacgctggccgtgttcggcgacggcggccgcgacatcctcttctccccctacggcgacctgtggcgccagctccggcggatctgcgtgctcgagctcctctccccgcgccgcgtccggtccttccgccgcatccgggaggaggaggccgcgggcctgctccgctccgtcgccgcctcctgcgccgccgcccacgcccagggcggcgccgcggtggtcgacgtcggcgagaggatctgccgcgccatgaacgacatcgtggtgcggtcggccgt

SEQ ID NO: 38267 - protein, 213 aa, Panicum virgatum
  misc_feature: Ceres CLONE 1993157
  misc_feature: SWISSPROT Homolog: EC 1.14.13.68 4-hydroxyphenylacetaldehyde oxime monooxygenase
MEAAATTLPLLGLLLLLPLFLIIKLIARSYAPASPSSQPGKKPPLRLPPGPWQLPLIGSLHHLLLSPHGGLAHRALRDLSARHGPLMMLRLGAVPTLVVSSAEAAREVMRTHDAAFASRSLTPTLAVFGDGGRDILFSPYGDLWRQLRRICVLELLSPRRVRSFRRIREEEAAGLLRSVAASCAAAHAQGGAAVVDVGERICRAMNDIVVRSA

SEQ ID NO: 38268 - DNA, 623 bp, Panicum virgatum
  misc_feature: Ceres CLONE 1993165
  misc_feature: Encodes the peptide sequence at SEQ ID NO. 38269
aaggcgaccggcaagtccccctccccacctaacgttgcgacggccggtcagcctccagtccacggcgcgcccgcgagctcgacgtctcgacgcttccacttgccgagagccgggcgccgcagagcctcaagttcaattcaccgccgcgggcgcggagagcgtttccgagcctcggctcttccacccgccgagagccgcgggcccggcggcagctagctccggcgggcggcggaggaatgcggatggggaagtacgagatggggcggacgctcggggagggccacttcggcaaggtgaggctggcgcggcacgccgagacgggccgcgccttcgccatcaagatcctcgaccgtcagcgcatcctcgccatgaagatcgacgagcagataaagagggagatcgccacgctgaagctgctcaagcaccccaacgtcgtccggctgtacgaggtttcagcaagcaaaacaaaaatatacatggtccttgagtatgtaaatggaggagaactatttgacaaaatcgcattgaagggtaagctgacagagaaggaagggagaaaactattccagcagctaatggatgccataggctattgccacgagatgggggtctatcatagggac

SEQ ID NO: 38269 - protein, 128 aa, Panicum virgatum
  misc_feature: Ceres CLONE 1993165
  misc_feature (6)..(128): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated salt sensitivity
  misc_feature: Useful for making plants with modulated biomass
MRMGKYEMGRTLGEGHFGKVRLARHAETGRAFAIKILDRQRILAMKIDEQIKREIATLKLLKHPNVVRLYEVSASKTKIYMVLEYVNGGELFDKIALKGKLTEKEGRKLFQQLMDAIGYCHEMGVYHR

SEQ ID NO: 38270 - DNA, 649 bp, Panicum virgatum
  misc_feature: Ceres CLONE 1993213-R
  misc_feature: Encodes the peptide sequence at SEQ ID NO. 38271
ctccggatggcgcacggcacggaccagtgggacgcgtggcgccgcgacccggaggtgaacaaggtgttcatggacgggctcggggcagacagccagctcaccatggacttcgtggtgacccggtgcggcgaggtgttcgacggcgtcggcactctggtcgacgtcggcggcgggaacggcagcacggcgagggccatcgcgagggcgttcccgcacgtcaggtgctcggtgctggacctcgcccacgtgatcggccacatccagccgtccgatggcgttcagtacatagtcggtgatatgatgagctcgatccctcctgctgacgctgtgctgctcaagcacgtcttgcatgactggaacgacgaggactgcgtcaggatcctaactcaatgcaagaaggccattgtttcggaggagaaaccatcaggagggaaagtgatcatcatagacacagtcgtcgggtctccggccgatgacgccatgttcctagcccaggtcacgttcgatctgaacatgcttgtgacgacgccgggcagggagcgcgacgagcacgagtggcgcagtatattcacggccgcggggttcgggcaccacaagaagaggccagtcctggggtttctctcaatcatcgagccgtatccatcgagac

SEQ ID NO: 38271 - protein, 214 aa, Panicum virgatum
  misc_feature: Ceres CLONE 1993213-R
  misc_feature (1)..(189): Pfam Name: Methyltransf_2 Pfam Description: O-methyltransferase
  misc_feature: SWISSPROT Homolog: EC 2.1.1.150 Isoflavone 7-O-methyltransferase
MAHGTDQWDAWRRDPEVNKVFMDGLGADSQLTMDFVVTRCGEVFDGVGTLVDVGGGNGSTARAIARAFPHVRCSVLDLAHVIGHIQPSDGVQYIVGDMMSSIPPADAVLLKHVLHDWNDEDCVRILTQCKKAIVSEEKPSGGKVIIIDTVVGSPADDAMFLAQVTFDLNMLVTTPGRERDEHEWRSIFTAAGFGHHKKRPVLGFLSIIEPYPSR

SEQ ID NO: 38272 - DNA, 1441 bp, Panicum virgatum
  misc_feature: Ceres CLONE 1993213
aagcgaccaaccccgttcccgttcccgtccccgtctcgtgcttccccttctccaacctccatcgccaccagaaggggagtggaacagcgcagacccttgctccgattcgcctctcctcggcggaagtagcggagcgggcgctgcggcgggcgggcgggcgggcgggcggaggccatgtggcccggctgcggcgggcggttctactgggcgccgggatcggcggcggcggggcaggcgaggggcgtcgcggtggtcttcgcgtgggtgtggagcgacgaggcgcagctgcggccgttcgtcgagctctacgcctcgctcgggtggcgctgcctcgtctgccaccccgacctcgtcgcgctatatctctctgagaaagcaacatcactggcaactggtgttattaatgagctggttaaggaactgaaagtaaagcctttgccaactgttcttgcttccttttctggtggttctaagggatgcatgtacaaggttattcagttactagatggaagatgcgaaggagatgcaactatgagggactatcggttagtgagaaactgcatctgtgggcaaatttatgactctagccccgtagattttaccagcgatgtgggcactcagtttctcccaaagcctgcagatggaaattcatctcagtcatccatattacgttcctggatggcaaaggctctagcatctggcatggatactctcttcccaagcagaattgaggctcagcgtgcagagtactggcacacactatactcatcagcaggattgggtcctgttcttatattttgctcagaagatgataatcttgctccaagccatgttatctgtggttttgcgaggcgcctgattgaactaggtgcagatgttaaacttatgaaatggagcgactcccaacatgttggtcattacaattcacacgaagctgaatacaggacagctgtaaatgatatgctgaagaaagctctcatcaccttctgccaccgaagccaactgtatgactcaaaaatggctggtgataaggaatataagatagcacactcagtctgcagtctacataatgctgcagccaattcaaatgagagcttaagaagggttgctaacagtcctagtgatcacttcttcctgccaagttcgaaggatcatgatgaatctagcgaaccaggttctctgatggaggaccagaggcgccatttatcccatccacccagcatggaacctaaaggagtgcttggtcagatcctgttcgatgtttgtgttccgaagaatgttgaaggatgggacatcaagccaacagtatcccaaaatggacggccaacattcacttcagccaggcaacttggtcctttcaatcccatcaagtacttcagacgttcaagactttagtttgttgcaggagttgagaattttgtgtatataacggaggcaaggc

SEQ ID NO: 38273 - DNA, 672 bp, Panicum virgatum
  misc_feature: Ceres CLONE 1993219
  misc_feature: Encodes the peptide sequence at SEQ ID NO. 38274
ggacgtcattttccccccacctctatgggctcgtcgggagcaccgccggagccgccggccgtggcggcggcgaggaagctgcaccacctcctccgctcccgcgaccttcgcccggcgctctcctacctccgcaccctcccttcgccgctaaccctcctccccaaccacgccctcaacgccctcctccgcgcggtcgccgccgccggccgcgtccgcgccgccgcctcactcttccgctccatcccctcccccacgccgcattccttcaactccctcctcgccgcgctcctccggcggggccgccgccgcgcggcctccgccctgctcgcggtgttcctccgctcccccgacgcctcccccgacgtcaccaccctcaacacccttctccatgggcttttcactgcctccctgcgcccgtcggctcccacgctcctcaagctcttccgcttcttgccggagacctacgccttcgcccccgacaccatcacgtacaattctctgctatccgctctgtgccgagccggcgacctggccaccgcgcgcaagctgttcgacggaatgcgcgcgagcgaagaagagagcaaaagtggcgccctccctaatgttgtcacctacactaccatgatcagggcgtactgtgcaaaggggcttgctgacaaggcattgtcactc

SEQ ID NO: 38274 - protein, 215 aa, Panicum virgatum
  misc_feature: Ceres CLONE 1993219
  misc_feature (154)..(188): Pfam Name: PPR Pfam Description: PPR repeat
MGSSGAPPEPPAVAAARKLHHLLRSRDLRPALSYLRTLPSPLTLLPNHALNALLRAVAAAGRVRAAASLFRSIPSPTPHSFNSLLAALLRRGRRRAASALLAVFLRSPDASPDVTTLNTLLHGLFTASLRPSAPTLLKLFRFLPETYAFAPDTITYNSLLSALCRAGDLATARKLFDGMRASEEESKSGALPNVVTYTTMIRAYCAKGLADKALS

SEQ ID NO: 38275 - DNA, 743 bp, Panicum virgatum
  misc_feature: Ceres CLONE 1993220
  misc_feature: Encodes the peptide sequence at SEQ ID NO. 38276
aagctcgcgcggtcgcgagcctcccccaaaatccccagaaccctagcagagctcgagacccccccacccccactcgcgatggcgtcggagagcgagacgacggcggtctccaccataacaagcgcgacggtcgacgatggtggcgcgcacgagagcaagcgggagctcggcagtggcgcggccaccagccccggcgtggggcaggaggaggacgaggagatgttagggccgggcccggcgccggcgaagcagcggaagaagcgcccgctccagttcgagcaggccttcctcgacgccctcccctccgccgccatgtacgagaagagctatatgcatcgggacgtcgtcacccacgtcgccgtctctccggccgacttcttcatcactgggagcgcagatgtaatgcaggtgagcgttgatggattgctttgctgcacgatatccagcgaccgttctgtgaagatatatgatgttgtaaactatgacatgatgttcatgatgcgtctcccatttgttcctggggctattgagtgggttcatcgagagggggatgtcaaaccaaaacttgctgttagtgaccgaaatacaccttttgttcacatatatgatactcattctggttcaaacgatccaatcatctccaaagagattcatgctggtcctgttaaagtaatgagatataaccatgtgcatgatgttgtgatatctgctgatgccagaggactgttggaatactgggtctc

SEQ ID NO: 38276 - protein, 221 aa, Panicum virgatum
  misc_feature: Ceres CLONE 1993220
  misc_feature: SWISSPROT Homolog: EC 5.2.1.8 Peptidylprolyl isomerase
MASESETTAVSTITSATVDDGGAHESKRELGSGAATSPGVGQEEDEEMLGPGPAPAKQRKKRPLQFEQAFLDALPSAAMYEKSYMHRDVVTHVAVSPADFFITGSADVMQVSVDGLLCCTISSDRSVKIYDVVNYDMMFMMRLPFVPGAIEWVHREGDVKPKLAVSDRNTPFVHIYDTHSGSNDPIISKEIHAGPVKVMRYNHVHDVVISADARGLLEYWV

SEQ ID NO: 38277 - DNA, 675 bp, Panicum virgatum
  misc_feature: Ceres CLONE 1993229
  misc_feature: Encodes the peptide sequence at SEQ ID NO. 38278
ctgtcccaagcaccaagaagctcctcccgtttatggctgtgagagtggccgcgatgctcggtcgtcgtcttctactccagcttctcctccttgctgcggcttccgacgcctacggcgatggcgccggccagccgccgatcagcaggagaagcttccctgtggggttcatcttcgggacggcctcagcagcctaccagtacgagggcggtgcaatggaagggggcagagggccgagcatctgggacacctttactcatcagcacccagataaaattgctgacagaagcaatggggacgtggcagtagattcctaccatctctacaaggaagatgtgcgcataatgaaggatatggggatggatgcctacaggttctccatctcctggagtagaattcttccaaatggaagtatgaatggtggagtcaacaaagaaggcgtcagatactacaacaatttgattgatgagctcctgctgaaaggcgttcaaccatttgtgaccctttttcactgggactcacctcaggcattagaagataaatacaagggattccttagtcctaacatcatcaatgactacaaggactacgctgaagtctgcttcaaggagtttggtgaccgagtgaaacactggatcacgttcaatgagccctggagcttctgctcaggtgggtatg

SEQ ID NO: 38278 - protein, 214 aa, Panicum virgatum
  misc_feature: Ceres CLONE 1993229
  misc_feature (37)..(214): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered carbohydrate content
  misc_feature: Useful for making plants with altered cell wall content and/or composition
  misc_feature: Useful for making plants with modulated biomass
  misc_feature: Useful for making plants with modulated flowering time
MAVRVAAMLGRRLLLQLLLLAAASDAYGDGAGQPPISRRSFPVGFIFGTASAAYQYEGGAMEGGRGPSIWDTFTHQHPDKIADRSNGDVAVDSYHLYKEDVRIMKDMGMDAYRFSISWSRILPNGSMNGGVNKEGVRYYNNLIDELLLKGVQPFVTLFHWDSPQALEDKYKGFLSPNIINDYKDYAEVCFKEFGDRVKHWITFNEPWSFCSGGY

SEQ ID NO: 38279 - DNA, 724 bp, Panicum virgatum
  misc_feature: Ceres CLONE 1993239
  misc_feature: Encodes the peptide sequence at SEQ ID NO. 38280
cgtgagctcgggagggagcgtgtgcgctgcgctgcagatcgggcggcgcctccgcgtagctcgggccgtttgagggggcccgcccgccccatgcgccggtgaggtggtggggcccgctctgcgcgcgagtcagaatggcggcggcggcggcgatgaggtggtgggcggcggtggcgctcgcggtggcggtggcgctcgggccggggcgggtcgtcgccaacaccgagggtgatgctctgtacagcctgcggcagagcttgagagatgctaacaatgtcttgcagagttgggatcccactcttgttaatccctgtacatggttccatgttacgtgtaacaatgataacagtgttatcagagttgaccttggaaatgcacaattatcaggtgtactagtcccccagcttggtcagctgaaaaatctccaatatttggagctttacagcaacaacataagtgggacaataccccctgaactgggcaacctaactaacctggtcagtttggatctgtatatgaacaacttctctggctatattccggacagccttggaaacctattgaagctgcgtttcctccgtcttaacaacaacagcttggttggtaaaattcctgaatccttgaccaatatctccactctccaagtactggatctttcgaacaacaacctctcaggacaagtcccgtcgactggttccttttcactcttcactccctatagttt

SEQ ID NO: 38280 - protein, 196 aa, Panicum virgatum
  misc_feature: Ceres CLONE 1993239
  misc_feature (28)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAAAAMRWWAAVALAVAVALGPGRVVANTEGDALYSLRQSLRDANNVLQSWDPTLVNPCTWFHVTCNNDNSVIRVDLGNAQLSGVLVPQLGQLKNLQYLELYSNNISGTIPPELGNLTNLVSLDLYMNNFSGYIPDSLGNLLKLRFLRLNNNSLVGKIPESLTNISTLQVLDLSNNNLSGQVPSTGSFSLFTPYS

SEQ ID NO: 38281 - DNA, 707 bp, Panicum virgatum
  misc_feature: Ceres CLONE 1993245
  misc_feature: Encodes the peptide sequence at SEQ ID NO. 38282
aaaaaccaggttagtgctcagacttgtctttcaagtgtactttctcctagctagtgttctagcaacccgcttcatcttgccttgaatctctggactgtgacaagaacacctttaaccttctctcagcttcattatttgtgttcctcggagcgtttcttcctggatttttttcagacttttcctcactatcttaatcgccagaacagtgcgccgggatctgactcctgatgtaaaaacagagctaacatggacgatgagtctggcggacataataagccagagaagagcatattacacaatcaacgtttgaatctacagagtctttcattaaaagatatgagagaggtcacaaatgatttctctgatgagaggctacttggacaaggtggttttggtagggtgtataagggagttctagcaaatggggatacaatagctgtgaagaagcttacatggacaacgtcaggacttcaggataagcaatatgagaacgaagcccgtcatctcatgaggcttaaacatccaaacatagtgcaacttgtaggatactgttctgaaacagagaaggaacttgtacaactgcccaacgggaaatacgtttatgctgagaagtcagaaaggctgctttgcttggagtacatgcctaatggaagcctctgcaagcatctttccgatgcatcttctggacttgattgggatacacgcta

SEQ ID NO: 38282 - protein, 153 aa, Panicum virgatum
  misc_feature: Ceres CLONE 1993245
  misc_feature: SWISSPROT Homolog: EC 2.7.11.1 Non-specific serine/threonine protein kinase
MDDESGGHNKPEKSILHNQRLNLQSLSLKDMREVTNDFSDERLLGQGGFGRVYKGVLANGDTIAVKKLTWTTSGLQDKQYENEARHLMRLKHPNIVQLVGYCSETEKELVQLPNGKYVYAEKSERLLCLEYMPNGSLCKHLSDASSGLDWDTR

SEQ ID NO: 38283 - DNA, 128 bp, Panicum virgatum
  misc_feature: Ceres CLONE 1993247
  misc_feature: Encodes the peptide sequence at SEQ ID NO. 38284
accagataggccgcctgccgcccaggatcatgatcgagctaatcctaaacctgatcactctgtttactatcatccaaccttaaatccatctggagcacctccacttcgaaaacctcccatgtactaat

SEQ ID NO: 38284 - protein, 41 aa, Panicum virgatum
  misc_feature: Ceres CLONE 1993247
  misc_feature: Useful for making plants with modulated flowering time
PDRPPAAQDHDRANPKPDHSVYYHPTLNPSGAPPLRKPPMY

SEQ ID NO: 38285 - DNA, 667 bp, Panicum virgatum
  misc_feature: Ceres CLONE 1993250
  misc_feature: Encodes the peptide sequence at SEQ ID NO. 38286
aacaaagagggccttccctctcctaagtttgcctcgcacctctctctcgcgagccgccgccgccttcttcgccggcgtcgacgatggccgactacggccacggcgggggtcagatgcggggcaacccggactctcgccccaggggccaggggcagcgccccaacgtccagcagctcaagctcatggggcagatccacccgacggggctcacgcccaacctgctcaagctcttcgagccgcggccgccgctcgagtacaagcccccgctcgagaagcgcaaattgccggcatacacagggatggctcagtttgtgtcgcaatttgccgagcctggggatcctgaatatgctccccccgtgcccacgtgtgagacaaaggctgaaaagaaggctaggattcgcaataataagctcgaacaaggtgcagctaaggttgctgaagagcttcagaagtatgacccgcagagtgatcccaatgccactggtgacccatacaaaacactctttgttgcaagacttaactacgagatgtctgaacacaagattaaacgggagtttgaagcttatggtcctattaagagggttcggcttgtaactgagaaggatacaagtaaacctagaggatatgctttcatagagtacatgcacacacgtgacatgaaaaaatg

SEQ ID NO: 38286 - protein, 194 aa, Panicum virgatum
  misc_feature: Ceres CLONE 1993250
  misc_feature (140)..(194): Pfam Name: RRM_1 Pfam Description: RNA recognition motif. (a.k.a. RRM, RBD, or RNP domain)
MADYGHGGGQMRGNPDSRPRGQGQRPNVQQLKLMGQIHPTGLTPNLLKLFEPRPPLEYKPPLEKRKLPAYTGMAQFVSQFAEPGDPEYAPPVPTCETKAEKKARIRNNKLEQGAAKVAEELQKYDPQSDPNATGDPYKTLFVARLNYEMSEHKIKREFEAYGPIKRVRLVTEKDTSKPRGYAFIEYMHTRDMKK

SEQ ID NO: 38287 - DNA, 600 bp, Panicum virgatum
  misc_feature: Ceres CLONE 1993255
  misc_feature: Encodes the peptide sequence at SEQ ID NO. 38288
aattttccgcgctgcgcttgtagacatctatccagccgagcgcacctggatggtgtacgatctcctgctggtcgccttggcggccgtctccgccacgccggtgctccgccgatacctcacgctgctccgcggcggcctccccaagggcatcttcagctggcccctcatcggcgagaccatcagcttccttcacgcgcacccgtccaacaccgccggccggttcctcaaggatcacctcgccaggtacaggacggtgttcaagtctcacctcttcggctcgacggaggtggtctcctgcaacgaggagctctatccatttcgtgctgcacgacgagcagctcctgttcgagtgcacctaccccggcgccgtccacaccatcctacgccagtcctccgctctggtggtcactggcgagcgccaccgtcatatccggagcatgttcctcgccctcgtcgcctccacggggctcagcgcctcctacgtcaccaccgtcgacaagtccgaccgctccctcatcgcctcctgccgcggctgccagaccatcaccttctgctaggaggccacgaagttccccaacgagctgatcatggagcaggtgc

SEQ ID NO: 38288 - protein, 183 aa, Panicum virgatum
  misc_feature: Ceres CLONE 1993255
  misc_feature: SWISSPROT Homolog: EC 1.14.13.77 Taxane 13-alpha-hydroxylase
MVYDLLLVALAAVSATPVLRRYLTLLRGGLPKGIFSWPLIGETISFLHAHPSNTAGRFLKDHLARYRTVFKSHLFGSTEVVSCNEELYPFRAARRAAPVRVHLPRRRPHHPTPVLRSGGHWRAPPSYPEHVPRPRRLHGAQRLLRHHRRQVRPLPHRLLPRLPDHHLLLGGHEVPQRADHGAG

SEQ ID NO: 38289 - DNA, 662 bp, Panicum virgatum
  misc_feature: Ceres CLONE 1993267
  misc_feature: Encodes the peptide sequence at SEQ ID NO. 38290
agcgaataatccccgcgagagcgagctcctcgccaccccggccatggaggactggctcttctacgccctcaccacgctcctccgctgcctgctctgcttgctcctgctgcgcgcccgcgccagcagctcggccgggggcaagggccattccgccggcggcgcgctcccgcctcttccgccggggccaacgccgctgccactggtgggcccgctgctcttcctgttgcgccctgacttggacgtcgaggccgtgctccgccgcatcgcgcgggagcacggcccggtcttcacctacgcgccgctgggcaaggcgctgcccaccatcttcgtggcctcccgcgccgcggcgcaccgcgcgctcgtgcagcgcggcgcggcgttcgcgtcccgcccggcctccagcgccgtggtcaacgccggcggcatcatcttctcgccctacggcgccacatggcgcgcactgcggcggaacctcacggccggcgtgctcaacccgtcgcggctccgggtcttctcccccacgcggcggcgggtgctcagcatcctcgcctctcgcttccgcgccgccggcgccggcggggagcgccccgtcgctgtgatggagccattccagcacgccatgttccgcctgctcatgtgcatgtgcttcggggaccgcgtcg

SEQ ID NO: 38290 - protein, 206 aa, Panicum virgatum
  misc_feature: Ceres CLONE 1993267
  misc_feature: SWISSPROT Homolog: EC 1.14.14.1 Unspecific monooxygenase
MEDWLFYALTTLLRCLLCLLLLRARASSSAGGKGHSAGGALPPLPPGPTPLPLVGPLLFLLRPDLDVEAVLRRIAREHGPVFTYAPLGKALPTIFVASRAAAHRALVQRGAAFASRPASSAVVNAGGIIFSPYGATWRALRRNLTAGVLNPSRLRVFSPTRRRVLSILASRFRAAGAGGERPVAVMEPFQHAMFRLLMCMCFGDRV

SEQ ID NO: 38291 - DNA, 1509 bp, Panicum virgatum
  misc_feature: Ceres CLONE 1993278
  misc_feature: Encodes the peptide sequence at SEQ ID NO. 38292
atctcctcctccccttcaaccaccgcgaggtctccagctgcgtcgcgcgcgcattcgtcagatccagaaccgagccgagcccccggccgagatccagctagctccctagcgagcttcgggccgagcagcagcggggatcggggagaggggggcaaaggatgaagcggaggacgcggaacaagatcatcctctggtcgctggccgtgacggcggtggcggtgctggtgggcggcacgatcgcgctggtgctgacggcggggacgtggaaggccaagctgaaggagtcgcaggagaagatctgcaacaaggggtgggagtgctcggggagcaagtactgctgcaacgacaccatcaccgacttcttcaaggtgtaccagttcgagaacctcttcgccaagcgcaacacccccgtcgcgcacgccgtcggcttctgggactaccaggccttcatcaccgccgccgcgctcttcgagccgcaggggttctgcaccaccggcggcaagcagatgcagatgatggagctctgcgccttcctcggccacgtcggcgccaagacctcctgtgggtatggcgtggcgaccggcgggccgacggcgtgggggctctgctacaaccacgagatgagccccgaccagacctactgtgacaagacctacacccagtacccctgcgtcgagggcgcagagtactacggccgcggcgccatccccgtctactggaactacaactacggtgcggcgggtgatgggatcaaggaggacctgttgcaccaccccgagtacttggagcagaacgcaacgctggcattcatggcggcaatgtggcggtggatgacaccgatcaagaagggccagccatcagcgcacgaagcctttgtgggcacctggaagcccaccaagaatgacacgctcagcaagcgcctgcctgggttcggagccaccatgaacatactctacggcgaatcaatctgtggcaggggatacatcgacgccatgaatgtcatcatctcgcactaccagttctaccttgacctcatgggggttggccgtgagcactctggaaacaaccgcgactgcgctgagcaggccccgttcaatccctccagcaagtcagatgaccagcagcagcagcaatcaggaagctagaacggacccattaccgcggcacacgtgttgtacacctgttcttgccattgccactgatcaagcttcctgcgccacagtaagctgctgattcttcagaatgtgtgaagctgctttggattgatgttgttttgagtggctgatcagaatactgtatgtgctgtctatgggaattgggaaatttgtagccattgtaccatggtgtccatagatagtctgtttttgtttccttgattttgtcagatacaacatacatgtgttaaagatgatggttaaaactgaacgtagccaggcttattttctgaacttatgcctgctccgaaatatgtttaaagaggattcaattgaacataccttgacttcctct

SEQ ID NO: 38292 - protein, 328 aa, Panicum virgatum
  misc_feature: Ceres CLONE 1993278
  misc_feature (68)..(306): Pfam Name: Glyco_hydro_19 Pfam Description: Chitinase class I
  misc_feature: SWISSPROT Homolog: EC 3.2.1.14 Chitinase
  misc_feature: Useful for making plants with modulated water use efficiency
  misc_feature: Useful for making plants with altered cell wall content and/or composition
MKRRTRNKIILWSLAVTAVAVLVGGTIALVLTAGTWKAKLKESQEKICNKGWECSGSKYCCNDTITDFFKVYQFENLFAKRNTPVAHAVGFWDYQAFITAAALFEPQGFCTTGGKQMQMMELCAFLGHVGAKTSCGYGVATGGPTAWGLCYNHEMSPDQTYCDKTYTQYPCVEGAEYYGRGAIPVYWNYNYGAAGDGIKEDLLHHPEYLEQNATLAFMAAMWRWMTPIKKGQPSAHEAFVGTWKPTKNDTLSKRLPGFGATMNILYGESICGRGYIDAMNVIISHYQFYLDLMGVGREHSGNNRDCAEQAPFNPSSKSDDQQQQQSGS

SEQ ID NO: 38293 - DNA, 1412 bp, Panicum virgatum
  misc_feature: Ceres CLONE 1993286
  misc_feature: Encodes the peptide sequence at SEQ ID NO. 38294
catcacctccaccaccacattcattcattcgttcaggcatcaccttttcttttctaaacccgaccaacttattctttctttgtcaatcgctagtcctttcattgtcgtcactttccacaagttgactcgacccccccaataagtccactttgtttgcctctggtccagtgatccgacgactgtgtcgttgccttcggtttctcctaaactcactggtcaccaagtcacgccatccgctcagccatcctgcgcccggtccagctctcaaaccagcctgctcgcgcaaggacctcgagacacttctttacatctcacatcgccctcggcctctgcattctctgataatccgaatcgattccattcggagtctctgttgactcccttcgccagaaacaccgaaccctcaggattcttcatgcaatcgtacggctctctccattcaccatctttgaaaaagtacgacaacatggtggaatatcgaagagcctccagcttcaacttcggcaacattgtcggtgatcccttcgcgttggccacaatttctatcagcctgcttgcatggctcatagcattcgtttcctccatcattgcaaccgtccaaggcgatttccctaaatatgcttggtggactgctgcctacctattatgctgtatagtgggcgtcacgttcgtcttcgcaaccaacaccagccatgtttacagtatcgccgtggtcggctatctcgccgcaggaatggtgatgaccacatcctcggtcaatttcctagtttaccaaccccagggggcaatggaagctgctgctgcaggtcacatcttgctctccattgttgccattatctggatcttttactttggttccacacctgctgcctcccaccgaatcttcattgatcagttcgccctcaacaaagaaggtggtgactttcgtggtccagcccaaaacatgaccaacgtgtacaatcgatcagacacaacccaacccgcccaacccccacagatgtacacctctgctcaactaaatgggttcgaaacttcctctccagtttccggttacccaggtgggcccgcaggctcggcagctcgtgcctcagcacagcccccggccaacccagccagtgctcctgtatctgcccctgcgaccgaggctcctcagcccacagaatacccttaccgtgctaaggccatttacagctacgaggcaaaccccgacgatgccaatgaaatcagtttcagcaagcacgaaatcctcgaagtttcagacgtaagtggccgatggtggcaagcgaagaaggaaaacggcgacactggtatcgcccctagcaactatttgatcttgttatgaggtcgtgcgcatcaactctgaaaaccaccaacacacaaaagaccagatatgaaagtgggtgatgagcgat

SEQ ID NO: 38294 - protein, 308 aa, Panicum virgatum
  misc_feature: Ceres CLONE 1993286
  misc_feature (252)..(308): Pfam Name: SH3_1 Pfam Description: SH3 domain
MQSYGSLHSPSLKKYDNMVEYRRASSFNFGNIVGDPFALATISISLLAWLIAFVSSIIATVQGDFPKYAWWTAAYLLCCIVGVTFVFATNTSHVYSIAVVGYLAAGMVMTTSSVNFLVYQPQGAMEAAAAGHILLSIVAIIWIFYFGSTPAASHRIFIDQFALNKEGGDFRGPAQNMTNVYNRSDTTQPAQPPQMYTSAQLNGFETSSPVSGYPGGPAGSAARASAQPPANPASAPVSAPATEAPQPTEYPYRAKAIYSYEANPDDANEISFSKHEILEVSDVSGRWWQAKKENGDTGIAPSNYLILL

SEQ ID NO: 38295 - DNA, 1869 bp, Panicum virgatum
  misc_feature: Ceres CLONE 1993287
  misc_feature: Encodes the peptide sequence at SEQ ID NO. 38296
acacacgaaggcctgcagacatcgaacaatcacacacagtgccggccatggggttcgaggtgcggaggacgagccggtcgtacgtgcgcccggccgcggcgacgccggcgggctcgctggagctgtccgccattgaccgcgtggtggggctgcgccacatggtgccgtcgctgaacgtgtacccgccgcgcggctgcggcgccgccgccggcgaggggcagctgcagcagcagtccccggcgagcgtggtccgggaggcgctggggaaggcgctggtggactactacccgctcgccgggcggctcgtcggcgggcccggcgggccggcgagcgcccgcgtggagtgcaccggcgagggcgcgtggttcgtggaggccgtcgccgggtgcagcctggaggacgtcgggcgcctcgagaagtacccgttcgccatcccggagggcgacctgctcccggacgaggcgcctggtgtgcagccactcgacctccctctcatgatgcaggtgaccgagttcacgtgcggtggcttcgtggtggggatgacctccagccacgccatcactgacggcctgggcgctgggcagttcatcaccgccattggcgactacgcccgcggtctccccaagccccgtgtcactcccatctggtcccgcggcgagctcatcccaaacccgcccaagaagctcctctccggccctcttcccacgccgcggacgttccaactccggcacctcaccgtggacctgagctccgacagcatcgagcgtgccaagtcccagttcctgcagtccacggggcggcgctgctccaccttcgacgtcgccgtcgccaggctgtggcaggcgcggacgcggtcgctgcggctcgcggacccgtcgacgcgcgtcagcctcggcttcttcgccgacgctcgccgcctcctgcgcggcggcggcggcgccgccgggttctacggcaactgcttctacacggtgacggtgagcgcagagagcggcacggtggcgggcgcggacacggccggcgtggtcgccatgatccgggacgccaaggcgcggctccccgccgagttcgcgcggtgggcggcggggaagcgcgtggagccggacccctacgacctgagcttctcgtacgagtcgctgttcgtgtcggactggacccgcctggggttggacgccgactacggctgggggacgccgtcgtaggtgatatcctttgcgttcgtcccgttcatgcccaaagccattatcggcgcgccgccggcgcccaaggcgggggcaaggatcatgacacggtgcgtcgaggaggagaacttgccggagttcagggacgagatggaagcattctagaactcacaccactatgcatgctttgatataggggatgctctgatgatatatgaggatgctctgatacaagtgatcaaatttgaagtcagaaaatcaaacgaaatataatttgaaacagagagagtacctgctacctcatgctcgttgacattgtatctcatgtccagcattgcttgtggacttgtggttgtggtgtagtggttagaggtggtccaagattttgaactataaaatctaagagccggactcttaaaggattggactctaatataatataatttgaaactaataaattaaagagttttgttgggctgtgaagagatactagggccatggcctattaccacccctagtagtggtacgtgcgtgatgcacatacgcttcatcatgcgctagtgttttagcgggtttgggctgtatcttgggcattgtaatgagatacagtttgtaataagatacggtttgtaccgaggtctatttatggctttattaaaggaagaacaatccaagattgcttggctct

SEQ ID NO: 38296 - protein, 384 aa, Panicum virgatum
  misc_feature: Ceres CLONE 1993287
  misc_feature (3)..(384): Pfam Name: Transferase Pfam Description: Transferase family
  misc_feature: SWISSPROT Homolog: EC 2.3.1.167 10-deacetylbaccatin III 10-O-acetyltransferase
MGFEVRRTSRSYVRPAAATPAGSLELSAIDRVVGLRHMVPSLNVYPPRGCGAAAGEGQLQQQSPASVVREALGKALVDYYPLAGRLVGGPGGPASARVECTGEGAWFVEAVAGCSLEDVGRLEKYPFAIPEGDLLPDEAPGVQPLDLPLMMQVTEFTCGGFVVGMTSSHAITDGLGAGQFITAIGDYARGLPKPRVTPIWSRGELIPNPPKKLLSGPLPTPRTFQLRHLTVDLSSDSIERAKSQFLQSTGRRCSTFDVAVARLWQARTRSLRLADPSTRVSLGFFADARRLLRGGGGAAGFYGNCFYTVTVSAESGTVAGADTAGVVAMIRDAKARLPAEFARWAAGKRVEPDPYDLSFSYESLFVSDWTRLGLDADYGWGTPS

SEQ ID NO: 38297 - DNA, 693 bp, Panicum virgatum
  misc_feature: Ceres CLONE 1993301
  misc_feature: Encodes the peptide sequence at SEQ ID NO. 38298
actcatgttcttcttcttcctccgagcttctgcatccatcagcaatggagagtcaacgcagcagcaacggtagagaagaacccctcaacggtagtcctcacctcaaagccccactcaacacgctccatgtcgaccgctgcacccccgcgcaccgcgtgcacgcgctcctctacgccggcgccatcctcggcctggtgtgccgttttgcagggagaatggcgtgcaggtgcggtcgccggaggtgttctttgcttcttcttcttcttcttcttctggatgttctgccggtggcggcgatacggataagctgaaggtgatgtaccaaaacatggtacagagggtggaggatgtgatggagaaaggcatccatgtcgacagtgtcgaattggacttgtctgaagaacaacaacagatttttaaaaggtggaaagaatattctggcaacaaccatccatcaattattcaggttcttcttaaaagcaatgaggataaagatattaccgggcaagccatgcccaatctgatttacttttcaagggagaagcgtcctggttttcctcaccacttcaaagctgggtcccttaattctctgctccgtgcctcgagcatcctaacaaatgcaccattgatcctaacaatcgactgtgacatgtactccaccgacccgacctcacctcaacgcgcactatgcta

SEQ ID NO: 38298 - protein, 125 aa, Panicum virgatum
  misc_feature: Ceres CLONE 1993301
  misc_feature: SWISSPROT Homolog: EC 2.4.1.12 Cellulose synthase (UDP-forming)
MYQNMVQRVEDVMEKGIHVDSVELDLSEEQQQIFKRWKEYSGNNHPSIIQVLLKSNEDKDITGQAMPNLIYFSREKRPGFPHHFKAGSLNSLLRASSILTNAPLILTIDCDMYSTDPTSPQRALC

SEQ ID NO: 38299 - DNA, 1873 bp, Panicum virgatum
  misc_feature: Ceres CLONE 1993306
  misc_feature: Encodes the peptide sequence at SEQ ID NO. 38300
gccccccaggcagggtgaagaggaagaaccagaagaaggcaagtggtggtggcggcgacggcggtgatgaggatgaggagtgaggatgaaccagtagccgttacctgatataatattatctagttgtcataaacatgttggtatcttgagctcttagctgtgtggcctgatgctcagccccttgtgctgactgggcatcacggatggttatcgttttatcttgcagtgttattagcctatacctagctgctatgttttgagatgtttattcaagttgcgtttcgacttctgttgtcatcaaagctgtacctgttttctctgcaaaaaaaaggaaggatcctaccaaacctaccaactcctcctcctcgaccgatcgcccgcgcaaaggggaaacctaaaaaaaaaactaactcgccattcgccaactagctagcttaactttctctccgcttcgggcgccaccgcgatcgtgcgaggtttcgtgaagacaccagagagtagtagcgggggtgttgaggaactgatctgatcgtcgatcgtgaagacgatgaccgtggtcgacgccgtgtcgtccgcgggcgccggcgacgccgtcgcgcccgccgccgacgccgcggggcagccgccggctgcggggaacgggcagacggtgtgcgtcaccggcgcggccgggtacatcgcgtcgtggctcgtcaagctgctgctcgagaaggggtacactgtcaagggcaccgtcaggaacccagatgacccgaagaacgcgcacctcaaggcgctggacggcgccgccgagcggctcttcctctgcaaggccgacctcctggacttcgacgccatctgccgcgccgtggagggctgccagggcgtcttccacaccgcctcccccgtcaccgacgaccccgagcaaatggtggagccggcggtgcgcggcacggagtacgtgatcagggcggcggcggaggccggcacggtgcggcgggtggtgttcacgtcctccatcggcgccgtcaccatggaccccaaccgcgggcccgacgtggtggtcgacgaatcctgctggagcgacctcgacttctgcaagaaaaccaggaactggtactgctacggcaaggcggtggcggagcaggcggcgtgggatgcggcgcggcagcgcggcgtggacctggtggtggtgaacccggtgctggtggtgggcccgctgctgcagccgacggtgaacgccagcatcgcgcacatcctcaagtacctggacggctccgcccgcaccttcgccaacgccgtgcaggcctacgtcgacgtccgcgacgtcgccgccgcgcacctcctcgtcttcgaggcccccgccgcctccggccgccacctctgcgccgaccgcgtcctccaccgcgaggacgtcgtccgcatcctcgccaagctcttccccgagtaccccgtccccaccaggtgctccgacgaggtgaacccgcggaagcaggcgtacaagttctcgaaccagaagctccgggacctggggctggagttccggccggtgagccagtcgctgtacgacacggtgaagagcctccaggagaagggccacctgccggtgctcgccgagcaggcgcccgagctggaggccgagaaggaggccgccgcccccgccgccgaggtgcagcagggcgggacgatcgccatccgtgcgtgaggtccaggcagatggcgccacgaatgaacagaatgcaagccatgttcatatgctgccccggccggtgcccctgatgtgtaacccaagtagtagtgtttgttgcctgtctgatgcccctaccaagacttgtaacgtcgtgctgctcgtccttgtgaactatagtgggtgaataaatatggttaattcccc

SEQ ID NO: 38300 - protein, 378 aa, Panicum virgatum
  misc_feature: Ceres CLONE 1993306
  misc_feature (35)..(275): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature: Useful for making plants with altered carbohydrate content
  misc_feature: Useful for making plants with altered cell wall content and/or composition
  misc_feature: Useful for making plants with altered lignin content
MTVVDAVSSAGAGDAVAPAADAAGQPPAAGNGQTVCVTGAAGYIASWLVKLLLEKGYTVKGTVRNPDDPKNAHLKALDGAAERLFLCKADLLDFDAICRAVEGCQGVFHTASPVTDDPEQMVEPAVRGTEYVIRAAAEAGTVRRVVFTSSIGAVTMDPNRGPDVVVDESCWSDLDFCKKTRNWYCYGKAVAEQAAWDAARQRGVDLVVVNPVLVVGPLLQPTVNASIAHILKYLDGSARTFANAVQAYVDVRDVAAAHLLVFEAPAASGRHLCADRVLHREDVVRILAKLFPEYPVPTRCSDEVNPRKQAYKFSNQKLRDLGLEFRPVSQSLYDTVKSLQEKGHLPVLAEQAPELEAEKEAAAPAAEVQQGGTIAIRA

SEQ ID NO: 38301 - DNA, 1743 bp, Panicum virgatum
  misc_feature: Ceres CLONE 1993332
  misc_feature: Encodes the peptide sequence at SEQ ID NO. 38302
ggaggagcgctgcagtgccggcctgacggcctgtctcttccctgctgctgctgctgccggtggctccgttctcggcctccccccggccatgtcctccatggatgagggctacggccctacttgggacagcgacgacgaatacgacaacttcatacgcaagatgaacccgccgaggattgtgatagataacgagtcctcagcagaggccacaattgtcagggtggatagcgcaaatgaatatgggatattgctagaagtgatccaagttatgattgatctcaaccttgtcataggcaaggcatatattacctctgatggtggatggttcatggatgtcttcaatgtgaccgataaggaagggaagaagatcaaagatgaggaaaccctggcgcagattgaagactacatcagaaagtccttgggcgccgattcaagatacataccttcaagacggagatcagtaggcgttgctgccgcagctgaccacaatgtcattgagttgacggggacggaccggccaggccttctctcagaagtcagcgcggtgcttgccagcctcaagtgcaatgtggtcagcgccgagatctggactcacaagaccagagctgcagccgtgatgcgggtcactgacgaggacaccgggctggctgtcacagatgccgagaggctggagaggatcagggagaggctttcatacctgctccggggaggcgacctctccaggggagctgccatggcggtgtcgtccgggactgccaccacgcacaccgagaggaggctgcaccagatgatgcttgacgacggcgactatgagcagctccagcggcaggctccagagcagtctcagaggcctaatgtcacagtgagaaactggaacgacaaggactattcggtggtgaccatccggtgtaaggacaggtccaagcttctgtttgacacggtttgcactctgacagacctgcaatatgttgttttccatgcaaacattgatgccaaggataatcaagcttaccaggaattctatgtaaggcatgtgaatggatcaccgatgaacactgaaactgagagattgcgagtcatccagtgccttgaagcagctattgaacggagggtatccgagggtgtcaagcttgagctgtgtactactgacaaggtcggcctgctatctgaggtcacccgcatcttccgtgagaacagcctgactgttactagagcagaggtgaccacaagaggcaggatggctgtcaacgcgttctacgtccgcggttctgcaggcgaggcggtcgatcagaagacaatagactccatcaggcaagccatcgggcagaacctccaggtgaaaggccagcctgagccaccggagccacagaagaacgagtcccccacatggttcctcttcgccaacttgttccggccgaggtctctctacagctttggtttgttcatgcgctgatcatatcgccgcgtcctgaaaaccaccatgtaaattcattagccatgaagcaaagttcaggaaaaccgggggatcagaaataacaagcgttctctcatcagctctagtagtgcaggatatattggggtctagatagcatatggggatgttcattcatatatcatggttctctgtaaatatagtcagtttcgccatcctcgtgttgtacatacatttagaatgtagataaaggacgtaaatataagctgtacagtacagaatatgattgaatcccagatggttaccacctc

SEQ ID NO: 38302 - protein, 454 aa, Panicum virgatum
  misc_feature: Ceres CLONE 1993332
  misc_feature (134)..(206): Pfam Name: ACT Pfam Description: ACT domain
  misc_feature (346)..(412): Pfam Name: ACT Pfam Description: ACT domain
  misc_feature: SWISSPROT Homolog: EC 2.7.7.59 [Protein-PII] uridylyltransferase
MSSMDEGYGPTWDSDDEYDNFIRKMNPPRIVIDNESSAEATIVRVDSANEYGILLEVIQVMIDLNLVIGKAYITSDGGWFMDVFNVTDKEGKKIKDEETLAQIEDYIRKSLGADSRYIPSRRRSVGVAAAADHNVIELTGTDRPGLLSEVSAVLASLKCNVVSAEIWTHKTRAAAVMRVTDEDTGLAVTDAERLERIRERLSYLLRGGDLSRGAAMAVSSGTATTHTERRLHQMMLDDGDYEQLQRQAPEQSQRPNVTVRNWNDKDYSVVTIRCKDRSKLLFDTVCTLTDLQYVVFHANIDAKDNQAYQEFYVRHVNGSPMNTETERLRVIQCLEAAIERRVSEGVKLELCTTDKVGLLSEVTRIFRENSLTVTRAEVTTRGRMAVNAFYVRGSAGEAVDQKTIDSIRQAIGQNLQVKGQPEPPEPQKNESPTWFLFANLFRPRSLYSFGLFMR

SEQ ID NO: 38303 - DNA, 261 bp, Panicum virgatum
  misc_feature: Ceres CLONE 1993333
  misc_feature: Encodes the peptide sequence at SEQ ID NO. 38304
agcagaaggctcgctcctctcctctcctctcctgctgcagtcccactagcgctcggatccaaccaagttccggccgtcgagcgcgcacgactgctgcctgcagacgacataacgccggcgcttcggtgtgtaactacaacaaggccctgagggtgggcccgcgcgggccgatcctgctggatgactaccacctgatcgattaggtgggccacttcgcccgtcagagcatcccgtagcccgtgggccacgcttgcggggcct

SEQ ID NO: 38304 - protein, 66 aa, Panicum virgatum
  misc_feature: Ceres CLONE 1993333
  misc_feature: SWISSPROT Homolog: EC 1.11.1.6 Catalase
QKARSSPLLSCCSPTSARIQPSSGRRARTTAACRRHNAGASVCNYNKALRVGPRGPILLDDYHLID

SEQ ID NO: 38305 - DNA, 630 bp, Panicum virgatum
  misc_feature: Ceres CLONE 1993347-R
  misc_feature: Encodes the peptide sequence at SEQ ID NO. 38306
ccagtcatagaattttcatcgacaagcctcaatgctgatttgtctgggctggcttgtccgaatgaggcacctttaatgttgaagaataaggcccctcgctggcatgagcagctgcaatgctggtgcctcaacttccgagggcgtgtcacagtggcatcagtcaagaacttccagcttgtagcctctgtggatccttcccttaacatcccagctgctgagcaggagaaagtaattcttcagttcgggaaaatagggaaggatatattcacgatggattataggtacccgctatcggcattccaggcattcgcgatctgcctgactagctttgataccaagccggcgtgcgaataaccgacagaggcagaagctgcggtatgagttctgttcatgtctgttcaggtagtacctgtttccttgatgatgtaaattctagattctactactagcccatgggaaattgcatcttatcaaatgaaggtgagcaatatcatctgtattgtggtaaaccgtaggaagattgagtaatcccttgtgaccaactggtgtgtattttcgttaaaatgcttagcagtgaaatatcactgtcgcgatgaaatatggatcgcctgcgttgtttcgcctgcgatg

SEQ ID NO: 38306 - protein, 117 aa, Panicum virgatum
  misc_feature: Ceres CLONE 1993347-R
  misc_feature (1)..(111): Pfam Name: Tub Pfam Description: Tub family
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 462 in the 10/666,642 US patent application
PVIEFSSTSLNADLSGLACPNEAPLMLKNKAPRWHEQLQCWCLNFRGRVTVASVKNFQLVASVDPSLNIPAAEQEKVILQFGKIGKDIFTMDYRYPLSAFQAFAICLTSFDTKPACE

SEQ ID NO: 38307 - DNA, 1467 bp, Panicum virgatum
  misc_feature: Ceres CLONE 1993347
acaagcgcacagaattcacaggagctgcagtgtggaagcgagggagagaggctgtgtgtgtgagagcggcccgcaagagaggagagattgagaatggaaggtggaagcaaatccttagcttagaggcaggcaaaggaggttattctccgatctggagctcctggggagaaggagctggatgaatcccatggagacggagaacaacggcgaaagagaggctccttgatctgttcttgagcgtagagatttgattttctaagctgtggagctggagatttagatcccagggccatccaacctgtgcttggtagctgcattgctgcctctctccagatccgagctggtgctcgaagaaaggtgggatctttgcttaccatctccacagatcggcgaaaaaaatctgggctctcgagctgttgttgggagagtaaggtgcttcaatcttctggagaagttgtttttttctccagttgggggtagatatgggagtgatggcgactactttctgagctgcccccttccattttggggggctagattcgtgctgtaatggcggatctcaccgtggagcagtaggttttctttcggcgaaggcgaaaggaacttgtcgtattagctgcaatgtctctgaagagcattgtgcgggagctcaaggagatgagggatggcatcgggagcatgtctaggcgcgccggcgccggcttggatgggcgcggcggccacggccgcgctggttcgcggcattcttggcctggcctgtgggcggagcagcagcagcctcagcggcaaggcctgggccaggaggagccgcaacagcagcaggggcggtgggctaacctgccgccagagttgctgctcgacgtgatacagagggtggaggccagtgaggcgacttggccggcgcggcgccaggtcgtggcctgtgctgccgtctgtcgttcttggcgggaggtcaccaaggaggtcgtgaaaacacttgaggagtgcggaagaatcacattccccatctccctcaagcagccggggcctcgggagcatcctgtgcagtgttttgtgaggagggacagagcaacatccacctatctcctctacctagggctcagtccatctctacatggggaaaatgacaagcttttgcttgcagctcgcaaggtcaggcgtgcggccaggacttcatttgtgatctcactggtccctgatgatttctctcattccagtagcacttatgttggcaaactgaaaccaaacttccttggcacaaagttcactatttttgatagccagcccccttctgatgctgtggtgctgccgaacaataaaccaagcaaaagacagtccaaacaagtatcaccaaggctgccactaggcaattacaatgttgctaccgtcacatatgagcttactgtcctacgcaacagaggaccaaggagaatgcaatgcaccatggactcaataccggctcagtgc

SEQ ID NO: 38308 - DNA, 656 bp, Panicum virgatum
  misc_feature: Ceres CLONE 1993348
  misc_feature: Encodes the peptide sequence at SEQ ID NO. 38309
actagtgtcgcgcgcagcaaaccagcagctcggcccgcaggcccgcagcactagtgccatggaggaggaggcggcgcgggcgccgctgctgcagccgcagccgcgcggcgaggcggcggggggcggcaccaaggcggggcgcgcgaggcgggcggcggcggagtggtgggtggagtcgaagaagctgtggcgcatcgtggcgccggccatcttccagcggatcgcgctgtacgcgatcaacgtcgtcacgcaggccttcatcggccacctcggcgacctcgagctcgccgccttctccatcgccgccaccgtcgtcgccggcttcaacttcggattcctgctgggcatggcgagcgcgctggagacgctgtgcgggcaggcgttcggtgccaagaagtaccacatgctgggggtgtacctgcagcgctcgtggatcgtgctgctcatcttcgccgcggcgctgacgccgacctacatcttcatggaggacctgctgctgctgatcgggcagtcgccggagctgtcgcgcctggcggggcagatgagcgtgtggctgctcccgcagcacttcgccatggcgatgctgctcccgctcacgcggttcctgcagagccagctcaagaactgggtcaccgccgccaccgcgggcgccgcgc

SEQ ID NO: 38309 - protein, 199 aa, Panicum virgatum
  misc_feature: Ceres CLONE 1993348
  misc_feature (49)..(199): Pfam Name: MatE Pfam Description: MatE
MEEEAARAPLLQPQPRGEAAGGGTKAGRARRAAAEWWVESKKLWRIVAPAIFQRIALYAINVVTQAFIGHLGDLELAAFSIAATVVAGFNFGFLLGMASALETLCGQAFGAKKYHMLGVYLQRSWIVLLIFAAALTPTYIFMEDLLLLIGQSPELSRLAGQMSVWLLPQHFAMAMLLPLTRFLQSQLKNWVTAATAGAA

SEQ ID NO: 38310 - DNA, 707 bp, Panicum virgatum
  misc_feature: Ceres CLONE 1993361
  misc_feature: Encodes the peptide sequence at SEQ ID NO. 38311
ctaagtaagcaaggaagcagacactccattcgctttcagaactcactactagccaagccagtactagtcctcagaagagagcaaagaggaggaagaagacgatggtgtctgctaccgtgctcaagtcctctttccttcccaagaaggccgaatggggcgccacccggcaggccgccgctcccaggccggccaccgtctccatggtcgtccgcgccagcgcctacgccgatgagctcgtcaagaccgcgaacacgatcgcgtcgccggggcggggcatcctggccatggacgagtcgaacgcgacgtgcgggaagaggctggcgtccatcgggctggagaacacggaggccaacaggcaggcgtacaggacgctgctggtgacggcgccggggttgggccagtacatctcgggcgccatcctgttcgaggagacgctgtaccagtccaccgtggacggccgcaagatcgtggacgtgctcgtggagcagggcatcgtgcccgggatcaaggtcgacaagggcctcgtcccgctcgccggctccaacaacgagtcctggtgccagggcctcgacggcctcgcctcccgtgaggccgcctactaccaggctggcgcccgcttcgccaagtggcgcaccgtcgttagcatccccaacgggccctccgagctcgccgtcaaggaggccgcctggggactcgcccgctacgcc

SEQ ID NO: 38311 - protein, 201 aa, Panicum virgatum
  misc_feature: Ceres CLONE 1993361
  misc_feature (44)..(201): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
MVSATVLKSSFLPKKAEWGATRQAAAPRPATVSMVVRASAYADELVKTANTIASPGRGILAMDESNATCGKRLASIGLENTEANRQAYRTLLVTAPGLGQYISGAILFEETLYQSTVDGRKIVDVLVEQGIVPGIKVDKGLVPLAGSNNESWCQGLDGLASREAAYYQAGARFAKWRTVVSIPNGPSELAVKEAAWGLARY

SEQ ID NO: 38312 - DNA, 664 bp, Panicum virgatum
  misc_feature: Ceres CLONE 1993369
  misc_feature: Encodes the peptide sequence at SEQ ID NO. 38313
aaccacccccaccgcggcgacgcatcatcatccactctcaatacccacctcagctcagctcattcctcccaggctatcaccacctgacctgatcacacgccccgcaatcgcatacgacgacgacgaggatgccgccgaggccgtggcgaccggtgctggcgtcggccaccaagtgctgcgcggcggaggacgccgcggtggcgcccgacggcctggcgcgctgccgcccgcagcagtcggagctctcgcgccggctcgcctccttccggcgcctctcgtcgctggccaacagcccggcctctgccgccgcggcgggcggcggcaaggacggcggcgaggcggaggcgggggcggcggccggggagatggcgggcccgctgcagctgcaagcgttcgggctgggcgagctccgcggcgtcacgcacgacttctccgccagcttcctgctgggcgagggcggcttcggcgccgtgtacaagggcttcgtcgacgccggcatgcgcccgggcctcgccgcgcagcccgtcgccgtcaagcagctcaacgccgggggcttccagggccaccgggagtggctcgccgaggtcatcttcctgggccagttccggcacccgcacctcgtcaggctgctgggctactgctgcgaggacgaggagcgcctgct

SEQ ID NO: 38313 - protein, 178 aa, Panicum virgatum
  misc_feature: Ceres CLONE 1993369
  misc_feature: SWISSPROT Homolog: EC 2.7.11.1 Non-specific serine/threonine protein kinase
MPPRPWRPVLASATKCCAAEDAAVAPDGLARCRPQQSELSRRLASFRRLSSLANSPASAAAAGGGKDGGEAEAGAAAGEMAGPLQLQAFGLGELRGVTHDFSASFLLGEGGFGAVYKGFVDAGMRPGLAAQPVAVKQLNAGGFQGHREWLAEVIFLGQFRHPHLVRLLGYCCEDEERL

SEQ ID NO: 38314 - DNA, 165 bp, Panicum virgatum
  misc_feature: Ceres CLONE 1993375
  misc_feature: Encodes the peptide sequence at SEQ ID NO. 38315
agtcccgcctcggccccccgagccgcaatggaccccgtggccacatggtggtctgacaccgctcgagcgcgccgacacggaaggctaccacctcctggaatgcgacaatcggcgccagcggcgcggcatcgagctaatcgcctccgagaatttcacgttcgtccc

SEQ ID NO: 38315 - protein, 54 aa, Panicum virgatum
  misc_feature: Ceres CLONE 1993375
  misc_feature: SWISSPROT Homolog: EC 2.1.2.1 Glycine hydroxymethyltransferase
VPPRPPEPQWTPWPHGGLTPLERADTEGYHLLECDNRRQRRGIELIASENFTFV

SEQ ID NO: 38316 - DNA, 1211 bp, Panicum virgatum
  misc_feature: Ceres CLONE 1993387
  misc_feature: Encodes the peptide sequence at SEQ ID NO. 38317
ggagccacaccagaccagaccagccccttggatggccttagcgaatggcacagcccacggtttcgctaccaccacctcctcctcctgcttatagtcgcgtgccgccgcgcctgtccctcccccatcgctgccgctcccctttcttcttcctcctcccaccgcgtccttatcgctaccttctttctccaattcctcgccgctgctgccaaaagatcgcttttttcgtggggctattcagttgctgccgcccagttggtacggtgagtgatccatggaggtgattgctgggggagtgggggtgccggagcccgccgccacggcggcggccgcggccggggagcgcgcggccaagcggcggcgggtcgccggcgcggagccggcgccggcgggggcgacgcgggccggaggagcggtggcgcggcgcgggaggcggcggcgcgtgcaggcggacgcggacgccgccgccgtgcagcgcctcttccaggcatgccggggcgtgttcaggggcctcggcaccgtgcccatgcccgacgaggtccggctgctccgcgccatgctcgacagcatgaagccggaggatgtcggcctaagcccggatctcaagttcttcaggactagagatgctgctcaaggaaccacccccacaattacacacacgacaatatacaaatgcccaaatttctcgatggttatcttatttttgccgcggaatgcggtcatccctctccacaatcaccctggaatgacggtgttcagcaagctgctcctcgggtccatgcatataaagtcatatgactgggttgatcctgattctgcagatccctcagtgaccagctgttcatcgcaagctgatgatcaattgagattggcaaaactggtagtcgatgatgtttttacggcgccgtgtgacacctcagtactgtatccgacgactggaggaaacatgcatcgatttactgccattgcgccttgcgcaatcctcgacattcttggccccccgtactccatagaagaggacagggattgcacatactacagcgatattccgtatgcgcaacattcgagtaagtagccacattttttacctctgatgaaatctgaatactttgtgcatccactaatcactagtagctcttaatttagacaaacgttcagtaccgctgtttgccacttgaaagacatgtcgctgttccaactagattcaaaaggcc

SEQ ID NO: 38317 - protein, 266 aa, Panicum virgatum
  misc_feature: Ceres CLONE 1993387
  misc_feature: SWISSPROT Homolog: EC 1.13.11.19 Cysteamine dioxygenase
MEVIAGGVGVPEPAATAAAAAGERAAKRRRVAGAEPAPAGATRAGGAVARRGRRRRVQADADAAAVQRLFQACRGVFRGLGTVPMPDEVRLLRAMLDSMKPEDVGLSPDLKFFRTRDAAQGTTPTITHTTIYKCPNFSMVILFLPRNAVIPLHNHPGMTVFSKLLLGSMHIKSYDWVDPDSADPSVTSCSSQADDQLRLAKLVVDDVFTAPCDTSVLYPTTGGNMHRFTAIAPCAILDILGPPYSIEEDRDCTYYSDIPYAQHSSK

SEQ ID NO: 38318 - DNA, 660 bp, Panicum virgatum
  misc_feature: Ceres CLONE 1993387-R
ggtttaggcatgatctgcaaacatgtagctaatgatagtttatccaaaacagttgttttgcatggagcagcccaccggatagggaaatgtttctgttagttaaataacagctagcagaaggctttgttttagaatccaggcacaatccatctcgcaacctgaccacgtgatcagtggttttagcacacagtttcgcccttaaaaaaatgtaccagctggagcctcctgccgtataaagtaatctagcttcacccttaagatgttagacagatgaactgcaatagataattaattgcaccaatctctagtgtcttgcaacttgcaatgctgatgcttgtgctaattgtattgcaaccctggaaattaaattcagttgctcaccgaaggttgacttgtgtttctgcttgcagcggcagacagcaccagtgacctcaacaacgttgagcaagatcaaggctgtttggcatggctgaaggagattgacatgccgagggagctgaagatgtgcagtgtccactacggcggccccccaatctgtgacaagtgaccgctggccttcggcgtgaacgaaggcctgctcgatctctcctgtagtcctgttgtagttgtcctgtacctaactgaatgatgtgcaattgatcttggctggattggatcgtc

SEQ ID NO: 38319 - DNA, 700 bp, Panicum virgatum
  misc_feature: Ceres CLONE 1993392
  misc_feature: Encodes the peptide sequence at SEQ ID NO. 38320
tgtggacttctgcggcatcaagttcatcaaccccttcggtatcgcctccgccaccggcgcgacgtcgtccgcgatgatcgcgcgcgcgttccaggccggctggggcttcgcggtgacgaagaccttcgccctcgaccgcgactacgtgacgaacgtgagcccgcgcatcatccgcggcagcacgtcgaacgccaagttcggcccgcaccagagctccttcttgaacatcgagctcatctcggagaagagcgccgcgtactggatctcctcgatccgccagctgaagaaggattatccggagcacgttgtcgttgcgtccatcatgtgcggctacagcaaggaggactggcaggagctcgcgatcatgacgcaggaggccggccccgacgccctcgagctcaacctgtcgtgcccgcacggcatgggcgagcgcggcatgggcctcgcgtgcggccagaaggtcgacatggtcgagaacatctgcaagtgggtcgcggaggtctccaaggtgcccttcttcgccaagatgacgccgaacattaccgacatcaacgacatcgctgcggctgccatgcgcggcggcgccacgggcgtgaccgccatcaacaccgtcagcagcctcatgggtttccgctccaacggcgagccgtggccgtccgtcggcgccgaccgcctcaccacgtacggcggcatgtccggc

SEQ ID NO: 38320 - protein, 232 aa, Panicum virgatum
  misc_feature: Ceres CLONE 1993392
  misc_feature (1)..(231): Pfam Name: DHO_dh Pfam Description: Dihydroorotate dehydrogenase
  misc_feature: SWISSPROT Homolog: EC 1.3.1.2 Dihydropyrimidine dehydrogenase (NADP(+))
VDFCGIKFINPFGIASATGATSSAMIARAFQAGWGFAVTKTFALDRDYVTNVSPRIIRGSTSNAKFGPHQSSFLNIELISEKSAAYWISSIRQLKKDYPEHVVVASIMCGYSKEDWQELAIMTQEAGPDALELNLSCPHGMGERGMGLACGQKVDMVENICKWVAEVSKVPFFAKMTPNITDINDIAAAAMRGGATGVTAINTVSSLMGFRSNGEPWPSVGADRLTTYGGMS

SEQ ID NO: 38321 - DNA, 1307 bp, Panicum virgatum
  misc_feature: Ceres CLONE 1993394
  misc_feature: Encodes the peptide sequence at SEQ ID NO. 38322
ctcgctcctgcgccggcgaccccgcggatcccacctccccgcactaatcaccgccgcgtgcaggcccgagagccccggaccccccgtctgccgcgtggtgccggctgccacggcgagcggcggatagccagcgagccgggagagcgccggccgccggagtcccgccccgcctcggcccgcccgggcgggcgatcgccggcgcgggcgccacccacccgcgccccgggctcgatcggcgcgccattggggccgctgctcccgcgcggcgggttcttcccaggggggggggggggatttggccgttcccgccgccccggcctctcggtcggattcgttcgctccggcgcgggaggggcttcctcctggcgtgtgggggcgccgcgatgccggaggccgggcactacgggtacaagaagaccgacggcatctgcgacggcgtgtgcggcgagcctgtgtcaaaggcagctctgaccatgtcaaggctaaagtgtgcgctacggggatttgatctcagggcacttatggctctcttgattggtgtgccaatgctgatcttaatgatatatgctcatggtcagaaggtcacatacttcctccggccgatctgggaatctcctcccaagcctttcaagacaatccctcactactaccatgaaaatgtcaccatggagaatctctgcaagctacatgggtggaaagttcgggatacccctcgccgtgtatttgacgctgtactcttcagcaatgagcttgatatccttgagatccgctggaatgagcttagtccctatgtgtcagagtttgtgcttcttgaatccaactcaacattcactggcatgaaaaagcccctccacttcaaggaaaatcgtcatcgatttgggtttgctgaatcacggctgacatatggtatgattgggggtaggttcgtgaagggggagaacccatttgttgaggagtcatatcagagggttgccctggaccagcttattaagattgcgaaaatagaagatgatgacctgctgatcatgtcggatgttgatgaaatcccaagcggtcacacaatagacctcttgaggtggtgcgatgacattccagatatacttcatcttcagctcaggaattatctttactccttcgaatttttcctggatgacaggagctggagggcatcaatacacaggtaccgatctggaaagacgaggtatgcacacttccggcagacagatgagcttcttgctgattcagggtggcattgcagcttttgcttccgctacataagcgattttgctttcaaaatgcaagcttat

SEQ ID NO: 38322 - protein, 307 aa, Panicum virgatum
  misc_feature: Ceres CLONE 1993394
  misc_feature (28)..(307): Pfam Name: Glyco_transf_17 Pfam Description: Glycosyltransferase family 17
  misc_feature: SWISSPROT Homolog: EC 2.4.1.144 Beta-1,4-mannosyl-glycoprotein 4-beta-N-acetylglucosaminyltransferase
  misc_feature: Useful for making plants with altered carbohydrate content
MPEAGHYGYKKTDGICDGVCGEPVSKAALTMSRLKCALRGFDLRALMALLIGVPMLILMIYAHGQKVTYFLRPIWESPPKPFKTIPHYYHENVTMENLCKLHGWKVRDTPRRVFDAVLFSNELDILEIRWNELSPYVSEFVLLESNSTFTGMKKPLHFKENRHRFGFAESRLTYGMIGGRFVKGENPFVEESYQRVALDQLIKIAKIEDDDLLIMSDVDEIPSGHTIDLLRWCDDIPDILHLQLRNYLYSFEFFLDDRSWRASIHRYRSGKTRYAHFRQTDELLADSGWHCSFCFRYISDFAFKMQA

SEQ ID NO: 38323 - DNA, 648 bp, Panicum virgatum
  misc_feature: Ceres CLONE 1993394-R
  misc_feature: Encodes the peptide sequence at SEQ ID NO. 38324
aagcttatagtcatgttgaccggatcaggttccaagtacttcctgaaccctgataggattcaagatgtcatctgcagaggggcagatctttttgacatgcttccagaagagtacacattccaggaaatcattgctaagttggggccgatcccaagcacatattctgctgttcatcttcctagttatctgctgaagaatgtcgagcgctttagatatcttctaccgggcaactgcagaagagaaagtggctgattttatggcttaccctgcaatctgctgtgtatgggtgccacggcacatctgttgtcttcgtcgaggcccggatggctgtggcagttgcatctggtatgattggctaacatgtggttggctaacatagccggacaattgcttgggggaagttgtctgtggatgagaggaagccgctgactttgagctctgtaatcggacatgggaagaggatctaacagcatatgacagcatagcgcatgcttggccctggctggctgtgccttccggatgaggtgaactgagtgtgtgaatacaaccaggtgtcgttgtcatccattacttccctgattgatatataaactcaaaagggctgttgtagattgcaaaaccaattgatattccagaactacatgttgt

SEQ ID NO: 38324 - protein, 83 aa, Panicum virgatum
  misc_feature: Ceres CLONE 1993394-R
  misc_feature: Useful for making plants with altered carbohydrate content
KLIVMLTGSGSKYFLNPDRIQDVICRGADLFDMLPEEYTFQEIIAKLGPIPSTYSAVHLPSYLLKNVERFRYLLPGNCRRESG

SEQ ID NO: 38325 - DNA, 500 bp, Panicum virgatum
  misc_feature: Ceres CLONE 1993404
  misc_feature: Encodes the peptide sequence at SEQ ID NO. 38326
attcctacccgagcgtgaagtggtaaggatgtgagggaggcggcggcgcgggtgacgaccgatggggcaaccgggaactggcgggggctggccctggcgctcgccgtgctcctcgcctgctccggcgtcgttctccccacggagcaggacaccatatcggatcgcatggagtgccgcgcaattgctggcacataagcctgttgtgaggctcaaggtctttttctatgatctccctaccaaatacaagcaagacactgctgaacaacgaccctaggtgcctgatccacatgtttgctgctgagatcttcatgcactggttcctgttgtcaagcgctgttccatcttttaatcccgaggaagctcattgcttctacgctcctgcatattcaacatgcgatctgactccttcgcttcttcccttgcctttcgagtctcctcgaatgatgcgtattgcaatccagctgattgccactaactggccttaatgaactagatcacaa

SEQ ID NO: 38326 - protein, 86 aa, Panicum virgatum
  misc_feature: Ceres CLONE 1993404
  misc_feature: Useful for making plants with altered carbohydrate content
  misc_feature: Useful for making plants with altered cell wall content and/or composition
MISLPNTSKTLLNNDPRCLIHMFAAEIFMHWFLLSSAVPSFNPEEAHCFYAPAYSTCDLTPSLLPLPFESPRMMRIAIQLIATNWP

SEQ ID NO: 38327 - DNA, 706 bp, Panicum virgatum
  misc_feature: Ceres CLONE 1993406
  misc_feature: Encodes the peptide sequence at SEQ ID NO. 38328
aacacacagcagccatttacgcatcaatcatggcacgaacacccatgatcgccttgcaccttctcgtcgccctttgcatcctctccaacgcaagaacatcctcttcagctcccagcgatgtggatggattcatcggctgcctctccgcggccattccgccttccctcatccacaccccagcgaccaactcctactcttcgctcctgctggcctccgtccggaacctccgctacgtcttgccgggcaccacgaggccgctcctgatcgtcgccgtcaccgagcccgcccatgtgcaggccaccgtggtctgcggccgccgccacagcgtccgcatccgcacgcgcagcggcggccacgactacgagggcctctcctacgcctccgtcgaccccgaccagcacttcgccgtgctcgacctcggcgagctccgcgcgatcagcatcgacgcctcgagatccgaggcctgggtcgggtcaggcgcgacgctcggcgagctctactacgccgccgccgccgctaaccagacgttcgggttccccgccggcaactgccccaccgtcggcgtcggcggccacctgagcggcggcgggttcggcgcgctgtcacgcaagtacggcctctccgccgaccaagtcatcgacgcggtggtggtggacgccgaggggaggctgctgaaccgaagcaccatgggggaggacctcttctg

SEQ ID NO: 38328 - protein, 225 aa, Panicum virgatum
  misc_feature: Ceres CLONE 1993406
  misc_feature (76)..(218): Pfam Name: FAD_binding_4 Pfam Description: FAD binding domain
  misc_feature: SWISSPROT Homolog: EC 1.21.3.3 Reticuline oxidase
MARTPMIALHLLVALCILSNARTSSSAPSDVDGFIGCLSAAIPPSLIHTPATNSYSSLLLASVRNLRYVLPGTTRPLLIVAVTEPAHVQATVVCGRRHSVRIRTRSGGHDYEGLSYASVDPDQHFAVLDLGELRAISIDASRSEAWVGSGATLGELYYAAAAANQTFGFPAGNCPTVGVGGHLSGGGFGALSRKYGLSADQVIDAVVVDAEGRLLNRSTMGEDLF

SEQ ID NO: 38329 - DNA, 707 bp, Panicum virgatum
  misc_feature: Ceres CLONE 1993415
  misc_feature: Encodes the peptide sequence at SEQ ID NO. 38330
acctccctcccacccccgccgattcactccgctcgcgccttccccaatcccctcacgccgcagggaggaggaggaggcggcgggtgtcgcggcggagaagattccctccgattcctctcctcccagtccgtccgatccgctcatgatggctctccagcagcagcagcacgcggggtcggcgtccgggtcggcgtcggcttcgagctcgagctcggggctgcacccgctcgcttcgccctcgtccttcgcggacaccacccacaccaaggtcttcgtgggcgggctcgcctgggagaccaacagcgacaggctccgccgcttctacgagcgcttcggggacattctcgaggccgtcgtcatcaccgaccgccactctggccgctccaagggatatggattcgtgacgttccgtgaaccggagtcagcgaggaaggcatgcgaggaccccacgccggtgatcgacggcaggcgggccaattgtaaccttgcttcgcttggtcgagcccagcatcctgtgccccttgggcgtccaagatcagctgggtcctactttggtgtctcagttccaaggggcttttatttaggcggttatggccagcaccgaccgcttccacttggatactaccaagggttcccagttccccagtacagttacgctacatatggggccgaatacatctatccacagggtacattgaacccataca

SEQ ID NO: 38330 - protein, 187 aa, Panicum virgatum
  misc_feature: Ceres CLONE 1993415
  misc_feature (42)..(112): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated biomass
MALQQQQHAGSASGSASASSSSSGLHPLASPSSFADTTHTKVFVGGLAWETNSDRLRRFYERFGDILEAVVITDRHSGRSKGYGFVTFREPESARKACEDPTPVIDGRRANCNLASLGRAQHPVPLGRPRSAGSYFGVSVPRGFYLGGYGQHRPLPLGYYQGFPVPQYSYATYGAEYIYPQGTLNPY

SEQ ID NO: 38331 - DNA, 715 bp, Panicum virgatum
  misc_feature: Ceres CLONE 1993416
  misc_feature: Encodes the peptide sequence at SEQ ID NO. 38332
ggagtctggcaatggggacaagattgccatgtactgggaggggaacgagcccagtcaggatgggaagctcacatactccgtgctcttggacaaggtttgccagctggcgaattacctgaaaagcgttggtgttggaaagggtgatgctgtggtggtctacctaccgatgttgatggagctgcccattgcaatgcttgcatgtgctcggattggtgcagttcactcggttgtgtttgctggcttctctgctgatgcactagcacaaagaattgttgactgcaagcctaaggttgtgattacctgcaatgctgtgaaaagggggcagaaactcatccctctgaaagatatagttgacacttctctggttgaaagtgcaaagaatggagttgatgtaggtatttgcttgacatatgaaaatcagtcagcactgaataaagaagacacacgatggaaaccaggaagagatgtttggtggcaggatgttgtgcccaatttcccaactaaatgtggtgtggaatgggttgatgcagaggatccattgtttcttctgtacacaagtggcagcacagggaagccaaagggtgtgttgcatacaactgggggctatatggtctactctgctacaacatttaagcatgcatttgactacaagccaggagatgtatactgactgtggttggattactggacatagttatgtgacatatggtcctct

SEQ ID NO: 38332 - protein, 222 aa, Panicum virgatum
  misc_feature: Ceres CLONE 1993416
  misc_feature: SWISSPROT Homolog: EC 6.2.1.1 Acetate--CoA ligase
ESGNGDKIAMYWEGNEPSQDGKLTYSVLLDKVCQLANYLKSVGVGKGDAVVVYLPMLMELPIAMLACARIGAVHSVVFAGFSADALAQRIVDCKPKVVITCNAVKRGQKLIPLKDIVDTSLVESAKNGVDVGICLTYENQSALNKEDTRWKPGRDVWWQDVVPNFPTKCGVEWVDAEDPLFLLYTSGSTGKPKGVLHTTGGYMVYSATTFKHAFDYKPGDVY

SEQ ID NO: 38333 - DNA, 621 bp, Panicum virgatum
  misc_feature: Ceres CLONE 1993429
  misc_feature: Encodes the peptide sequence at SEQ ID NO. 38334
atccatccgcttctgcacacttgatcgtggctgcagcatataccatggatgcatgctcagcttgtattctcctcctcagtttgattcacctgctttctagcatctcagcccgtgatttcctctcggcgggctcctccctttccgttgagcacagctccgacgtgctccactcggcagacggcactttcgcctgcggcttctacagcatctcccccaatgcctccaccttcgccatctggttctccagatcatctggaaggaccattgtctggagcgcgaatcctctccaccctgtgtacacctggggatccaaagtcaagttagaagtcgaggggggcatggttctgaaagattacaatggccagattgtgtggagcaacaatgtgagcacttcggacgctgggcatgttcaagctcagctcttggacaatgggaacctcattgtgaagggcaaaggtggtgccatcctgtggcaaagcttcgattctcctactgataccttgctacctactcagagcattactgctcctacaaagctggtatctactaacaggttacttgttcctggccactacagcttccatttcgatgatcaataccttctttctctgtttgatgatg

SEQ ID NO: 38334 - protein, 192 aa, Panicum virgatum
  misc_feature: Ceres CLONE 1993429
  misc_feature (71)..(181): Pfam Name: B_lectin Pfam Description: D-mannose binding lectin
MDACSACILLLSLIHLLSSISARDFLSAGSSLSVEHSSDVLHSADGTFACGFYSISPNASTFAIWFSRSSGRTIVWSANPLHPVYTWGSKVKLEVEGGMVLKDYNGQIVWSNNVSTSDAGHVQAQLLDNGNLIVKGKGGAILWQSFDSPTDTLLPTQSITAPTKLVSTNRLLVPGHYSFHFDDQYLLSLFDD

SEQ ID NO: 38335 - DNA, 1452 bp, Panicum virgatum
  misc_feature: Ceres CLONE 1993442
  misc_feature: Encodes the peptide sequence at SEQ ID NO. 38336
aaaaactcaacaccgcgaaaccctagcggtcccgcggcggcgatggcgaccggcggcgacaagcccccgtccctcgacgccgacgtcgacatggccgacctcgcctcgctcgacgccccggccgcctcatccgccgctgcggccggcgctccctccacccgcttccggcccagggccaagggcaagcccaaaccgaagcccgaggcccccaagcccgaacctctggccgtgcccaaatcagagctggagccggatctggaaccagagccggtgtcgatgccggagcccgtggccgcccccgcgctgccgctggaggatgatcgcctggacgctatggaggtggacggggcgggggacgctgctggtcctggagacggggcggcggcggaggaggatttcgtggtgcgcgagatcgatgtgtacttcacccccaagcccttcgacgacgacaccaagctgtacattatgcaatatcccctacggccatgttggcgcccatatgagttaaatgagatatgtgaagaggttcgcgtgaagccattgagttcagaagttgaagttgatttgagtgtcaataaacagagtgaaaattatgaccaagaggcacctttgggactgacaaaacagacactttcatcatcaaaggcagaagatgtttctgattatgcggttggaattcttaaaggcaacttgattcatttgaatcatattgatgcagtggtgcaactgcgaccatcaatgtcacatgtaatttctggtcgagcatataataggcaggctttacaatctcgggaaatgaatggtggtgctagtggttcaaaggctccatctcgtaagggaagtgagcgcccagaagattccaaggaccacacagaagattctgagccatggatttctctcacgtaccaaccagcagggagtaatattgcaaccaagtaccatgataagatgatatcaaatgagggtgttcctattgatttcacaatgagcaagtctgattatgtaatgtccttgtgtcctggagcctcaactagcagcaagcatattaacaaatgccaagcaataagggagatgcttttgctaccacttgaagaacgcctgcaaaaatggtttactgaggtttcagaagtaaaccaatttgatgctctgaagcaccttgctcctacctattcagaggaagaaatcctgaaagcccttccagactatgcatatttggtgcgtggtttatgggtctgcaaaagttctttgttgtttgatgatggatatgcttccaaaagagacagaattcttctcgaatttacaaaaagggagtccatccctgagaaaattctacaagtatggataaaaccggatgaccttaggaggaagaggatactgattccattgtgtaaaagacgtggagttctgaaggactataaatttatatcctcagatatgtcctttataaaacac

SEQ ID NO: 38336 - protein, 469 aa, Panicum virgatum
  misc_feature: Ceres CLONE 1993442
  misc_feature (116)..(468): Pfam Name: Sin_N Pfam Description: Sin-like protein conserved region
MATGGDKPPSLDADVDMADLASLDAPAASSAAAAGAPSTRFRPRAKGKPKPKPEAPKPEPLAVPKSELEPDLEPEPVSMPEPVAAPALPLEDDRLDAMEVDGAGDAAGPGDGAAAEEDFVVREIDVYFTPKPFDDDTKLYIMQYPLRPCWRPYELNEICEEVRVKPLSSEVEVDLSVNKQSENYDQEAPLGLTKQTLSSSKAEDVSDYAVGILKGNLIHLNHIDAVVQLRPSMSHVISGRAYNRQALQSREMNGGASGSKAPSRKGSERPEDSKDHTEDSEPWISLTYQPAGSNIATKYHDKMISNEGVPIDFTMSKSDYVMSLCPGASTSSKHINKCQAIREMLLLPLEERLQKWFTEVSEVNQFDALKHLAPTYSEEEILKALPDYAYLVRGLWVCKSSLLFDDGYASKRDRILLEFTKRESIPEKILQVWIKPDDLRRKRILIPLCKRRGVLKDYKFISSDMSFIK

SEQ ID NO: 38337 - DNA, 1420 bp, Panicum virgatum
  misc_feature: Ceres CLONE 1993462
  misc_feature: Encodes the peptide sequence at SEQ ID NO. 38338
acgtgcttccgaccaaccgccgtggtcccctcgctcgcgggtacactctccgggctcccaccacctccgcctcttccgccgccgcgagcgccggcgacgatgccgcgcaaggcctcctccacctcagatgcgcgggccaagtggcggaagcggaagcgcgccgccgccagcccttccccgtccaagcagcaggccgaccactccgacgattctgactccgccgcggcggcgaacggcgacgaggacgcgccccgcggcgcctctgccaacgggggcggcggaaccctagctgccggcggcggcggcggcggcgatgacgaccccgtgctcgacctccgcggggcggaggtgctttcatctcccgccgagccgatctcctccttccccgtggccgtccgctgcgccgtcggccggcctcacccctcggtgcttgctatcgtcgacgcggagcgcgcggcggccggtgccgacggtgctccggccgccccagcctcggtacccgttctcgagaacatttcgcacggtcagctccaggtgatctcggcgatgctgcccgaccacccgtccctgtcacacgaccctgacaagccgtccacgtatgtctgcaccccgcctccactcatggagggatgtggagtgcacaagcagttctacggcagacttcacatcgtgcccaggcactcagattggttcatgccaacaacggtgcacagattggagaggcaggttgtgccgcagtacttctctggaaaatcccaggggcaaataccagagaagtacatgatgttgaggaataaggtgattgcaaagtatttggagcgtcctgggaaaagactcgtgtttgcagagtgccaggggcttgtcacaagcacacctgaattgtatgacctgagtaggatagttaggttcctggaatcttgggggatcattaattaccttgcaacggggtctgtgcaccgtggcctcaggatggcagcatcactaatcaaggaggagacaacaggggagctgcaactggtatctgcaccgatgaaatcgattgatggtttggttttgtttgatcggccaaaatgcagtatccgggcagatgatatagcttctgtggtgtcaacttcatctgcttcagtggtggcaaatggtgatattgattctgcgaatttggacgagaagatctgggagcgcttatcagagactttttgtagtttctgctcacaaactttgcccagtttacattacgagtcacaaaaggaggcagacattgctctttgttcagattgcttccacagtgcaagatttgttactgggcattcaagcttagattttcagagagtggatgggatgaaggatcgatcagacactgatggggacagatgggactgatcaggaaactttactgttgttggagggcattgagaagttc

SEQ ID NO: 38338 - protein, 426 aa, Panicum virgatum
  misc_feature: Ceres CLONE 1993462
  misc_feature (189)..(279): Pfam Name: SWIRM Pfam Description: SWIRM domain
MPRKASSTSDARAKWRKRKRAAASPSPSKQQADHSDDSDSAAAANGDEDAPRGASANGGGGTLAAGGGGGGDDDPVLDLRGAEVLSSPAEPISSFPVAVRCAVGRPHPSVLAIVDAERAAAGADGAPAAPASVPVLENISHGQLQVISAMLPDHPSLSHDPDKPSTYVCTPPPLMEGCGVHKQFYGRLHIVPRHSDWFMPTTVHRLERQVVPQYFSGKSQGQIPEKYMMLRNKVIAKYLERPGKRLVFAECQGLVTSTPELYDLSRIVRFLESWGIINYLATGSVHRGLRMAASLIKEETTGELQLVSAPMKSIDGLVLFDRPKCSIRADDIASVVSTSSASVVANGDIDSANLDEKIWERLSETFCSFCSQTLPSLHYESQKEADIALCSDCFHSARFVTGHSSLDFQRVDGMKDRSDTDGDRWD

SEQ ID NO: 38339 - DNA, 714 bp, Panicum virgatum
  misc_feature: Ceres CLONE 1993462-R
gacggggggcactctaccaggaggtggcagtaccatgtcttcaaatccaatgaatcaggccaccagcgttagaccgcagatgatgcaggtctcgatgccgcagtccagcatgccgtccatgtatgccaacaacatgcaggggcatccccagatggctgctctgctgcagcagcgtcaacagatgctcttgtttgggcctcgcctgccgctctcagcaatccaccctggcacaccatcctcgtcttcgcccagtatgatgctcaaccctggtatgcccaactcggctgctccaaatcaccactcgttgttgagaccaccctcagggaacaattcaaatgtaggttaatgagataagtgttttttttttctcgtcccggatctatagattcatgggatgtagcccctgattctgatgtttgaccattattgtaattcgattgaacaatcacatatagaggtagttggttaccagcaataggttttccattgtctgtaggctgtggaccgtgtgtatgtggtttgttggtctgataagactgatgttgctagtggctaggcagtgcatagagaatgtagaggttcgtcctgattaattgttattactgttccggaagttcccaggaagtcggggaaattggatccacatgtattcctaatcatctgtgtttcgtatttggtgtgcgaaagtggtctatatatttggaacttttctgg

SEQ ID NO: 38340 - DNA, 670 bp, Panicum virgatum
  misc_feature: Ceres CLONE 1993482
  misc_feature: Encodes the peptide sequence at SEQ ID NO. 38341
aagcttatggcaaagataatgcaacagatcaggaaattagagctgctgctgagcttgcaaacgctgccaaattcatagataaaatgcctcagggtttcgatacttcggttggtgagcatgggacacagctttctggtggacagaagcaaagaattgccattgcaagggctattctgaaagacccaagaatcctactattagatgaagctacaagcgcactggatgctgaatctgaaaggattgtgcaggaagctcttgacagggtcatgacaaacaggacaactgtcatagttgcacaccgtctgagcactgttagaaatgctgataccattgctgtcattcatcaaggaacactagttgaaaaaggaccacacaatgagcttctaagagatccagaaggagcttatagccagctgataaggctacaggaagctaaccggcaggacactcggaagggtgattccaatgctcgttcaggcaaacaaacgtcaataaataaatcagctagcaggaggtcatcccgtgataacagtagccaccattcattctcggtaccatttggtatgcaactcgggattgacattcaggatggttcatctaacaaactatgtgatgagatgccacaagaagtacctctcaatcggcttgcatctcttaacaggccagagat

SEQ ID NO: 38341 - protein, 222 aa, Panicum virgatum
  misc_feature: Ceres CLONE 1993482
  misc_feature (2)..(116): Pfam Name: ABC_tran Pfam Description: ABC transporter
  misc_feature: SWISSPROT Homolog: EC 3.6.3.44 Xenobiotic-transporting ATPase
AYGKDNATDQEIRAAAELANAAKFIDKMPQGFDTSVGEHGTQLSGGQKQRIAIARAILKDPRILLLDEATSALDAESERIVQEALDRVMTNRTTVIVAHRLSTVRNADTIAVIHQGTLVEKGPHNELLRDPEGAYSQLIRLQEANRQDTRKGDSNARSGKQTSINKSASRRSSRDNSSHHSFSVPFGMQLGIDIQDGSSNKLCDEMPQEVPLNRLASLNRPE

SEQ ID NO: 38342 - DNA, 1428 bp, Panicum virgatum
  misc_feature: Ceres CLONE 1993510
  misc_feature: Encodes the peptide sequence at SEQ ID NO. 38343
actcctccgttcccgctgccatttgaaaccccacctccgatggccaccgccgacggcgacccgccccaacccttccccgccgacctcgacgacaacggattccccgatctaccctcctcccccgccgccgccaccaccaccagcagcggcttcgccgaggatttctaccgtagcggcatcgactggtcctccctgcgcgcccctccgccgcggcggccgcccgagggggcagctggggttaaggagaagggtaaggagggtggctcgctcgtccagagcagcctcttccaggcgtgggggatcgagaggccacggcgggaggagggggccggggctggggattcctcgctcgtgcagaggagcctcttccaggcgtgggggatagagaggccgaagcgagaggggggaggggctggggacgcctccccttccccttcccgttccggttcttggtcgggaaggaaacggcggcgaggaggccccgaggaggaggtggcggcggcggccatgaatccccgcacttgccccttctacaagaagattcccggcacgccattcacggtggacgcatttcggtacggagaagttgagggctgctcggcctatttcctcagccattttcatcatgaccattatggtggattgaccaagaaatggtgccatggccccatctattgttctgcgctcactgcacgcttggtaaagatgtgcctgtcagtaaattcagattatatttgtcccttggagcttgatactgagtatgtcatcgagggagtgacagttaccttgttggaggccaatcattgccctggtgcagctctcattcacttccgactaagtgatggaaagacttatctccacactggggatttcagagcatcgagatctatgcaactgcatccactcctccagagaggacgcataaatttgctttacctggacacaacatattgcaatcccaagtacaagttcccaccgcaggaggatgttattgattttgttgtgagcacagctcgaagatatctaaagaagcaaccaaaaaccctcattgttgttggggcatatagcattgggaaagaaaatgtgtatctagcgatttctcaagctttggaggtacccatatacaccgatgcatcgagaagacggattcttcactcatttggttggaaggacttatccaaaaggatatgttcttgcaatcaaagctcagcacttcatgttttgccccttggatctgtaaaccatgagaactggaagaagtacttggggactctcaaccaacaatttctagctgtgttggcttttcggcctacaggttggactttctctgaggcaactggaaagcagcttgacctaataaaaccaaactctaatggcagcgtaacaatctatggtgtgccttatagcgagcactcaagtttcactgag

SEQ ID NO: 38343 - protein, 462 aa, Panicum virgatum
  misc_feature: Ceres CLONE 1993510
  misc_feature (382)..(462): Pfam Name: DRMBL Pfam Description: DNA repair metallo-beta-lactamase
MATADGDPPQPFPADLDDNGFPDLPSSPAAATTTSSGFAEDFYRSGIDWSSLRAPPPRRPPEGAAGVKEKGKEGGSLVQSSLFQAWGIERPRREEGAGAGDSSLVQRSLFQAWGIERPKREGGGAGDASPSPSRSGSWSGRKRRRGGPEEEVAAAAMNPRTCPFYKKIPGTPFTVDAFRYGEVEGCSAYFLSHFHHDHYGGLTKKWCHGPIYCSALTARLVKMCLSVNSDYICPLELDTEYVIEGVTVTLLEANHCPGAALIHFRLSDGKTYLHTGDFRASRSMQLHPLLQRGRINLLYLDTTYCNPKYKFPPQEDVIDFVVSTARRYLKKQPKTLIVVGAYSIGKENVYLAISQALEVPIYTDASRRRILHSFGWKDLSKRICSCNQSSALHVLPLGSVNHENWKKYLGTLNQQFLAVLAFRPTGWTFSEATGKQLDLIKPNSNGSVTIYGVPYSEHSSFT

SEQ ID NO: 38344 - DNA, 668 bp, Panicum virgatum
  misc_feature: Ceres CLONE 1993514
  misc_feature: Encodes the peptide sequence at SEQ ID NO. 38345
aaaaacacacaccaaaacctaaggcggcgggggcggcggcgcgagccacggtcaggcggcgcggcagcaaggcggagcacgcacctaccccgcgccgcgtccaccccatggcggcgcatccagccacgtcctccgcgccgtcccggagcctctccggcgcgcggccgcgccgcgccgcgccccgcagccccagctcgctcgccgtcgcggcgcctccggccgggctccggccatgcgggagccgcgccctccgcgtccgcgctaaggttgccagtggcgtgcagggtgccagcgtggtggacgatggagtggagaggccgtggaaactgagtgatgctcgccttgttctggaagatggttctgtctggaaggccaagtcttttggtgcttcagggacgcaagttggtgaagttgttttcaacacatcattgacaggctatcaagaaattttgacggacccgagctatgctggtcaatttgtcctgatgaccaatccccatattgggaacactggtgttaatcctgatgatgaagaatcgaaccaatgtttcctcggtggcctaatcataagaaatctaagcatatgtacttccaactggagatgcaaagagacacttgaagagtatctgattaagaggaacattatgggaatatatgatgttgataca

SEQ ID NO: 38345 - protein, 186 aa, Panicum virgatum
  misc_feature: Ceres CLONE 1993514
  misc_feature (75)..(186): Pfam Name: CPSase_sm_chain Pfam Description: Carbamoyl-phosphate synthase small chain, CPSase domain
  misc_feature: SWISSPROT Homolog: EC 6.3.5.5 Carbamoyl-phosphate synthase (glutamine-hydrolyzing)
MAAHPATSSAPSRSLSGARPRRAAPRSPSSLAVAAPPAGLRPCGSRALRVRAKVASGVQGASVVDDGVERPWKLSDARLVLEDGSVWKAKSFGASGTQVGEVVFNTSLTGYQEILTDPSYAGQFVLMTNPHIGNTGVNPDDEESNQCFLGGLIIRNLSICTSNWRCKETLEEYLIKRNIMGIYDVD

SEQ ID NO: 38346 - DNA, 687 bp, Panicum virgatum
  misc_feature: Ceres CLONE 1993528
  misc_feature: Encodes the peptide sequence at SEQ ID NO. 38347
gctcgtgtttcgatcatcagtagacatttgaggacgacgtagaagatacaattcctcatagatggctgcttccccatctttccgttccgctgccgctgccggcgtgctgctggcaatggtggtggccgccgtgtgcctccccgccgcggcggcgcaactgtgcgaggactactacgacgacacgtgccccgacgcctacgacatcgtcaagcaggtcctcatggacgcgcaccagtcggacacgcgcatcttcgccagcctcatccgcctccacttccacgactgcttcgtccagggctgcgacgggtcgctgctgctggacaccgtgccggggatgcagtcggagaaggagtcgccgcccatctcagtcgagctggtatacgtcctttctgccttgctagccactgcttgcactggcgacgtacgtacgtgctacacagtattttgatgatcgaagtacagatgcggtgggtgcgacgtcgctttgatcgtacgggcatgccatctcgatcgatcatgaactgtcaacaacatgccacaataacttcattgccatctaccgtctggtttttaaggaacgatttgatatgatgggcgtgtcggtgtgcctgcatgtaaagtacaactctgtacgtatttgtagctataccaagctagatgctagagcttaataataagtgctaatgt

SEQ ID NO: 38347 - protein, 128 aa, Panicum virgatum
  misc_feature: Ceres CLONE 1993528
  misc_feature: SWISSPROT Homolog: EC 1.11.1.7 Peroxidase
  misc_feature: Useful for making plants with modulated nitrogen use efficiency
MAASPSFRSAAAAGVLLAMVVAAVCLPAAAAQLCEDYYDDTCPDAYDIVKQVLMDAHQSDTRIFASLIRLHFHDCFVQGCDGSLLLDTVPGMQSEKESPPISVELVYVLSALLATACTGDVRTCYTVF

SEQ ID NO: 38348 - DNA, 1569 bp, Panicum virgatum
  misc_feature: Ceres CLONE 1993529
  misc_feature: Encodes the peptide sequence at SEQ ID NO. 38349
cgagaaaatgggtgcacctgtcgaaagactagcaattatgcgagacaaaattactggtcgatcaagaggttttgggttcgttaccttcgtatcgatggaaggactccaactcgtttgttcacgtagacatacattagatggaagacaaatagaatgtaagagagccataccaaaaagtgaaatagcttctaaagttaaaaaagtatttgttggcggaattcctctcacattggatgaagcaacattgagacaatattttgagaaatttggccctgttgaagagtgtcgaattatgacagatggtgtttcaaatagatctcggggattcgcgttcgtttgtttttatgacgacgaagtaatgaacaaagtcctatcttcccctcattccttagacggaaaatgttttgaagttaaaaaggcaagagttaaacccactactgcacaaatgcctaatatgcctgctactccggaaaatcctttcgcggttcccccaatccgtccagtttttgtaccttatggcaactttatgaaaggagcctttccctccggtgccttcccagccggaggctttcctgctggattttttatctatcctgctggtcatcaaggatttggatatgagtttggtgaaaatggggaaattgtagaacctcaagtatcacaacaacaagctcctttttttgttcccccaatccaaccaattccagcatcaacttcagttcaaagaccaagtcacgttgtcacacaacataaagaaatggaacaacctcattacgaaccatcaaaacaagaaatatcgcagccaacacaaccagttcaaccagccattcaacaaccaatccaaccaatagaacctcgaaattggcattcgcaagctcccattagaagaggaacaagacatgaaaagcaacaaattaatcgatcagttagtgcacaagattcgcttcttgttgaaagaccttcaacaagatcggaaaaacagaatttaaatagaacagtaagcgttaatgacaaactcctaatgacaccgaatcattccggctctgcgctttcaagaacatccgcgtctggatcgaaaacattgacatctccaagatcatctggatccaaacacaaacaagatctctcttcgcagtctccgcctcctccaagactatctaaagttgctccgggtaaaccaacggtcgtatcctctaggggccttgtccctgttcaagaagaaccaaagacacaaaccgctcaacctgttttagaaaggaagagtgatctacctgtatatcaaacaagaaaagaaaaagaagcgcaagccctaaaagaagcgcaagcccaaaaggaaaaagaaaaagaaaccgaaacagaagaaaaagagcaaccagaggcaaatggaaggcgaaaacgtgggttgtcgtcaccagtattacctctggatccaattcgtcatctggatcttaattggcgaagtggttccggaaaatcacaggaatcaacaatccataaatattttgcccttgtcccatcaacacccgaggcccagagataaattgtgttagaataaatccacattacctg

SEQ ID NO: 38349 - protein, 510 aa, Panicum virgatum
  misc_feature: Ceres CLONE 1993529
  misc_feature (66)..(140): Pfam Name: RRM_1 Pfam Description: RNA recognition motif. (a.k.a. RRM, RBD, or RNP domain)
MGAPVERLAIMRDKITGRSRGFGFVTFVSMEGLQLVCSRRHTLDGRQIECKRAIPKSEIASKVKKVFVGGIPLTLDEATLRQYFEKFGPVEECRIMTDGVSNRSRGFAFVCFYDDEVMNKVLSSPHSLDGKCFEVKKARVKPTTAQMPNMPATPENPFAVPPIRPVFVPYGNFMKGAFPSGAFPAGGFPAGFFIYPAGHQGFGYEFGENGEIVEPQVSQQQAPFFVPPIQPIPASTSVQRPSHVVTQHKEMEQPHYEPSKQEISQPTQPVQPAIQQPIQPIEPRNWHSQAPIRRGTRHEKQQINRSVSAQDSLLVERPSTRSEKQNLNRTVSVNDKLLMTPNHSGSALSRTSASGSKTLTSPRSSGSKHKQDLSSQSPPPPRLSKVAPGKPTVVSSRGLVPVQEEPKTQTAQPVLERKSDLPVYQTRKEKEAQALKEAQAQKEKEKETETEEKEQPEANGRRKRGLSSPVLPLDPIRHLDLNWRSGSGKSQESTIHKYFALVPSTPEAQR

SEQ ID NO: 38350 - DNA, 672 bp, Panicum virgatum
  misc_feature: Ceres CLONE 1993538
  misc_feature: Encodes the peptide sequence at SEQ ID NO. 38351
acgaaccctaccaaagctagctaatcgctcgatcggtcctcatccgctgcccatggctcccgccgccctcttcgccgccaataacgcaatccgctgccagccatgtccgccgcgactgctgagccaatgccacagtagtcctcgtcgtctgcatttggcttccgcttccggacgaggcgctgcaacgccggcgtcaagcttgtccaccacctgggagtgtccaactgttcacagtcaagaatcactgatccgtcttcccgggcgagccgatggcctcgcgaatgtactggcgatcggcactgcaaacccacccaactgcgtgctgcaggacgagtaccctgattggttcttccgggtcacccaaaccgaccacctcacccacctcaaagccaagatgaagagaatctgtggcagaaccgaaatcaagaaacgctacttccactatgacgaggacctgatccgcagcaacccagagttcctggacagcacgctaccatccctgaccgcgcggcaagccatcacggccaccgccgtgccggagctcgccgcggccgccggtgccaaggccatcgccgagtggggaaggccgccgtcgtacatcacccacctcatcttctgcacctactcctgcacccacatgcctggcgccgaccttcggctggcgtccctact

SEQ ID NO: 38351 - protein, 206 aa, Panicum virgatum
  misc_feature: Ceres CLONE 1993538
  misc_feature (61)..(206): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature: The sequence is a functional homolog of SEQ ID NO 2 in US patent 7202397
MAPAALFAANNAIRCQPCPPRLLSQCHSSPRRLHLASASGRGAATPASSLSTTWECPTVHSQESLIRLPGRADGLANVLAIGTANPPNCVLQDEYPDWFFRVTQTDHLTHLKAKMKRICGRTEIKKRYFHYDEDLIRSNPEFLDSTLPSLTARQAITATAVPELAAAAGAKAIAEWGRPPSYITHLIFCTYSCTHMPGADLRLASL

SEQ ID NO: 38352 - DNA, 1433 bp, Panicum virgatum
  misc_feature: Ceres CLONE 1993540
  misc_feature: Encodes the peptide sequence at SEQ ID NO. 38353
aaactaacgctaaaaaagtaacagtttctgtactttattggttcgcgcaactccgtattccaacatgggcaaggataagacgcacgtttcgctcgtcgtcatcggccacgtcgatgccggcaagtccacggccaccggccacttgatctacaagtgcggtggtatcgacaagcgcacgatcgagaagttcgagaaggaagccgccgagatgggcaaggcgtccttcaagtacgcttgggtgctggacaagcttaaggcggagcgcgagcgtggcatcaccatcgacattgctctgtggaagttcgagtcgccgaagtcggtgttcacgatcatcgatgcccccgggcaccgtgacttcatcaagaacatgatcaccggcacgtcgcaggctgacgccgcgatcctcatgatcgcgtccggccagggcgagttcgaggctggtatctcgaaggacggccagacccgcgagcacgctctgctggcgttcacgctcggcgtgaagcagatgatcgtcgcgacaaacaagatggacgacaagtcggtcaactactcggaggcgcgttatgaggagatcaagaaggaggtcggctcgtacctgaagaaggtcggctacaacgtcgagaaggtgcscttcgtgcccatctcgggctggaacggcgacaacatgatcgagaagtcggacaacatgccgtggtacaagggcccgacgctgctggaggccctcgacctccttgaggcgccgacccgcccgtcggataagccgctccgcctgccgctgcaggatgtgtacaagatcggcggtatcggcaccgtgcccgtgggccgtgtcgagaccggcatcatgaagccgggtgacgtcgtgacgttcgcgccgtcgggcgtgacgactgaggtcaagtcgatcgagatgcaccacgagcagctccccgaggccgcccccggtgacaacgttggtttcaacgtcaagaacatctctgtcaaggacatccgccgtggcttcgtttgctcgaactcgaagaacgaccccgcgaaggagtgcgaggcgttccaggctcaggtcatcgtgctaaaccacccgggccagatctcgtcgggatacgcgccggtgctcgactgccacacgtcccacatcgccgtcaagttccaactgatcgagtcgaagattgaccgccgctcgggtaaggagctggagaaggagccgaagtccgtcaagtcgggcgacgcgtgcatcgtgaacatggtgccgacgaagccgatgtgcgtcgagaccttcaccgagtacccgccgttgggccgcttcgccgtccgtgacatgcgccagacggtcgccgtcggtatcatcaagggcgtgacgaaaaaggaggccggctcgaaggtgacgaagtccgccgccaaggcgaccgccaagaagtgatcgcatggtggcgcttcac

SEQ ID NO: 38353 - protein, 449 aa, Panicum virgatum
  misc_feature: Ceres CLONE 1993540
  misc_feature (5)..(225): Pfam Name: GTP_EFTU Pfam Description: Elongation factor Tu GTP binding domain
  misc_feature (322)..(430): Pfam Name: GTP_EFTU_D3 Pfam Description: Elongation factor Tu C-terminal domain
  misc_feature (248)..(315): Pfam Name: GTP_EFTU_D2 Pfam Description: Elongation factor Tu domain 2
  misc_feature: SWISSPROT Homolog: EC 2.7.7.4 Sulfate adenylyltransferase
  misc_feature (189)..(189): Xaa is any aa, unknown, or other
MGKDKTHVSLVVIGHVDAGKSTATGHLIYKCGGIDKRTIEKFEKEAAEMGKASFKYAWVLDKLKAERERGITIDIALWKFESPKSVFTIIDAPGHRDFIKNMITGTSQADAAILMIASGQGEFEAGISKDGQTREHALLAFTLGVKQMIVATNKMDDKSVNYSEARYEEIKKEVGSYLKKVGYNVEKVXFVPISGWNGDNMIEKSDNMPWYKGPTLLEALDLLEAPTRPSDKPLRLPLQDVYKIGGIGTVPVGRVETGIMKPGDVVTFAPSGVTTEVKSIEMHHEQLPEAAPGDNVGFNVKNISVKDIRRGFVCSNSKNDPAKECEAFQAQVIVLNHPGQISSGYAPVLDCHTSHIAVKFQLIESKIDRRSGKELEKEPKSVKSGDACIVNMVPTKPMCVETFTEYPPLGRFAVRDMRQTVAVGIIKGVTKKEAGSKVTKSAAKATAKK

SEQ ID NO: 38354 - DNA, 1930 bp, Panicum virgatum
  misc_feature: Ceres CLONE 1993551
  misc_feature: Encodes the peptide sequence at SEQ ID NO. 38355
attgaaaattaaaaaattgcaaaaaagctccgcagaatgacttctctgagcagggtgcttcccttcatctgccttttcctttgtgtccttccttgtttatctactggtgtcgaagatgctgtcaccaaggactttgctgcttaccttcgaacaactcccaaccccatggctagtccccactactttatctatcaggctctatttgaatccgaacccctcaaatacagagacggaaacaacgccagttgcattatctgcactatcctcgtcggaatgagtcttcaagttgctgacatccacaaagtcaccattgacgactttatcatgaaagacctctgcgacttgttccccgaccaaatcaagccagcttgccaagaaatcgtcaagaacttcggacccatcatcatccaagctcttaccgaaaccagcagccctgatgaggtttgccttaaagttaagagctgcctctaccccgaatgcaaacttttcgtcaacgtaactcctccagctgtccagctttcccctcactggaccagataccttcaagacgacatctacatccccgaaattttcggtgttaagttctcccccttcgctgagctcatcaagcttatcggagaaatcctgcaaacccttgtgcccatggacgatgtcgatggtgatcgccacagtccatctatggctgaagtcagaggatacaactggagaggacgtgattgcgacgacatggacgctcgcgtgtacccaggcagaaaagaggatccttatggcggtcaagcttctgatttcaactgcaatggtatctccggaaaagatcccgctactggaaaagattacaaagatctcttctgtaccgagtctggacaaatgggagtgctcttattgggtgactcagcaggaatctttgctcagatccccaacgaattggctactgctgctgattggaacaagacaaccttcgctgagatctggcctactgtgttgaaccaaggcggacatcctcagttcagtgcttatactggttatgaagacattggcatgttgaaccagagcgtgcacgctgtctacaagaacttgtacgagagaaacaagtgcaatttcagagattaccaaaatctcgctgtcagtggagctgacagtggaagcactctcggcaacgcgaaatacgtcaacagaaaccaaaccaccgatttccctctcttggtgatcatggaactcgccgccaacgacgtctgctttggtaataccgttgcccctgaatctttcagacagaacattctcaatattcttgactggttggacactgttgtcccagctggatcccactttgtctcgattggtcttgtcaatggcagcatcatccatgagatcactggaaaccgcaagcaccctatgggaatgtcctacaacgttttctatgattatttgaactgcctcggcattgatttgtgtgagaactatttgaccagcaacgttacacacatcaactggactgctgataaagctgcggcattgaatcaaatctaccttgaaatcttcagcaactacaccgccaagaacttcgatttcatacattatgacttccctgctcaacaaatcatcgatacttggacctctcaaggaggtgatccatttgacttgatttctcacgttgatggattccatcccagccaaaacttcaacatgttgttgggagatttcctctggacttctctgactagagatcgcccacaatggctcggtgttgagaaccctaacaatgctcaaattgaaagtttgttcggtaaccagggaggatattaaataaataataactttctgatgaagtaatcatactttataatagatataatcgtaagtcgattgatatatttaaagatagtaagaagtaattcgagctatgaaatcacaatatcaaagtgaaagagat

SEQ ID NO: 38355 - protein, 588 aa, Panicum virgatum
  misc_feature: Ceres CLONE 1993551
  misc_feature (109)..(143): Pfam Name: SapB_2 Pfam Description: Saposin-like type B, region 2
  misc_feature: SWISSPROT Homolog: EC 3.1.1.77 Acyloxyacyl hydrolase
MTSLSRVLPFICLFLCVLPCLSTGVEDAVTKDFAAYLRTTPNPMASPHYFIYQALFESEPLKYRDGNNASCIICTILVGMSLQVADIHKVTIDDFIMKDLCDLFPDQIKPACQEIVKNFGPIIIQALTETSSPDEVCLKVKSCLYPECKLFVNVTPPAVQLSPHWTRYLQDDIYIPEIFGVKFSPFAELIKLIGEILQTLVPMDDVDGDRHSPSMAEVRGYNWRGRDCDDMDARVYPGRKEDPYGGQASDFNCNGISGKDPATGKDYKDLFCTESGQMGVLLLGDSAGIFAQIPNELATAADWNKTTFAEIWPTVLNQGGHPQFSAYTGYEDIGMLNQSVHAVYKNLYERNKCNFRDYQNLAVSGADSGSTLGNAKYVNRNQTTDFPLLVIMELAANDVCFGNTVAPESFRQNILNILDWLDTVVPAGSHFVSIGLVNGSIIHEITGNRKHPMGMSYNVFYDYLNCLGIDLCENYLTSNVTHINWTADKAAALNQIYLEIFSNYTAKNFDFIHYDFPAQQIIDTWTSQGGDPFDLISHVDGFHPSQNFNMLLGDFLWTSLTRDRPQWLGVENPNNAQIESLFGNQGGY

SEQ ID NO: 38356 - DNA, 632 bp, Panicum virgatum
  misc_feature: Ceres CLONE 1993553
  misc_feature: Encodes the peptide sequence at SEQ ID NO. 38357
aaatcctctcctgctagccctcgccacccctgcctcactcgaaccgcgccgcgccccaaaccctagcgcagccgcggtgtgaggcgcaccgctccaatccaaccccaatagcttcggccccgattctcctgccacccccccccccaaccccccctcaaaccccggccgcccttctccgcctccgccgtcctctgtaatttttcgaattctgtattgggaatatttgtggtgcttttttggttgtttgtttcaggagcgcgtgtcctcggaggattcgcggcggctgggctagggttttggcgtctcggtcaagggtgcgccatctgctccgtgggatctcccggaaccaggattgctgtcagtcaccatgtcatcatatcctgtgctaaacaaccgaccaattgatcagtggagagttactgatctgaaggatgaactccgtaaaagaaggcttcctgtcaagggtttgaaagaggaacttgtgaggcgactttttgaatccattcagagtgaaaaagcagctgatgaagctgatgaagctgatgaagacgcgggagcgaatgcagatgatcagttgcctgatgccaatgctagtgaacaaactacagttaccatcacagaagttcatcatg

SEQ ID NO: 38357 - protein, 88 aa, Panicum virgatum
  misc_feature: Ceres CLONE 1993553
  misc_feature (12)..(46): Pfam Name: SAP Pfam Description: SAP domain
MSSYPVLNNRPIDQWRVTDLKDELRKRRLPVKGLKEELVRRLFESIQSEKAADEADEADEDAGANADDQLPDANASEQTTVTITEVHH

SEQ ID NO: 38358 - DNA, 1348 bp, Panicum virgatum
  misc_feature: Ceres CLONE 1993564
  misc_feature: Encodes the peptide sequence at SEQ ID NO. 38359
ggggagagggagagagagagaagggaacagcagccgagggttgagctgtgtgagccttgaacaaagctaagtgaagcattcacatactacttacatatacactatatagatatacatagatagccagagagacttgcaggctccatgcttgggagatgaaacttgggtgtggtggtcgtcgtcgatgatggcgggggagctcgcgcttgccgctctggcgacgatcctgctcgcctggctcctggccctggtgctgagccacttcctgcccttgctcctgaaccccaaggcccccaggggcaccttcggatggccgctcgtcggtgagacgctcaggttcctcacgccccatgcttccaacaccctgggcggcttcctggaggatcattgcgccaggtatgggcgggtgttcaagtcccacttgttctgcacccccacggtggtgtcctgcgaccaggacctcaaccacttcatcctgcagaacgaggagcggctgttccagtgcagctaccccaggccgatccatggcatcctgggcaagtcctccatgctcgtggtcctgggcgaggaccacaagcgcctcaggaacctcgccctcgccctcgtcacctccaccaagctcaagcccagctacctcggcgacatcgagaagatcgcgctgcacgtcgtcggctcatggcgccaggccgccgagggcagcaaggacggcgacggcagcggcggcggcggcagggtcgtcgtcggcttctgcgaggaggcaaggaagttcgcgttcagtgtgatagtgaagcaggtgctggggttgtcaccagaggacccggtcactgccaggatactggaggacttcctggccttcatgaagggcctcatctccttccctctctacatcccagggaccccatatgccaaggctgtccaggccagagagaggatatcaagcactgtgaagggcatcatcgaggagcggaggagtccagggtcatgcaagaaaggcgatttccttgacgtgctcctgtcaaccaacgagctctccgatgaggagaaagtgagctttgtgctggactccctgctgggagggtacgagaccacctcgctcctgatctccatggtcgtgtattttcttggacagtctgcagaagatctgggcctggtcaagagggagcacgacagcataagatccaacaaagggaaggaggagagcttgacttcagaagactacaagaagatggaatatacccaacatgttatcaacgaggctctgagatgcggcaacatcgtcaagttcgtccacaggaaggccctcaaagatgtcagatacaaagagtatctgattccatctggctggaag

SEQ ID NO: 38359 - protein, 386 aa, Panicum virgatum
  misc_feature: Ceres CLONE 1993564
  misc_feature (36)..(386): Pfam Name: p450 Pfam Description: Cytochrome P450
  misc_feature (189)..(386): SWISSPROT Homolog: EC 1.14.13.93 (+)-abscisic acid 8'-hydroxylase
  misc_feature (34)..(165): SWISSPROT Homolog: EC 1.14.13.76 Taxane 10-beta-hydroxylase
  misc_feature: Useful for making plants with modulated oxidative stress sensitivity
MAGELALAALATILLAWLLALVLSHFLPLLLNPKAPRGTFGWPLVGETLRFLTPHASNTLGGFLEDHCARYGRVFKSHLFCTPTVVSCDQDLNHFILQNEERLFQCSYPRPIHGILGKSSMLVVLGEDHKRLRNLALALVTSTKLKPSYLGDIEKIALHVVGSWRQAAEGSKDGDGSGGGGRVVVGFCEEARKFAFSVIVKQVLGLSPEDPVTARILEDFLAFMKGLISFPLYIPGTPYAKAVQARERISSTVKGIIEERRSPGSCKKGDFLDVLLSTNELSDEEKVSFVLDSLLGGYETTSLLISMVVYFLGQSAEDLGLVKREHDSIRSNKGKEESLTSEDYKKMEYTQHVINEALRCGNIVKFVHRKALKDVRYKEYLIPSGW

SEQ ID NO: 38360 - DNA, 719 bp, Panicum virgatum
  misc_feature: Ceres CLONE 1993581
  misc_feature: Encodes the peptide sequence at SEQ ID NO. 38361
ataccgatacctacctatagctagctacgagttgtagctggtgatatgcatcaccctggccttctcctccattctttcagagagagagagagagattggttcatccctcagttcagttcataccggatcgagctagctagaagcagagagatggcgtcgagcggcggcggcaacaacggaggaggagacgagtggctgatcagggaggcgctgctggctccggcaggcaacggcaacggtagcggcggcaaggtggaggtggcggacctggaggagatccggagcgtgcgggcgttcctgcggcacgcggcggaggagaaccggcggctctggtacctggcgggccccgccatcttcacgtccatcgcgcagtactcgctcggcgccgtcacgctcgtcttcgccggccacctcaccacgctcgagctcgacgccgtctccaccgagaacaacgtcgtcgccgggctcgccttcggcatcatgcttgggatgggtagcgcgctggagacgctgtgcgggcaggcgtacggcgcgaagcagctgcacatgctgggcgtgtacctgcagcgctcgtggatcatcctcgtcgccatggccgtgctcatgctccccatctacctcttcgccaccccgatcctgggcttcttccaccaggacgccgagatcgccgccctcgcggggcggctcgcgctctacatgatcccgcagctcttcgccta

SEQ ID NO: 38361 - protein, 189 aa, Panicum virgatum
  misc_feature: Ceres CLONE 1993581
  misc_feature (66)..(189): Pfam Name: MatE Pfam Description: MatE
MASSGGGNNGGGDEWLIREALLAPAGNGNGSGGKVEVADLEEIRSVRAFLRHAAEENRRLWYLAGPAIFTSIAQYSLGAVTLVFAGHLTTLELDAVSTENNVVAGLAFGIMLGMGSALETLCGQAYGAKQLHMLGVYLQRSWIILVAMAVLMLPIYLFATPILGFFHQDAEIAALAGRLALYMIPQLFA

SEQ ID NO: 38362 - DNA, 1792 bp, Panicum virgatum
  misc_feature: Ceres CLONE 1993603
  misc_feature: Encodes the peptide sequence at SEQ ID NO. 38363
ataaagctaatttttaaattttatattaccagtagcagtctttttatgtaagctttgtttacaatctgaagatacttactgcacataaaacaatacaacaacaataagacagccttttggtctcaagatagtggtgttgataattcctttcccagtttttatacacattcttttgactttattaagcaacctcctttaattggttgtgtcttgattgttgctagttccattctacttgatgctgtgagctcacacttcatttatgtcactattcctgtagtttcttcttagagtaattatttggaaaaggtatcgctgctttaagtttgctcgttcaccttcttttctcaattccacagccttgcaattgctaaagaaggtgaactctcaattggaacaattgatgatatccaaaaacttcacatccgtacaatcccccttaatgaacaagcacggcgcatttgccaccaggagcaatcaaggacactagcattttgcagtttcaagtacaaccagactagtatggaggaaagtgagactcattacatccgtctgttagatcatcagacttttgagttcctgtctacatatcctctagatcaatatgaatgtggctgctccatcattagctgctcatttgcggatgataataatgtctattactgtgttggaactgcatatgttatacctgaggaaaatgaaccaacaaagggccggatccttgtatttgctgttgaagatggaaggttgcagttaattgtagagaaagaaactaaaggagcagtttattcgctgaatgcattcaatgggaaattgttggctgctatcaaccagaagattcagttatataagtggatgctacgcgatgatggttcacacgagctgcaatctgagtgtgggcaccatgggcacatactggccttgtatactcaaacccgtggtgacttcattgtggttggtgatctgatgaaatcgatatccttgctggtctacaagcatgaggaaagtgcgatcgaagagcgtgctagggattacaatgcaaactggatgactgcagttgagatgcttgatgatgaagcctatatcggggcggaaaatagttataacctattcactgtacgcaagaacagtgatgcagccacagatgacgaaagggccaggctggaggttgttggggagtaccatctcggagagtttgtgaataggttccgccatggttcactcgtaatgcgccttccggactcagagatagggcagattcccacagtcatctttggcacaataaatggggtaattggcatcatcgcctccctcccacatgaccagtacatgtttctagagaagctccagtccactcttgtgaagttcataaagggtgtcggaaacctgagccatgagcaatggcgttcgttccataatgataagaagacagccgaggctcggaacttccttgatggcgacctgattgagtcattccttgaccttagcaggagtaagatggaggaggtgtccaaggctatgggtgttcctgtggaggagctgtccaagagagtggaagagttgactaggctgcactagatgaataagttagctgtttgctgtaacatgtaaatcctttgtaacttgtattttgtactgtcgcagtggcatgtagttttcagtgcagggagtttcctcggcgatgctgttgccgccggttgcacaagtgttcacccggttgtagtttcctttgctttgttggatggctacttttcatctgacagtttggtgagtttgtttttcgtaaaccctc

SEQ ID NO: 38363 - protein, 351 aa, Panicum virgatum
  misc_feature: Ceres CLONE 1993603
  misc_feature (3)..(290): Pfam Name: CPSF_A Pfam Description: CPSF A subunit region
MEESETHYIRLLDHQTFEFLSTYPLDQYECGCSIISCSFADDNNVYYCVGTAYVIPEENEPTKGRILVFAVEDGRLQLIVEKETKGAVYSLNAFNGKLLAAINQKIQLYKWMLRDDGSHELQSECGHHGHILALYTQTRGDFIVVGDLMKSISLLVYKHEESAIEERARDYNANWMTAVEMLDDEAYIGAENSYNLFTVRKNSDAATDDERARLEVVGEYHLGEFVNRFRHGSLVMRLPDSEIGQIPTVIFGTINGVIGIIASLPHDQYMFLEKLQSTLVKFIKGVGNLSHEQWRSFHNDKKTAEARNFLDGDLIESFLDLSRSKMEEVSKAMGVPVEELSKRVEELTRLH

SEQ ID NO: 38364 - DNA, 716 bp, Panicum virgatum
  misc_feature: Ceres CLONE 1993605
  misc_feature: Encodes the peptide sequence at SEQ ID NO. 38365
accttttgccccactccctcctccccacctctcgttctctcctccctctccctctccctctccctctccctccgctccccacccctctcccttctcaagcgcgcgcccgcccgcccagatctagggtcccccccccgcggcgaagatgagcagcccccatggcggcctcgacgaccagatcgagcggctcatgcagtgcaagccgctccccgagcccgaggtcagagcgctgtgtgagaaggcgaaggagattctgatggaggaaagcaatgttcagcctgtaaagagtcctgttacaatttgtggtgatattcatggacaatttcatgatcttgctgaactcttccggattggtggaaagtgtccagatacaaactacttgtttatgggagattatgttgatcggggctactattctgttgaaaccgtcacgcttttggtggctttaaaagttcgctatcctcagaggatcaccattcttagaggaaaccacgaaagccgacagatcactcaagtttatggattctatgatgagtgcttaaggaagtatggaaatgcaaatgtctggaaaaccttcacggacctctttgactacttccccttgacagcgttggttgagtcagaaatattttgcttgcatggtggattatcaccatctatcgaaaccctcgataacatccgcaacttcgatcgtgtccaagaagttcctcatgaag

SEQ ID NO: 38365 - protein, 190 aa, Panicum virgatum
  misc_feature: Ceres CLONE 1993605
  misc_feature (48)..(189): Pfam Name: Metallophos Pfam Description: Calcineurin-like phosphoesterase
  misc_feature: SWISSPROT Homolog: EC 3.1.3.16 Phosphoprotein phosphatase
  misc_feature: The sequence is a functional homolog of SEQ ID NO 13 in US patent 7271316
MSSPHGGLDDQIERLMQCKPLPEPEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHE

SEQ ID NO: 38366 - DNA, 688 bp, Panicum virgatum
  misc_feature: Ceres CLONE 1993609
  misc_feature: Encodes the peptide sequence at SEQ ID NO. 38367
agcaccatggcgtccctcctgctagcaacagtgttgtccttcggtttcatcctcatctccacgtacgccttccagctgatcgccgccgctcgccgcaacctcccccctggccccttgccgctgccggtcgtcggcaacctcctcaccatcggacggggcagccctcagcgctccctagctcgcctcgccgagcgctacggccccatgatgtccctccggctcggtgtcgtcccggcggtcgtggtctcctcggcggacgccgcgcgcgaggtcctccagaggcacaacgcttgcctggcggaccgccccatgatcgacgcctggcaggccaacgggcaccgcgccaactccgtcatcgcgctcccgccgcacgccaagtggcgcgccatgcggcggctctgcgcggcggagctgttcgcgccgggccggctggaggggctccggccgctgcggcagcacaaggtgcgggagctgctccgccacgtctccggcaaggcggcgctcggcgagcccttcgccgtccgcgagccggtgttcaccgcggccatgaacatcctgtcgcggacgatgttctccgtcgaccttgactccggcccggcgtcgtcgtcgtcatcactcggtcgtggcctctgcgatgccgtcaaggaggccacgatcctggcggcgacgcccaacgtgtcggacttct

SEQ ID NO: 38367 - protein, 227 aa, Panicum virgatum
  misc_feature: Ceres CLONE 1993609
  misc_feature: SWISSPROT Homolog: EC 1.14.13.71 N-methylcoclaurine 3'-monooxygenase
MASLLLATVLSFGFILISTYAFQLIAAARRNLPPGPLPLPVVGNLLTIGRGSPQRSLARLAERYGPMMSLRLGVVPAVVVSSADAAREVLQRHNACLADRPMIDAWQANGHRANSVIALPPHAKWRAMRRLCAAELFAPGRLEGLRPLRQHKVRELLRHVSGKAALGEPFAVREPVFTAAMNILSRTMFSVDLDSGPASSSSSLGRGLCDAVKEATILAATPNVSDF

SEQ ID NO: 38368 - DNA, 601 bp, Panicum virgatum
  misc_feature: Ceres CLONE 1993615
  misc_feature: Encodes the peptide sequence at SEQ ID NO. 38369
gccgtttggcccatgtctccacaccagcagccaggctcgacctgagcaaagcaacgccgagctaccagcgcgtcgcctaccctgtcgctgtcagcctgcccccctcccccttcccctcggttccggcggtcatggcggtggcggctcccggacagctcaacctcgacgaagccccgtcatggggctcccgcaccgtcaactgctttgagaagctcgagcagatcggcgagggcacctatgggcaagtgtacatggcgaatgagacgggcaccaacgagatcgttgcgctcaagaagatccgcgtggacaacgagcgggagggcttccctattactgccatacgcgagatcaagatcctgaagaagcttcaccaccagaacgtcatcaagctcaaggagattgtcacctccccaagcccagagcgagatgagcaagggaagccgatcgatggtaacaagtacaaggggagcatttacatggtctttgagtatatggatcatgacctcaccggtcttgccgataggccaggaatgcggttcactgtgccacagattaagtgttacatgaggcagctgcttaccggcctgcactattgccatgt

SEQ ID NO: 38369 - protein, 156 aa, Panicum virgatum
  misc_feature: Ceres CLONE 1993615
  misc_feature (25)..(156): Pfam Name: Pkinase Pfam Description: Protein kinase domain
  misc_feature: SWISSPROT Homolog: EC 2.7.11.22 Cyclin-dependent kinase
MAVAAPGQLNLDEAPSWGSRTVNCFEKLEQIGEGTYGQVYMANETGTNEIVALKKIRVDNEREGFPITAIREIKILKKLHHQNVIKLKEIVTSPSPERDEQGKPIDGNKYKGSIYMVFEYMDHDLTGLADRPGMRFTVPQIKCYMRQLLTGLHYCH

SEQ ID NO: 38370 - DNA, 749 bp, Panicum virgatum
  misc_feature: Ceres CLONE 1993619
  misc_feature: Encodes the peptide sequence at SEQ ID NO. 38371
aattgcttttttttaaaaaagaattccaattccaattcgtctccgtcttccgagttccgactccgccgcctgtacggatgcccatggcctaccctaccgttgcttaatccccggctccctcctccgcggcttccatgccctaagctagttgctgctgctgctttgcttcaggcctgggttttccttcgtcccctcgccaatcgcagccaattgctttccccaattgcagttgccgctgatctaggctagggtttccccagcggccactccggctctcggcagattgaaattgaactagctcgccgcttccttgagcaatcgaatccaatcaagtccgatcggggatggccaccacccagttcgccatggtcgaggagctggcctcgctcatcaaggacaacctgcacagcaagcacctcatcctctccaccgaggaggccctcatcgccgccctccagcagctgcgctgcgccgacgacggcgacagcgacggtggagaggaggacggtgcggcggacaccatagagctccggcccgccggggcctaccaccgccttctcttgcatcgccttgctgaaatctacgggttcgctcatgaatcggttggtgaaggcgaggatcggcacctggtcctccagcgctgccctgaaacagccatccctcctgtccctattagtgatattgttatggaagttttgacacagtgatgattccacatcccgttgatgattccctatctgttgtgctaa

SEQ ID NO: 38371 - protein, 120 aa, Panicum virgatum
  misc_feature: Ceres CLONE 1993619
  misc_feature (34)..(100): Pfam Name: R3H Pfam Description: R3H domain
MATTQFAMVEELASLIKDNLHSKHLILSTEEALIAALQQLRCADDGDSDGGEEDGAADTIELRPAGAYHRLLLHRLAEIYGFAHESVGEGEDRHLVLQRCPETAIPPVPISDIVMEVLTQ

SEQ ID NO: 38372 - DNA, 702 bp, Panicum virgatum
  misc_feature: Ceres CLONE 1993619-R
gagcttgaagaaagaacagactggagcagctagaagaatgtttgcacatgcactggggctgtctgcagctcaaggaagttatggtgcactgcctaaaccgaagtaaagatccagagatgagatgtcgtgaattggagaaagaagcttgccaatgcatgctatccgcgctctttatccagtcatgcatatggcgtgggatgaatctgtgatggttggtgctcttttaagtccatctgctgcttctgcgaaatgatgtttgtgatgttggtagtagatggaaggtcttcttggttggatgttaactattggaccgacagaaaggatgaatctttgatggtgctcttttaagtccatctgctgcttctgtggaatggtgtttgtgatgttggcagtagatggaaggtcttcttagttggatgttaactattggcagacagagagggtatgtgacccttgttggaagaagagcgtagttggccacacccttgattgaagcagcagcctcaaggcctaagcttagttggggaaagagcttgcggatgcacattgcatgcggagctgagctgtgcaagtgcttcactggagtggaagaaacattgtcgtccttgcttatactgtgttgtgtttttagctccaggttgtaatgtgtcctagtatgtgttttggaaagacatgtcataatactacaattaaacttgctgc

SEQ ID NO: 38373 - DNA, 695 bp, Panicum virgatum
  misc_feature: Ceres CLONE 1993629
  misc_feature: Encodes the peptide sequence at SEQ ID NO. 38374
acacaccatcagtaacctagctagctttattccgggtctccagcagcggtactgtgatctacagctaccatggcttcctacattggcagcaagtctcgcatcacggcagccttgatgctgcttgttgctgccataaccatgatgagccacatcttcgtcgaggtggaggcccgggacctgtcggctggaagcgacggcaagaaggccatgaaggagaggcaccacaagtggatggcgcagcacggccgcacctacagcaacgaggcagagaaggcgcaccggttccaggtattcaaggccaatgctgcttttgttgacagatccaacgctgcagctggcaagaagtatcacctggcgatcaacgagttcgccgacatgaccagcgacgagttcatggacatgtacactggcttcaagccagtgccgaccggggtcaacaagatacccggttttatgtacgggaatgttacactgtcttcagatgaccagcagatgattgactggaggcagaaaggcgcagtcactggtgtcaagaaccagggccagtgtggttgttgctgggctttctctgcggtcgccgccgtggagggcatccatcagatctcgaccggcaacctggtctcgctgtcggagcagcagctgctggactgctccacagacgggaaacacggctgcaacggcggtctcatggacaa

SEQ ID NO: 38374 - protein, 208 aa, Panicum virgatum
  misc_feature: Ceres CLONE 1993629
  misc_feature (51)..(108): Pfam Name: Inhibitor_I29 Pfam Description: Cathepsin propeptide inhibitor domain (I29)
  misc_feature: SWISSPROT Homolog: EC 3.4.22.31 Ananain
MASYIGSKSRITAALMLLVAAITMMSHIFVEVEARDLSAGSDGKKAMKERHHKWMAQHGRTYSNEAEKAHRFQVFKANAAFVDRSNAAAGKKYHLAINEFADMTSDEFMDMYTGFKPVPTGVNKIPGFMYGNVTLSSDDQQMIDWRQKGAVTGVKNQGQCGCCWAFSAVAAVEGIHQISTGNLVSLSEQQLLDCSTDGKHGCNGGLMD

SEQ ID NO: 38375 - DNA, 708 bp, Panicum virgatum
  misc_feature: Ceres CLONE 1993637
  misc_feature: Encodes the peptide sequence at SEQ ID NO. 38376
aagtagcctgcgagcaaatcagacgaaaccctcccctccccgatcccccatggcgcaggacgagaccccggagccctccgccaccgcatccggctcctcctcctcctcctcctcctctgccgccgccgccgccccggccgcccgtctcaatgccgccgcgcccgagttcaccccccgatccaccgcccagcaccacggcagcaaccctcaccgccgcgggtctcaccactaccagcagcaccaccaccagccgcatcaccaccaccacaaccaccacgtgccgcagcagcactaccagccgcggcaccagcagcaccaccagggcggcgaggatgaggggagcgccgccgcggcgggggaggataaggaggggcctgcgggcgcggggcaggcgcagcagccccgcctgaacgacgccgatgcccggaaggtcgtcaagcaggtggaattttacttcagtgatatcaatttggccacaactgaacatctgataaagttcatcactaatgatccagatggatttgtgccaatatctgtagttgcatcttttaggaaaatccgggagatagtttctgacagatctttgttggttgctgcactgcgcacatcgtcagagctggttgtttcagaggatgggaaaaaggttaaacgcctacgacccttcaacactgaagaagttcagtcacgtatcgttgttgctgaaaattt

SEQ ID NO: 38376 - protein, 219 aa, Panicum virgatum
  misc_feature: Ceres CLONE 1993637
  misc_feature (128)..(187): Pfam Name: La Pfam Description: La domain
MAQDETPEPSATASGSSSSSSSSAAAAAPAARLNAAAPEFTPRSTAQHHGSNPHRRGSHHYQQHHHQPHHHHHNHHVPQQHYQPRHQQHHQGGEDEGSAAAAGEDKEGPAGAGQAQQPRLNDADARKVVKQVEFYFSDINLATTEHLIKFITNDPDGFVPISVVASFRKIREIVSDRSLLVAALRTSSELVVSEDGKKVKRLRPFNTEEVQSRIVVAEN

SEQ ID NO: 38377 - DNA, 1777 bp, Panicum virgatum
  misc_feature: Ceres CLONE 1993645
  misc_feature: Encodes the peptide sequence at SEQ ID NO. 38378
acaacaagttcagatatcagataattagtgtgcgcaaagccctagctccttattgatatcagagttgtgtgagctctagccgatatactatctgatcgcgtgaaaatgggtgaggaggcgccgacggcggtgtacgtcgacggctgccccggatgcgccatagagcggaagaaggaggccaacaagggcatcccctacaaagagttcttctttgtcgccgtcaccaccgttgcctccgctttaccaatatcatccttgtttcccttcttatactacatgatcgaagatctgcatgttgcaaaaaaggaacaagatattggattatacgctggttttcttggtgcatcttactttgttggtcgatttttggcctcactcttctggggtgtagtggctgatcgtattgggcgaaaaccgatcatcatattttctgtcctctcagtggttatagttaacactttatttggactaagtacgaagtattggatggcaattactacaagattgattctaggtgctctcaatggcatgcttgcgccaataaaggcttactcaatcgagatttgtcgtcctgaacaccacgctctagggctatcaattgtaagcactgcttggggcctaggtcttgttgtgggcccatccattggaggctacttggcacggccagcacagcagtatccaaacatgttctctgacaaatcaatttttgggaggttcccatatctcttgccatgcctttgtatttcaatttttgctgctgtggttctagtaagctgcatatggttaccggagacacttcataagcacaaaaacatagacaatgagatagaaatgtccagtgattcaagagcttcacagacaggagagatacatggtgacaaaagtctatgtaagaattggccattgatgtcttctatcattgcatattgtgttttcacacttcatgacacagcatacagcgagatactttcattgtggaccataagtgacagaaagtatggtggactaagcttttcatctaaagaagttggccaacttcttgcagttgctggtgctggacttattgtgtatcaactattcatctatagaccagtccacaaatttctgggatgtgtcaattcatgccgtgcttcatctgccctaacagtaccaattcttgctgcttatcccttcatgacgcacctgtatgggtatagacttggactagctctttattctgctgccattgtgaaaggtgctcttggtattactgccctgacgggcacttcgcttctccagaactatgccgtgccacagagccaaagaggcgctgctaatggcatagctgcaactgcaatgtccttcttcaaggctattggtcctgccggagcaggtgttttattctcgtgggcccaaaagcgccaacatgctgccttctttccaggggatcaaatggtgttttttattctgaacattgtccaatgtattgggcttgtgctgacctttaagccattcttagcagtaccagaccgctatgatctgaagtagctgctagatccctcagcaatggaataatggtgaatttgcagaagaaaaatatgcttcagctccaagaaattagcatgagtgttgtacaagataattatgtaacaccaaaagctgtgtattgtgccaaacaaaaaacagttgcatacttatgatcgatctatgtatcttttggttattccagttctaagttggcggtcatagtctgtgctcaagatagaactggaataatattttatctttaatttcccgg

SEQ ID NO: 38378 - protein, 473 aa, Panicum virgatum
  misc_feature: Ceres CLONE 1993645
  misc_feature (37)..(419): Pfam Name: MFS_1 Pfam Description: Major Facilitator Superfamily
  misc_feature: Useful for making plants with modulated flowering time
MGEEAPTAVYVDGCPGCAIERKKEANKGIPYKEFFFVAVTTVASALPISSLFPFLYYMIEDLHVAKKEQDIGLYAGFLGASYFVGRFLASLFWGVVADRIGRKPIIIFSVLSVVIVNTLFGLSTKYWMAITTRLILGALNGMLAPIKAYSIEICRPEHHALGLSIVSTAWGLGLVVGPSIGGYLARPAQQYPNMFSDKSIFGRFPYLLPCLCISIFAAVVLVSCIWLPETLHKHKNIDNEIEMSSDSRASQTGEIHGDKSLCKNWPLMSSIIAYCVFTLHDTAYSEILSLWTISDRKYGGLSFSSKEVGQLLAVAGAGLIVYQLFIYRPVHKFLGCVNSCRASSALTVPILAAYPFMTHLYGYRLGLALYSAAIVKGALGITALTGTSLLQNYAVPQSQRGAANGIAATAMSFFKAIGPAGAGVLFSWAQKRQHAAFFPGDQMVFFILNIVQCIGLVLTFKPFLAVPDRYDLK

SEQ ID NO: 38379 - DNA, 1541 bp, Panicum virgatum
  misc_feature: Ceres CLONE 1993658
  misc_feature: Encodes the peptide sequence at SEQ ID NO. 38380
ctaaaaccctagcgcattcgtcccccaagcacgacagccatggcaaccaccgccgccgccgccgccgccaccccgctcgacgaagccaaggccaggaacgttctccgccaggttgagttctatttcagcgacagcaacctcccccgcgacgggttcctgcggaggaccgtcgaggaaagcgaggatggcttggtgagcttggctctcatatgctccttctcgcggatgaggtcgcacctagggctcgaatgggaggtgaagccggatactgtgccggaggagacggtgctcgcggttgcagaagtgctgcgccgttcctcctccctccgtatctctgaggacgggaagaaagttggtagagctaaggagttgctggagccagatgaggttatagagcaagtggactctaggacaattgctgcatcacctcttccttacaatgtaaaactggaagatgttgaatcgttttttgctcagtgtggcaaggtaaatagtgtgaggctacctcgacatgtttctgacaaaagacacttctgtggaactgctttagttgaattttctgaagaagatgaagctaaaggtgtttatgagaaaacacttgtttttgcaggggcagatctggaaataagaccaaagaaagatttcgatgctgaaagagaggtgaagaaagaagcatatgaaaaggcacaagctaataagaatagtggtgaaggttatccaaaaggtttgattctggccttcaagctgaagaaaattccagctaatggtggttcagaacaaaatggtggggacaaagtagatgatgctgaaggtgctgagaaggatggatctgccaatactgcagagaaatcaagtatagggcatgaagacaaggctcctgaggataaaggcgttgcgagtaaagaacagtcagatggtgttgaggagacggaaggggtagcggctggggaaactgcacaatctgttgacaaggatgataaaaacccttcaaacaatgatgaagacaaaatctcaagggaggatataaaagaagaattcacaaaatttggcacagtgcggtatgtggacttcagtaaaggggatgattctggatttattcggtttgaagatcccacagcagctgaaaaggcacgtgcatttgcagccattgcagatgaaggtggtttgattatgaagggccacattgttagtctggagcctgtttctggtcaagctgagaaggattactggagtgcaattcgaggcggtcaagataaatataaagacagccggggcaacagaggacgggactggaagaataacagaggcggaaggcactttggtggtgggaagagggggcgctttgactcccgtgatagggcatcaaataaagctcagaaagtttagctttaggtcctataacgaggaaaacatatatgctgatgccgcgctgctccagtctgcacctttggaagtggcatttggtgttttgcgccttttggttcttatgaatgttgggctgtgcattttaaagcgcagattatgaatgacaccatgttgac

SEQ ID NO: 38380 - protein, 448 aa, Panicum virgatum
  misc_feature: Ceres CLONE 1993658
  misc_feature (320)..(416): Pfam Name: RRM_3 Pfam Description: RNA binding motif
  misc_feature (21)..(93): Pfam Name: La Pfam Description: La domain
MATTAAAAAATPLDEAKARNVLRQVEFYFSDSNLPRDGFLRRTVEESEDGLVSLALICSFSRMRSHLGLEWEVKPDTVPEETVLAVAEVLRRSSSLRISEDGKKVGRAKELLEPDEVIEQVDSRTIAASPLPYNVKLEDVESFFAQCGKVNSVRLPRHVSDKRHFCGTALVEFSEEDEAKGVYEKTLVFAGADLEIRPKKDFDAEREVKKEAYEKAQANKNSGEGYPKGLILAFKLKKIPANGGSEQNGGDKVDDAEGAEKDGSANTAEKSSIGHEDKAPEDKGVASKEQSDGVEETEGVAAGETAQSVDKDDKNPSNNDEDKISREDIKEEFTKFGTVRYVDFSKGDDSGFIRFEDPTAAEKARAFAAIADEGGLIMKGHIVSLEPVSGQAEKDYWSAIRGGQDKYKDSRGNRGRDWKNNRGGRHFGGGKRGRFDSRDRASNKAQKV

SEQ ID NO: 38381 - DNA, 1246 bp, Panicum virgatum
  misc_feature: Ceres CLONE 1993659
  misc_feature: Encodes the peptide sequence at SEQ ID NO. 38382
atatcttcaactcacttcactacaccgtgatccagtcactcgccttgctggacggggcactctgcgagagatcttaaaaaacatagcacaggttctaccaagtaccaaccccgccgttgccactagttcaccagttctccttgacccaactaccgtttttcgagttcctcggttccgttctttttcgaacatcagcagaaccaaaaaacatcaccacccacgggtcaagtcatcccgggggcgaccttgaccatgactccctctgctgtacctccggaacccgccacggtgccctccgcgatactgaccaccactttcgacgacactcttcgcttctaccttaatggcacccgtgttgtgctcgacgaggtcgaccccgaagttacactacttgaatatctccggggtattggtttaacagggaccaagctaggttgcagcgaaggcggttgcggcgcctgcacagtcgttgtctcgcagtataacccgacaacgaagaagatatatcacgctagcgtcaatgcctgcctcgcacccctcgcctccgtcgacggaaaacatgtcatcaccgtggagggtatcgggaacgtcaggcggccccacccggctcaggaacgtgtggcaaagagcaacggctcccaatgcggcttctgtaccccgggcatcgtcatgagcttgtatgctcttctcaggaacaaccaggcaccgaccgagcacgatatcgaggaggcattcgatggaaatctgtgtcgctgtacgggataccggcccatcctagacgctgcgcaaacgttcagcgtgaagagggaagcgagtggggctaatgggtgtgggaatgcgaaggcgaatggggggagtggctgttgtatggagaacggtgatggcggcggatgttgcaaggatgggaaggtggacggcgtcgacgaccaacagatcaagagattcacaccgccggggttcatcgagtacaaaccggacaccgaactcatctttcccccggcactgaaaaagcacacgtttaagccgctggctttcggaaacaagcgcaagaagtggctccgccctgtaaccctacaccaactgctcgagatcaagagcgagtatccgagcgcgaagttaataggcgggagcaccgagacgcagatcgagatcaagttcaaggcgcttcagtacccggtctcggtatttgttggggacatcccggaactaaggcagtactccttgaaggaagaccatctggagatcg

SEQ ID NO: 38382 - protein, 331 aa, Panicum virgatum
  misc_feature: Ceres CLONE 1993659
  misc_feature (106)..(180): Pfam Name: Fer2_2 Pfam Description: [2Fe-2S] binding domain
  misc_feature (28)..(98): Pfam Name: Fer2 Pfam Description: 2Fe-2S iron-sulfur cluster binding domain
  misc_feature: SWISSPROT Homolog: EC 1.17.1.4 Xanthine dehydrogenase
MTPSAVPPEPATVPSAILTTTFDDTLRFYLNGTRVVLDEVDPEVTLLEYLRGIGLTGTKLGCSEGGCGACTVVVSQYNPTTKKIYHASVNACLAPLASVDGKHVITVEGIGNVRRPHPAQERVAKSNGSQCGFCTPGIVMSLYALLRNNQAPTEHDIEEAFDGNLCRCTGYRPILDAAQTFSVKREASGANGCGNAKANGGSGCCMENGDGGGCCKDGKVDGVDDQQIKRFTPPGFIEYKPDTELIFPPALKKHTFKPLAFGNKRKKWLRPVTLHQLLEIKSEYPSAKLIGGSTETQIEIKFKALQYPVSVFVGDIPELRQYSLKEDHLEI

SEQ ID NO: 38383 - DNA, 1274 bp, Panicum virgatum
  misc_feature: Ceres CLONE 1993689
  misc_feature: Encodes the peptide sequence at SEQ ID NO. 38384
accacccgctgacagacgccgccgcacacagccaccaccgcccaaatcccgcaaaaccctaaagctgcgactgggcgagagagggaggaggcgaagaggacggcatggcgggtgcgacgtcaccggcggcggccgcgaatctggcgggcaagtcgggggtccgcgtcgtcgtgatcggcgaccccggcaccggcaagtccagtcttgtcgtcgccctcgccaccgagcagttccccgagaacgtgcccaaggtcatgccccccacccgcctccccgccgactacttccccgaccgcgtccccatcaccatcatcgacacgtcgtccagcccggagcagaagccgaagctgatcgcggagtgccaggcggccgatgcggtggtgctcacgtacgcctgcgaccgccccgccacgctggaacggctcagttcgttctggctccctgagctccggcgactccagctgaagactccagtaatcgtggtggggtgcaaactggaccttagggacgagcagcaggttagccttgagcaggttatggcgcccatcatgcagtctttccgcgagattgagacctgcattgagtgctccgcgcttcggcagatccaggtgcctgaggtcttctactatgcccagaaggcagtgcttcacccaactgctcctctctttgatcaagaggcacaatctctgaagcctcgctsygtgcgagctttaaagcggatattcattatatgtgataatgacaaggatggtgccctcagtgacgtggagctcaatgaattccaggtccgatgtttcagtgctcctctccagcctactgaaatttcaggcgtgaagagagttgttcaggagaagatgcctgaaggcgtaaatgaaagtgggcttaccttgactgggttcctttttctgcatgccctgtttattgaaaaaggtcgtctggaaactacatggactgtattgaggaaatttggttacgacaatgatatcaagcttagggatgatctcattgcaatgccaattaaaagagctcctgatcaaacactggaaatgacaagtgaagtagttgatttcttgaaagggatattcaacatgtttgacattgataatgatggtgctttactacctactgagctggaggaccttttctcaacggcacctgaaaaaccttggtcttctgatccatataaagactgtgctgaaaagaatgtcttgggtggtctgtcacttgaaggatttctttctaaatgggctcttatgacacttctcgatccaaca

SEQ ID NO: 38384 - protein, 389 aa, Panicum virgatum
  misc_feature: Ceres CLONE 1993689
  misc_feature (231)..(320): Pfam Name: EF_assoc_2 Pfam Description: EF hand associated
  misc_feature (20)..(132): Pfam Name: Miro Pfam Description: Miro-like protein
  misc_feature (354)..(389): Pfam Name: EF_assoc_1 Pfam Description: EF hand associated
  misc_feature (199)..(199): Xaa is any aa, unknown, or other
MAGATSPAAAANLAGKSGVRVVVIGDPGTGKSSLVVALATEQFPENVPKVMPPTRLPADYFPDRVPITIIDTSSSPEQKPKLIAECQAADAVVLTYACDRPATLERLSSFWLPELRRLQLKTPVIVVGCKLDLRDEQQVSLEQVMAPIMQSFREIETCIECSALRQIQVPEVFYYAQKAVLHPTAPLFDQEAQSLKPRXVRALKRIFIICDNDKDGALSDVELNEFQVRCFSAPLQPTEISGVKRVVQEKMPEGVNESGLTLTGFLFLHALFIEKGRLETTWTVLRKFGYDNDIKLRDDLIAMPIKRAPDQTLEMTSEVVDFLKGIFNMFDIDNDGALLPTELEDLFSTAPEKPWSSDPYKDCAEKNVLGGLSLEGFLSKWALMTLLDP

SEQ ID NO: 38385 - DNA, 702 bp, Panicum virgatum
  misc_feature: Ceres CLONE 1993705
  misc_feature: Encodes the peptide sequence at SEQ ID NO. 38386
aagtcttttggtcttcgtgttggccggtgttggccttgtctgccttcttgtgctcgcttcctcccccgccccgcctgctcccctgtccctcccgtgtcggaggggacacgcgcacgcgcgcgcgcggccgtgtgggacgggcctgctccggcgccggccgcgccggccatgcgtggggcccgccgagctcactagcacgccggcgagacttgcgcttcggttgcgggcgggtggtcggggactagaagatgatcaagcagcaccagcagcagcagccggcgagctccgtcgggccgcaggccgccgccgtggcggcggcggcggcgagcggatgtgaaggggagaagaagccgccggcgatcaactcggagctgtggcatgcctgcgcggggccgctggtgtcgctgccgccggcgggcagcctcgtcgtctacttcccccaaggccacagcgagcaggttgctgcttctatgcaaaaggatgttgatgggcatgttccgagctacccaaatcttccatcaaagttgatttgcctcctgcataacgtcactttacatgcggatccagaaactgatgaagtatatgcgcaaatgactcttcagccagttacttcatatggaaaggaggcattgcaactatcggagttagctctgaaacagcccaggcctcaaacagagttcttctgtaagacactggaccgca

SEQ ID NO: 38386 - protein, 151 aa, Panicum virgatum
  misc_feature: Ceres CLONE 1993705
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: Useful for making plants with modulated light quality sensitivity
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
  misc_feature: The sequence is a functional homolog of SEQ ID NO 100 in the 10/666,642 US patent application
MIKQHQQQQPASSVGPQAAAVAAAAASGCEGEKKPPAINSELWHACAGPLVSLPPAGSLVVYFPQGHSEQVAASMQKDVDGHVPSYPNLPSKLICLLHNVTLHADPETDEVYAQMTLQPVTSYGKEALQLSELALKQPRPQTEFFCKTLDR

SEQ ID NO: 38387 - DNA, 699 bp, Panicum virgatum
  misc_feature: Ceres CLONE 1993711
  misc_feature: Encodes the peptide sequence at SEQ ID NO. 38388
ctgaggctcagccagaagctcatggtggtgaccgccgctccgtctcttgccatccccacacccccgcgcccgaccccgaagccccgccgcgcacgcgccctctcgccgcggcagcgggacgtcgtctcgacgtctcctggacgtctgccatcgcgcgcgcggcggggcagggtgacctgccagcggcggccgcggcgctctccgccatgctcttgacccccgccgcgccggcccccaacgacgtcacgctccttaccgtcctgtccgcctgcgccgactcgccgtcctccccgctcgcccgccccttggcgctctccctccacgcccacgcgctcaaggttttcccttcccacctcctcctctccacctgcctcgtgcggttctacctcgcgtcccgcctcccgcaccttgcgctccagcttttcgactcaatgcccatccgctccgtcgtcacctacaacaccatggtctccgggctcatgcgcaacggcctcggggacgccgcgttcaaggtgtttgacggaatgcccgaaccggataaggtctcctggacggcgctcatcgacgggtgcgtcaagaacgggcgccacgacgaggccatcgactgcttccgctccatgctgctggacggcgtcgagccggactacgtcacgttgatagccgttgtctccgcgggcgccgaggtcggcgcgctcgggc

SEQ ID NO: 38388 - protein, 232 aa, Panicum virgatum
  misc_feature: Ceres CLONE 1993711
  misc_feature (181)..(215): Pfam Name: PPR Pfam Description: PPR repeat
EAQPEAHGGDRRSVSCHPHTPAPDPEAPPRTRPLAAAAGRRLDVSWTSAIARAAGQGDLPAAAAALSAMLLTPAAPAPNDVTLLTVLSACADSPSSPLARPLALSLHAHALKVFPSHLLLSTCLVRFYLASRLPHLALQLFDSMPIRSVVTYNTMVSGLMRNGLGDAAFKVFDGMPEPDKVSWTALIDGCVKNGRHDEAIDCFRSMLLDGVEPDYVTLIAVVSAGAEVGALG

SEQ ID NO: 38389 - DNA, 733 bp, Panicum virgatum
  misc_feature: Ceres CLONE 1993713
  misc_feature: Encodes the peptide sequence at SEQ ID NO. 38390
aagataggactcactcgccaccgccgccgcaatgttgtgcatcacgtcgccgtcttcctctccggctcctctccagctgacgcgccgctcgcgcgcgctttctgatcgagcggcgccgccagggatcgcgggtggcagcaatgcgcgcttgaatgtattgtctgtccagcgcgaggctcgccggccggggccggcaaagtccaagagcaaattcgccactgccgcgactgtgcaagaagataaaactatggcagcttcccaggacgatgtcgaccatcttcccatatacaagctagaccccgacttggagaaattcaaggaccatttcagctaccggatgaaaagatacctggaccagaaatgttccattgagaaaaatgaggggagtcttgaagaattttctaaaggctatttgaagtatgggatcaatacaaacaaggatgcaactgtatatcgtgaatgggcacctgctgcacaggaggcacagcttattggtgacttcaatgactggaatggtgcaaaccaccagatggagaaggataaatttggtgtttggtcaattaaaattgaccatgtcaaagggaaaccggccatccctcataattccagggttaaatttcgctttagacatggtggagtatgggttgatcgaattcctgcgtggattcgtttatgcactgttgatgcctctaaatttggagctccctatgatggtgttcattgggaatcctcc

SEQ ID NO: 38390 - protein, 233 aa, Panicum virgatum
  misc_feature: Ceres CLONE 1993713
  misc_feature (129)..(212): Pfam Name: Isoamylase_N Pfam Description: Isoamylase N-terminal domain
  misc_feature: SWISSPROT Homolog: EC 2.4.1.18 1,4-alpha-glucan branching enzyme
MLCITSPSSSPAPLQLTRRSRALSDRAAPPGIAGGSNARLNVLSVQREARRPGPAKSKSKFATAATVQEDKTMAASQDDVDHLPIYKLDPDLEKFKDHFSYRMKRYLDQKCSIEKNEGSLEEFSKGYLKYGINTNKDATVYREWAPAAQEAQLIGDFNDWNGANHQMEKDKFGVWSIKIDHVKGKPAIPHNSRVKFRFRHGGVWVDRIPAWIRLCTVDASKFGAPYDGVHWES

SEQ ID NO: 38391 - DNA, 724 bp, Panicum virgatum
  misc_feature: Ceres CLONE 1993715
  misc_feature: Encodes the peptide sequence at SEQ ID NO. 38392
ctttctctctccctctcccacctcgcagccccacccttcccctctctccccgcacaccatggcgatctccgagctcgggtgagctgacgagaatgcggccgatttgaggaggcggcgggagggtgatgggggttccgggcggattcgccagggtgtagagtaggtttcggttccggtggacgtgggaggatgagctcgtcgtcggcggccagcatcggccagacgccgccgccgcctccccacagcgagcaggtggcagcgtcgacgaacaaggaggtggacgggcacatccccaactaccccaacctgccgccgcagctcatctgccagctccatgatgtcacaatgcatgcggatgcggagactgatgaagtgtacgctcagatgacgctgcagccgctgaacccacaagagcagaacgatgcatacctgccggccgagatggggatcatgagcaaacagcctacgaattacttctgcaagacgctgacggccagcgacaccagcacgcatggcgggttctctgtgccccgtcgtgcagcggagcgcgtcttcccccctctgtgtggtttgtaggatttcacacagcagcctccagcacaggagcttattgcacgggatattcatgatgtggagtggaagttcaggcatatcttccgaggccaaccccagagacacctgctgactactggctggagtgtgtttgtcagtgctaagagactcg

SEQ ID NO: 38392 - protein, 128 aa, Panicum virgatum
  misc_feature: Ceres CLONE 1993715
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: Useful for making plants with modulated light quality sensitivity
  misc_feature: The sequence is a functional homolog of SEQ ID NO 100 in the 10/666,642 US patent application
MSSSSAASIGQTPPPPPHSEQVAASTNKEVDGHIPNYPNLPPQLICQLHDVTMHADAETDEVYAQMTLQPLNPQEQNDAYLPAEMGIMSKQPTNYFCKTLTASDTSTHGGFSVPRRAAERVFPPLCGL

SEQ ID NO: 38393 - DNA, 685 bp, Panicum virgatum
  misc_feature: Ceres CLONE 1993724
  misc_feature: Encodes the peptide sequence at SEQ ID NO. 38394
gggcgaaaaggaccaggtggtggggatgggggccggaaccaaaaccttgacgaaccacacagggaggagataggtagccaggaggtggggcgaaggcacgagggcggggggctagcccaaccagacctaccaaaccctagctcacctctcatcccgatccatggaggcggcgctgtgagccgccgccactgacgcctggacgcggagcccgtacggcgggggaggcgaggatgacggccagatcggacgatcccggcgtctcgccggggacctcgtcggcggcggccgccggcgagatctggggcacgtgggaggagctcctcctggcgtgcgccgtgcggcggcacggcacggcgagctgggactccgtggccatggaggtccagtcgcgctgccccgcctccgccgctgcgcgcctcacgcccaccgggtgccgcctccggttccgcctcctccaccgccggttcgccgccggcgccgagaacggtgacggcggcggcgccgacgccgacgaggaccccgacgcgaccgccgccgacgggtgggtggaggagctccgcaagctgcgcgtcgccgagctccgccgcgaggttgagcgatacgacctctcgatcgggtcgttgcaatccaaagtgaaacggctcaaggaggagagggagcggagcatctccggcgaggccgaccc

SEQ ID NO: 38394 - protein, 151 aa, Panicum virgatum
  misc_feature: Ceres CLONE 1993724
  misc_feature (21)..(76): Pfam Name: Myb_DNA-binding Pfam Description: Myb-like DNA-binding domain
MTARSDDPGVSPGTSSAAAAGEIWGTWEELLLACAVRRHGTASWDSVAMEVQSRCPASAAARLTPTGCRLRFRLLHRRFAAGAENGDGGGADADEDPDATAADGWVEELRKLRVAELRREVERYDLSIGSLQSKVKRLKEERERSISGEAD

SEQ ID NO: 38395 - DNA, 693 bp, Panicum virgatum
  misc_feature: Ceres CLONE 1993728
  misc_feature: Encodes the peptide sequence at SEQ ID NO. 38396
atatgctatcggaaaatgagaagataaagatattcgagaagctggtaaagttccagaatgatggtaccgtggaggtagatgtgacacgtagtgctcttgttacctcagaactctcagagattgatgcttttggttatataccgcatgaaattgaaaaagttacacctggaatcaccaagtcagtcccaaagttgaagattgctatacttgtagttggaacccgaggggatgttcagccttttatagcattagctaaaagacttcaggaatttggtcattatgttagactggcaactcatgtcaatttccgtactttcgtgaagtcagctggcattgatttttacccattgggtggtgatcctcggattatggctcagtacatgacaaaaaacaaagggttttgcctggctgcaccaacagagatttacgctcaaagaaagcaacttaaggaaattatcttctcagttctacctgcatgcacagaacctgatttggatactggaacaccattcagagctcaggcaataatagcaaatcctcctgcttatggtcatctgcacattgctgaggctctttgaatacctctgcatatcttcttcacttttccatggacgccaaccgatgaatttccacatccattggcacgaatgcctcagagcgcaacctacaggctatcgtatcttattctggatt

SEQ ID NO: 38396 - protein, 191 aa, Panicum virgatum
  misc_feature: Ceres CLONE 1993728
  misc_feature (66)..(191): Pfam Name: Glyco_transf_28 Pfam Description: Glycosyltransferase family 28 N-terminal domain
  misc_feature: SWISSPROT Homolog: EC 2.4.1.173 Sterol 3-beta-glucosyltransferase
MLSENEKIKIFEKLVKFQNDGTVEVDVTRSALVTSELSEIDAFGYIPHEIEKVTPGITKSVPKLKIAILVVGTRGDVQPFIALAKRLQEFGHYVRLATHVNFRTFVKSAGIDFYPLGGDPRIMAQYMTKNKGFCLAAPTEIYAQRKQLKEIIFSVLPACTEPDLDTGTPFRAQAIIANPPAYGHLHIAEAL

SEQ ID NO: 38397 - DNA, 638 bp, Panicum virgatum
  misc_feature: Ceres CLONE 1993737
  misc_feature: Encodes the peptide sequence at SEQ ID NO. 38398
atccacctcctcccgcgtgccaccgaaagccaagccatgaccatcggctcgcgtggccgccgccggccgctagagacatgcgtccgtggcgccgccgcttcgtccccttccctcgatccgcctgcagccgctggcggccagcggcgcccacccggggcggtacgcggacgcgatccccgccgcagcggcggcggccagcgcggaggccatggagatctacagccgccagcgccaccacatggcggcgggcggggtgtggggggacccgttccggaccgacggcgacacgctggccgccgccgctccggtgaccgcggcggcggcgccggtggacgtcgacgtcgaagcagaggtcaagttcggcacccgcctggcgcaagacgacgtcatcccggtggaggaagcgccgccgtcatcggatagcttcgggcactgtgacgccaggcctacagacaagattcacaggcggctggcgcagaacaggcatgctgctcggaagagccggctacagaagaaggcctacatccagaatctctagactagccggatgaagctggcgcagctggagcatgagctcatcatggccaggcgccagcagggcgcgcacgccgccggcggggttactagcgccgcccgtg

SEQ ID NO: 38398 - protein, 109 aa, Panicum virgatum
  misc_feature: Ceres CLONE 1993737
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
MEIYSRQRHHMAAGGVWGDPFRTDGDTLAAAAPVTAAAAPVDVDVEAEVKFGTRLAQDDVIPVEEAPPSSDSFGHCDARPTDKIHRRLAQNRHAARKSRLQKKAYIQNL

SEQ ID NO: 38399 - DNA, 691 bp, Panicum virgatum
  misc_feature: Ceres CLONE 1993740
  misc_feature: Encodes the peptide sequence at SEQ ID NO. 38400
attcccactccctctcgcctccgcacagacccgtcagacaccccgtccctccctcctcgccgtggaaccaacgcccagcgcgcgcgcgcgcgagcacgagaacccccaccgcgtatggaagttgctgcggcgaagcaactcctccccatggcgcggggccccaactccccgtcctcgtccacctcctcctcctccccgtcctccgccgcctccccgtcgccgcgccagccgcagtcccagcccgtcccgccgtcgcccaagcccgtgccgcgcatcatcgacaccacgcccttcccgaccaccttcgtgcaggccgacaccaccaacttcaagcaggtcgtgcagaggctcaccggctccgacacgccgccgtcggcccagaacaagcccgccaagacccaccaccaccaccaccaccaccaccacggcgccagcggcctcgccggcgggcccaagaagccggccttcaagctctacgagcgccggatcggcaagaacaacctcaagatgatcgcgccgctggcgatggccgcggccgcggccgcgggggcgtcgccgcggaagccgggccccgaggtgctgtcgcccagcgtgctcaacttcccgtccctggcgctcgggagccccgtcacgccgctggtgtcggaccccttcaaccggtcgccggcgtccgcgtcgccgggcgaggagg

SEQ ID NO: 38400 - protein, 192 aa, Panicum virgatum
  misc_feature: Ceres CLONE 1993740
  misc_feature (58)..(88): Pfam Name: VQ Pfam Description: VQ motif
MEVAAAKQLLPMARGPNSPSSSTSSSSPSSAASPSPRQPQSQPVPPSPKPVPRIIDTTPFPTTFVQADTTNFKQVVQRLTGSDTPPSAQNKPAKTHHHHHHHHHGASGLAGGPKKPAFKLYERRIGKNNLKMIAPLAMAAAAAAGASPRKPGPEVLSPSVLNFPSLALGSPVTPLVSDPFNRSPASASPGEE

SEQ ID NO: 38401 - DNA, 715 bp, Panicum virgatum
  misc_feature: Ceres CLONE 1993771
  misc_feature: Encodes the peptide sequence at SEQ ID NO. 38402
aaagcacgaacagatcttgagagcgagcgagagggcattttcctttttgagggaggagaggagatggcggtgacgatcgcgtccgtgaaggcgaggcagatcttcgacagccgcggcaaccccaccgtcgaggtggacgtggtcctcagcgacggcagcttagcgaggggggcagtgcccagcggcgcatccactggaatatatgaggccttggagttgagggatggaggatctgattatcttggcaagggtgttcttaaggctgtggataatgtgaatagcattattggaccagcaattgttggaaaggaccccacggagcaggttgacattgacaacttcatggtccagcagcttgatggaacctccaacgaatggggctggtgtaaacaaaagcttggagcaaatgctattcttgccgtgtcactagctgtgtgtaaagctggagccatggtgaagaagattcctctttaccagcacattgcaaatcttgctggaaacaaaactctggtgctgcctgtacctgcttttaatgtgattaatggaggatcgcatgctggaaacaagcttgccatgcaggagttcatgatcctcccaactggtgcctcctcattcaaggaggccatgaagatgggagttgaggtgtatcacaacctgaagagcataatcaagaagaagtatgggtcagatgccacaaacgttggggatgaagggg

SEQ ID NO: 38402 - protein, 217 aa, Panicum virgatum
  misc_feature: Ceres CLONE 1993771
  misc_feature (4)..(140): Pfam Name: Enolase_N Pfam Description: Enolase, N-terminal domain
  misc_feature: SWISSPROT Homolog: EC 4.2.1.11 Phosphopyruvate hydratase
MAVTIASVKARQIFDSRGNPTVEVDVVLSDGSLARGAVPSGASTGIYEALELRDGGSDYLGKGVLKAVDNVNSIIGPAIVGKDPTEQVDIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGSDATNVGDEG

SEQ ID NO: 38403 - DNA, 694 bp, Panicum virgatum
  misc_feature: Ceres CLONE 1993772
  misc_feature: Encodes the peptide sequence at SEQ ID NO. 38404
gagagagagcttcttcagactccagcctcagttcagacatcagagttcaggccaagaacggagagtttcagaagggagctagagcgagagagaaagagagagggttttctgagtagtactccggcttacggtggtgcggcgaggatggtgtcggctgctgcccgtgtgatgaaggcggcggcgccatgggttctggcttgcggcttcctgctctgcttagcaggctctcccggagctgagggtgccatcggcgtgaactacggcatggtcgccaacaacctaccggcgccggagcaggtgatctccatgtacaaggccaggaacatcagctacgtgcggctcttccacccggacgcgtccgtgctcaacgcgctccggggctccggcatcggcgtcgtcctgggcacgctgaacgaggacctccagcgcctggcgtccgacccgtcctacgccgcgtcgtgggtcgccgccaacgtgcagcccttcgccggcgccgtccagttccggtacatcaacgccggcaacgaggtcatcccgggggaagccgccgcgcacgtgctcccggccatgcagaacctcgagtccgcgctccgctccgcgggggtgagcggcgtccccgtcacgacggccgtggcgacggccgtgctcggcgcgtcgtacccgccgtcccagggcgtgttctcggaggcggcgg

SEQ ID NO: 38404 - protein, 183 aa, Panicum virgatum
  misc_feature: Ceres CLONE 1993772
  misc_feature (35)..(183): Pfam Name: Glyco_hydro_17 Pfam Description: Glycosyl hydrolases family 17
  misc_feature: SWISSPROT Homolog: EC 3.2.1.73 Licheninase
MVSAAARVMKAAAPWVLACGFLLCLAGSPGAEGAIGVNYGMVANNLPAPEQVISMYKARNISYVRLFHPDASVLNALRGSGIGVVLGTLNEDLQRLASDPSYAASWVAANVQPFAGAVQFRYINAGNEVIPGEAAAHVLPAMQNLESALRSAGVSGVPVTTAVATAVLGASYPPSQGVFSEAA

SEQ ID NO: 38405 - DNA, 665 bp, Panicum virgatum
  misc_feature: Ceres CLONE 1993780
  misc_feature: Encodes the peptide sequence at SEQ ID NO. 38406
gtttccgttccccggcatcgctttgacaccgctccgtcgctctcgcgccttcttcttcgcccgctcacctctctcgcctgtcagctcagctcccggcagtcgtcgccggtcagctctctcggccaccctagacgatcgagggcctaccagggctgcggctccatccatcgtgctgctactacctcatcatcatcatcatcatcatcatcatcatcatgctagacaaccaaaagcaagcggaggttctctggcccaggctggtggccaacaagctcttccggaagacctccggcagccacgccttcgtcgccgacttcccgctcgccgatgacgccgccgccttcgacgacggcgggtgcagccccgacgcggacgccagccgctgcgtcaagcgggcgcggccgcaggagcggggcaagaccctcaagtacaagctgttcgcgagcacgtggaacgtgggcggcgtggcgccgccggacgacctggacctgtcggactggctggacgcccgcgacgggccctacgacgtgtacgtgctcgggttccaggaggtggtgccgctgcgcgcgcgcaacgtgctgggcgcggacaagagccgcgtcgggatgcggtggatcgagctcatccgcgccgcgctgaaccggtccgcggcggcgtcgtcctcg

SEQ ID NO: 38406 - protein, 149 aa, Panicum virgatum
  misc_feature: Ceres CLONE 1993780
  misc_feature: SWISSPROT Homolog: EC 3.1.3.56 Inositol-polyphosphate 5-phosphatase
MLDNQKQAEVLWPRLVANKLFRKTSGSHAFVADFPLADDAAAFDDGGCSPDADASRCVKRARPQERGKTLKYKLFASTWNVGGVAPPDDLDLSDWLDARDGPYDVYVLGFQEVVPLRARNVLGADKSRVGMRWIELIRAALNRSAAASS

SEQ ID NO: 38407 - DNA, 1372 bp, Panicum virgatum
  misc_feature: Ceres CLONE 1993783
  misc_feature: Encodes the peptide sequence at SEQ ID NO. 38408
gtgctacaaatatctctagtatgaacatgcagcaaggattctctctccacagtccacaaacaaatatggaactagtcttctcacggctccaatggctgatactcctacctttggtcttcctctttattctcctctcctacctgtacaccatcctatggctgagaccagagaggctgaggcagaaactgaggagccagggagtgaaggggcccaagccttctttcctctttggaaacatagcggagatgaggagaatccagaaggaactggccatatctgtccaagaactgcaagcagggaccactgaaaagttctcctcggattatacagccaccctattcccctacttcctccattggagcagaatttatggttccatcttcttgtattcaactgggagcatacaagttctgaatatgacagatcctgacatggtgaaagagctggccaattgcaaatcttttgatattggaaggcctttgtctttgcaaaaagagcgtggggctcttcttggcatgggaatattggcatcaaatggtgagctttgggcacatcaaagaaaggtgattgcaccagagtttttcatggacaaggttaagggcatgttgcacgtgatggtcgaagctgcaatgccaatgttgacttcatgggaaaacataactgcagagactgtggtggatgagtccttgagaaatttttcagctgaagtcatatcgaggacttcatttggaagcaattttgctgcaggtaaagagatattcaacaaaattcggcaacttcagattgcaatggcagagcaaagcatgcttggtgttcccggaataagatacttaccaacaaaaaccaatagagaaatttggagtctggatcgcagcattcgtcgcctcattttaaatgtagctctgaagcacgagcaagattcagacgccttgtcaactaaggatctcctgcactctataattaagggtgctaaagcccgccacttcgcttcgcagacgcctgaggatttcatcatcgacaactgcaagaacatctacttcgcagggcatgaaacaacctcaaccactgctgcatggtgcttgatgcttcttgcttcacaccctgaatggcagtcccgtgctcggactgagctattggatgtttgtcaagggaaaccaatagaatttgacatgctgcggaagttgaaaatgataacaatggtgatccaggagacccttcgtctgtaccctccagcagcgtttgtggcacgagaagctctgaacgacctaaaaattgggcagcctcaacattccaaaaggaaccaacatcagaatcccagtagcgctgggctcaccgggatcctgttgtctggggtcccaattccgacaggttt

SEQ ID NO: 38408 - protein, 435 aa, Panicum virgatum
  misc_feature: Ceres CLONE 1993783
  misc_feature (46)..(432): Pfam Name: p450 Pfam Description: Cytochrome P450
  misc_feature: SWISSPROT Homolog: EC 1.3.3.9 Secologanin synthase
MELVFSRLQWLILLPLVFLFILLSYLYTILWLRPERLRQKLRSQGVKGPKPSFLFGNIAEMRRIQKELAISVQELQAGTTEKFSSDYTATLFPYFLHWSRIYGSIFLYSTGSIQVLNMTDPDMVKELANCKSFDIGRPLSLQKERGALLGMGILASNGELWAHQRKVIAPEFFMDKVKGMLHVMVEAAMPMLTSWENITAETVVDESLRNFSAEVISRTSFGSNFAAGKEIFNKIRQLQIAMAEQSMLGVPGIRYLPTKTNREIWSLDRSIRRLILNVALKHEQDSDALSTKDLLHSIIKGAKARHFASQTPEDFIIDNCKNIYFAGHETTSTTAAWCLMLLASHPEWQSRARTELLDVCQGKPIEFDMLRKLKMITMVIQETLRLYPPAAFVAREALNDLKIGQPQHSKRNQHQNPSSAGLTGILLSGVPIPTG

SEQ ID NO: 38409 - DNA, 719 bp, Panicum virgatum
  misc_feature: Ceres CLONE 1993798
  misc_feature: Encodes the peptide sequence at SEQ ID NO. 38410
aacaaacgctaaaaaagtaacagtttctgtactttattggttgagcgaatcaacatgcgcgagatcgtttcgatccagggtggccagtgcggtaaccagattggctccaaattctgggaggtcgttgccgatgagcacggcgtcgatccgaccggcacgtaccagggcgacagcgacctgcagctcgagcgcatcaacgtgtacttcaacgaggccacgggcggccgctacgtgccgcgcgcggtccttatggacctcgagccgggcacgatggactccgtccgcgccggcccgtacggccagatcttccgtccggacaacttcgtgttcggtcagtcgggcgcgggtaacaactgggccaagggtcactacaccgagggcgccgaactcatcgactccgtgctggacgtgtgccgcaaggaggccgagtcgtgcgactgcctgcagggcttccagatcgcgcactcgctcggtggtggcacgggctccggcatgggcacgctgctcatctcgaagctgcgcgaggagtacccggaccgcatcatgatgaccttctccgtcatcccgtcgccgaaggtgtccgacaccgtcgtcgagccgtacaacaccacgctgtccgttcaccagctcgtcgagaactccgacgagtccatgtgcgtcgacaacgaggctctgtacgacatctgcttccgcacgctgaagctgacgacgccgacgtt

SEQ ID NO: 38410 - protein, 221 aa, Panicum virgatum
  misc_feature: Ceres CLONE 1993798
  misc_feature (45)..(221): Pfam Name: Tubulin Pfam Description: Tubulin/FtsZ family, GTPase domain
  misc_feature: Useful for making plants with modulated flowering time
MREIVSIQGGQCGNQIGSKFWEVVADEHGVDPTGTYQGDSDLQLERINVYFNEATGGRYVPRAVLMDLEPGTMDSVRAGPYGQIFRPDNFVFGQSGAGNNWAKGHYTEGAELIDSVLDVCRKEAESCDCLQGFQIAHSLGGGTGSGMGTLLISKLREEYPDRIMMTFSVIPSPKVSDTVVEPYNTTLSVHQLVENSDESMCVDNEALYDICFRTLKLTTPT

SEQ ID NO: 38411 - DNA, 1447 bp, Panicum virgatum
  misc_feature: Ceres CLONE 1993820
  misc_feature: Encodes the peptide sequence at SEQ ID NO. 38412
agagctgttcgttgtttttgcatggaccgtgtgcccagcagcccagtcgtcggttcgtttgtggagacaatgtggatggatgatggacacgcctcgcactcggcactcctcacgatcagccgaagctcagccagcctcgaggggacggggaacgggggagggggattcaacccggggaggcgctttttaagcttgccgatcccctcgccatcttttcctgaaaggtgacccccccttcggtcagccctgacaatctcgatcggtccacgatgcgatcaggattcgtcgcatgtcagtcattcgtttgaaccatcagcatcaccaattgcatacccagtactactgcgtagcgcttcaagatgcatcgtctctcgcttcagtcactccttgccatctcggctttggtttcgggcatcgccgccgacgggaaggcggacggtgaccaccaggccgtcaccgtcgtcgtcagtcaaaccctcacaagctgcccctccccgagcccacccccgccgtgctcctcgcccaccgagtccggatctctgtcaccgagctcgccgtccagctcgtccagcatccgcagcacagccaccaccagcgccggtactcccgcctgcaccgacttctggctggagaagatcaagcaccagggtgtggccccctttggcggcccagactacgacgtcttccgtaacgtcaaggactacggcgccaagggtgatggcgtctcggacgacacggaagccatcaaccgggccatcagcgaggggaagcgttgcggccccggatgcaccggcagcaccaagacgccgggcctcgtctacttcccggctggtacctacatggtgtcgtctcccatcatcgacttctactacacccagctgatcggcaaccccggatgcatgccggtgctcaaggccacctccaacttcaccggccgctggctcctcgacaccaacgagtatggggctaacggcctctcctggggcgccaccaacgtattctggcgccaggtggccaacttcgtcattgacatcaccaaggtctctcccgagaccctgatctcgggcattcactggcccagttcgcaggccacctcgctgtccaacattgtcttccgctcatccgagaccaagggtaacctgcaccagggcctcttcgtcgaagaaggatccggcggctacatgggcgacctcgtcttctacggcggtgcccaggccatgtccatcggcaaccagcagttcaccatgcgcaacatcaccgtccacaacgccaagacggccatccagcagctgtggtcgtggggctggacgtacaagggcgtgagcatcaacaactgcgaggtcgggttcgacttcaccgctgccaatgatcaggggacgctgaatgtcgggtccattaccatcgtcgacagcgagatcaagaacacgcccgttgggcatcacttacg

SEQ ID NO: 38412 - protein, 362 aa, Panicum virgatum
  misc_feature: Ceres CLONE 1993820
  misc_feature: SWISSPROT Homolog: EC 3.2.1.58 Glucan 1,3-beta-glucosidase
MHRLSLQSLLAISALVSGIAADGKADGDHQAVTVVVSQTLTSCPSPSPPPPCSSPTESGSLSPSSPSSSSSIRSTATTSAGTPACTDFWLEKIKHQGVAPFGGPDYDVFRNVKDYGAKGDGVSDDTEAINRAISEGKRCGPGCTGSTKTPGLVYFPAGTYMVSSPIIDFYYTQLIGNPGCMPVLKATSNFTGRWLLDTNEYGANGLSWGATNVFWRQVANFVIDITKVSPETLISGIHWPSSQATSLSNIVFRSSETKGNLHQGLFVEEGSGGYMGDLVFYGGAQAMSIGNQQFTMRNITVHNAKTAIQQLWSWGWTYKGVSINNCEVGFDFTAANDQGTLNVGSITIVDSEIKNTPVGHHL

SEQ ID NO: 38413 - DNA, 687 bp, Panicum virgatum
  misc_feature: Ceres CLONE 1993820-R
agtttgtcggcgcggccgatgtgtttatgggccagatccagacggagacggcgtactatcagccgaatcccgatgccaggttgccgtttaaggcggacgagacgtatgctgatccggtgctggcggagggggagtccgggtgggggctgcgggtggtggatagtgaggggttggtggtgtacggggcggggttgtatagtttctttgataactatgatgtgaattgcagtcagattggggagggggcgacgtgccagaagaggatttttagtgtggaggggaagagtgaggtcagggtttataacctgaacacggtggggacgaacaagatggtgacggtggacggggtggatgtggcgaattatgaggacaatattgatgggtttgtgcacacgattgcgctgtttggggtggacgcctaagggacaagggccgggcggttagccgttggctctgtggaagggtggtctgttaagatacaaatattttggggcttcgatgagacgttgacgacggcaccccgggtttgatgagagatgaagtccgggttgggtaatgcgttggggtggccagtcgggtctaatgtaaagcactgtgaactcctgtgcattctttctttgtatatttactagtgtataatcgggcccttggggtctggacgcagatgaatacatcagcttcacggcc

SEQ ID NO: 38414 - DNA, 713 bp, Panicum virgatum
  misc_feature: Ceres CLONE 1993822
  misc_feature: Encodes the peptide sequence at SEQ ID NO. 38415
aaactctccctacgttcggtggggggaggtacaggggcttgcacgggcgcgcgcaccccgcacacggcgcgcactcctcccgcggcttcagcatcactagaggtgttgagccttaggtcaaatcgtctcactattaatctcccacctgacatagcatccattccttctctgcactccctttatcttcagcacaataacttgtccggaattataccaagcacactatcttccagcctaacattcttagacctgtcatataattccttcaatggagaaatcccgttgaaagtgcaagatatcactggactgactgcattgcttctccaaaacaactctctttctggacccatccctgaccttcacctccccaaattgagacatttggatttgaataacaataacctcagtggacctataccaccttccctgcagaagttcccagctagttctttcttgggaaatgcctttctatgtggatttccattggaaccatgtccaggaaccgcaccttctccaatatcaccatcaccccaaaatggccaaagaagcatatggaaaaggctcagccgtggtgtcatcattgcaatagctgctggagtaggggccatagtactgcttttgattatcatcctcttggtatgcatcttcaaaagaaagaaagacacagaacctggtgcgggatcatcttcatccaaaggaaaggttagtgctgg

SEQ ID NO: 38415 - protein, 237 aa, Panicum virgatum
  misc_feature: Ceres CLONE 1993822
  misc_feature: SWISSPROT Homolog: EC 2.7.11.1 Non-specific serine/threonine protein kinase
KLSLRSVGGGTGACTGARTPHTARTPPAASASLEVLSLRSNRLTINLPPDIASIPSLHSLYLQHNNLSGIIPSTLSSSLTFLDLSYNSFNGEIPLKVQDITGLTALLLQNNSLSGPIPDLHLPKLRHLDLNNNNLSGPIPPSLQKFPASSFLGNAFLCGFPLEPCPGTAPSPISPSPQNGQRSIWKRLSRGVIIAIAAGVGAIVLLLIIILLVCIFKRKKDTEPGAGSSSSKGKVSA

SEQ ID NO: 38416 - DNA, 713 bp, Panicum virgatum
  misc_feature: Ceres CLONE 1993832
  misc_feature: Encodes the peptide sequence at SEQ ID NO. 38417
gctcgcaagaacacacgcatcgcttccctccccgcgttcctcatcgggctcgatcagccaaggcccccgctacaaataagccatcgccacttgttgtctaatcccgccgcgtgctgatattttcttccctatttgccttgctagctgctatcaatcatcaatcgatctgcagctgcagcttacagcgacgtcgtcgtctaggtcagagctggaggcagcgaggatcctatatttataatggccgcctccaatagcagcagcgctggcaagaacggcaccaacccgctggaggccatgggcgccttcttctcgaagcaggtcgaccggcggaagctggtcaccagcgagaagcaggcgctgtccacgcggctgtcggcgtccggcgatgcgttcccggggtcggagcaccgtccggcggaccggaagcggtggatggcggagctgggcgcggaccgggtgcgcgtgcaccaggtggtgtggcccggcacgcacgactcggccaccaacaagatcggcgtcccgctggtgacccgccccttcgcgcagtgccagtccatgtccgtgtgcgagcagctggccatgggcacgcgcgtcatcgacgtgcgcgtccaggaggagcgccgcgtctgccacggcatcctggccacgtaccccgtcgacgtcgtgctcgacgacgtgcggcgcttcctgggcgagaccgagtcggaggtggt

SEQ ID NO: 38417 - protein, 158 aa, Panicum virgatum
  misc_feature: Ceres CLONE 1993832
  misc_feature: SWISSPROT Homolog: EC 4.6.1.13 Phosphatidylinositol diacylglycerol-lyase
MAASNSSSAGKNGTNPLEAMGAFFSKQVDRRKLVTSEKQALSTRLSASGDAFPGSEHRPADRKRWMAELGADRVRVHQVVWPGTHDSATNKIGVPLVTRPFAQCQSMSVCEQLAMGTRVIDVRVQEERRVCHGILATYPVDVVLDDVRRFLGETESEV

SEQ ID NO: 38418 - DNA, 730 bp, Panicum virgatum
  misc_feature: Ceres CLONE 1993844
  misc_feature: Encodes the peptide sequence at SEQ ID NO. 38419
tcatccccgactcctaaaccccaaagcaccaaaaccctaatcccctcctccccgccgccaccgccgccatgggctccgccgccgctctcccggcctccgccggctctggcgagaatctagtcctcatcctcgactacggctcgcagtacacccacctcatcacccgccgcgtccgccagctgggcgtcctctccctctgcgtctccggcacggcgccgcttgccgccctcgagagcctgcgcccgcgtgccatcgtcctctccggcgggccccactccgtccacgccgagggagcgcccacctttcccgagggattcctggacttcgccgatggcgcgggcgcccacgtgctcggcgtctgctacgggatgcagctgctcgtgcagtcccttggcggcgccgtggagcccggggagcggcaggagtacgggaagatggaggtcgaggggacggcgccgtcctctgcgctgtacggggaggcggagaccgggaagcgccagacggtgtggatgagccacggcgatgaggtggtcaggctgccggaggggttcgaggtggttgcgcgcagcgtcgagggcgccgttgcagccatcgagaatcgggagaagcgcttttatgggctccagtatcaccccgaggttacacattcaccccaaggaatggaaacactccgccgcttcctatttgatgtttgtgggatcaaagctgattggaagatgcaagatgtgct

SEQ ID NO: 38419 - protein, 220 aa, Panicum virgatum
  misc_feature: Ceres CLONE 1993844
  misc_feature (19)..(208): Pfam Name: GATase Pfam Description: Glutamine amidotransferase class-I
  misc_feature: SWISSPROT Homolog: EC 6.3.5.2 GMP synthase (glutamine-hydrolyzing)
MGSAAALPASAGSGENLVLILDYGSQYTHLITRRVRQLGVLSLCVSGTAPLAALESLRPRAIVLSGGPHSVHAEGAPTFPEGFLDFADGAGAHVLGVCYGMQLLVQSLGGAVEPGERQEYGKMEVEGTAPSSALYGEAETGKRQTVWMSHGDEVVRLPEGFEVVARSVEGAVAAIENREKRFYGLQYHPEVTHSPQGMETLRRFLFDVCGIKADWKMQDV

SEQ ID NO: 38420 - DNA, 675 bp, Panicum virgatum
  misc_feature: Ceres CLONE 1993848
  misc_feature: Encodes the peptide sequence at SEQ ID NO. 38421
aggggggccaggcaccggctatagctagtcaactatagaacggcaagcaaggggcacggcctaccctttgcttctcttcacacacccacccaccaaaactacccatacttatctgcccaatcaacccattaccggccttctcccctcctacttgcaaaactaaaacccataacctcataccaaaccacctagggcaaggaatcttcaatctgcaagcatgttgcaaaccatccatggccgaatcaccaacatggggccgctggttccccctcttgttgtctggggtgcaaccctaatgtgcatttggttaccccacaactttctcaaaaaaataaaccacaaacaaccccggcaggcggggctgccgcctggttctatggaactgccactcctcgaaaaaaccctcaatttcttccctcgaattccttcaatgaacctgctgcctttcttcaaccaacaaaggaaaaggttcggtcctattttcaaaacaaacttggtcggaaaggacctaattgtctctcttgacccgaacatcaaccactacttgctccagcaaaagaagaaggcgttccacatatggtttccgaaatcgttcataaaactcctgggcaagaagaacatcgccaaagttaacggttccttgcacagaaccactagaaacatgatcggccaagc

SEQ ID NO: 38421 - protein, 141 aa, Panicum virgatum
  misc_feature: Ceres CLONE 1993848
  misc_feature: SWISSPROT Homolog: EC 1.14.13.76 Taxane 10-beta-hydroxylase
MGPLVPPLVVWGATLMCIWLPHNFLKKINHKQPRQAGLPPGSMELPLLEKTLNFFPRIPSMNLLPFFNQQRKRFGPIFKTNLVGKDLIVSLDPNINHYLLQQKKKAFHIWFPKSFIKLLGKKNIAKVNGSLHRTTRNMIGQ

SEQ ID NO: 38422 - DNA, 679 bp, Panicum virgatum
  misc_feature: Ceres CLONE 1993883
  misc_feature: Encodes the peptide sequence at SEQ ID NO. 38423
tggtgaaaaatcttgctttgatggtatatatcactgttggttctgctgcaaatccaattttggaatttttggaggagtggggtacagaaaattttgaggagatatcgccagctgtcattccgcaagctgctaagatttttgtcaatggttgctgggttggaattcataggaaccctgatctgttagtgaagactcttaggcgtttaagacgacagattgatgtcaacactgaggttggtgtggttcgtgatatccgtcttaaagaacttcgactctacacagattatgggcgctgcagtcgtccattatttattgttgagaaccagaggctgctcatcaagaaggcacatatccgagcattgcaacaaagggagactcctgatgaaggttggcatgaattggtctcaaaaggatatatagagtacatagataccgaagaagaggagactaccatgatctccatgaccataagtgatcttataaatgcaagacaccacccatcggacgcgtattctgagacttacacacattgtgagatccatccttctttgattcttggtgtttgtgcatcaattattccttttcctgaccacaaccagtcacctcgtaatacatatcaatcagctatgggaaagcaagctatgggaatttatgtcaccaactaccagttaagaatgga

SEQ ID NO: 38423 - protein, 225 aa, Panicum virgatum
  misc_feature: Ceres CLONE 1993883
  misc_feature (45)..(107): Pfam Name: RNA_pol_Rpb2_4 Pfam Description: RNA polymerase Rpb2, domain 4
  misc_feature (130)..(181): Pfam Name: RNA_pol_Rpb2_5 Pfam Description: RNA polymerase Rpb2, domain 5
  misc_feature: SWISSPROT Homolog: EC 2.7.7.6 DNA-directed RNA polymerase
VKNLALMVYITVGSAANPILEFLEEWGTENFEEISPAVIPQAAKIFVNGCWVGIHRNPDLLVKTLRRLRRQIDVNTEVGVVRDIRLKELRLYTDYGRCSRPLFIVENQRLLIKKAHIRALQQRETPDEGWHELVSKGYIEYIDTEEEETTMISMTISDLINARHHPSDAYSETYTHCEIHPSLILGVCASIIPFPDHNQSPRNTYQSAMGKQAMGIYVTNYQLRM

SEQ ID NO: 38424 - DNA, 634 bp, Panicum virgatum
  misc_feature: Ceres CLONE 1993884
  misc_feature: Encodes the peptide sequence at SEQ ID NO. 38425
aggccaagcagccaagcagccaagcaccgaacgaagcaaagcacacgacacgagatcgccgctgccactccaccgcaatggcgaccgccagagccaggacggctcctttcctcctcgtcctcctcgccaccctcctctgcgccgccgccgtcgccgcgtcgtcctgggacgacgaccgcgagccctcgcgctgcgtgcggcggtgcgaggactggccccggcaccagcgcgcccggtgcgtgcaggagtgccgccgggaggagcaggagcgggagcgggagcggggcgggcacgagctcggccgccgccgcggcgaggggtccgtgagggcgctccggccgttccacgaggcgtccaagctcctccgcggcatccgcgactaccgcgtcgcggtgctggaggccaacccgcgctccttcatcgtgcccagccacaccgacgcgcactgcatcggctacgtcgcccaaggcgagggagtggtggcgacgatcgagaacggcgagcggcggtcgtacaccgtcaaggaaggcgacgtcttcgtggcgccggccggggcggtcacctacctggccaacaccgacggccggaggaagctcgtcatcgccaagatcctccacaccatctccgtgcctgg

SEQ ID NO: 38425 - protein, 185 aa, Panicum virgatum
  misc_feature: Ceres CLONE 1993884
  misc_feature (72)..(185): Pfam Name: Cupin_1 Pfam Description: Cupin
MATARARTAPFLLVLLATLLCAAAVAASSWDDDREPSRCVRRCEDWPRHQRARCVQECRREEQERERERGGHELGRRRGEGSVRALRPFHEASKLLRGIRDYRVAVLEANPRSFIVPSHTDAHCIGYVAQGEGVVATIENGERRSYTVKEGDVFVAPAGAVTYLANTDGRRKLVIAKILHTISVP

SEQ ID NO: 38426 - DNA, 1498 bp, Panicum virgatum
  misc_feature: Ceres CLONE 1993887
  misc_feature: Encodes the peptide sequence at SEQ ID NO. 38427
ttttaaaaagtttgcgatcaaatgtctcaagataccttcactttcagtgctgatatccaacaattgatgggtctcatcattaacactttctactccaacaaggaaatcttcttaagagaactcatttccaacgcttctgatgccctcgacaaaatcagatacaagtccatcaccggtcaccccgttgacaaggaacccaacttcagaatcagaattatccccgacaagaccaacaatacccttaccctcgaagatactggtattggtatgaccaagcaagaactcgtcaacaacctcggtaccatcgccaagtccggtaccaaggctttcatggaagccctccaatctggtgctgatatctccatgattcgtcaattcggtgtcggtttctactccgctttcttggttgctgacaagatcaccgtctcctccaagtctgatgacgatgaaaagcaacacaagtgggaatccactgctggtggtactttcaccgtcgttgacgatgataccaaccctgatcaattggtcagaggtaccagaatcaccctccacatgaagagtgacaatcttgacttccttgaagaaaagaccatcaaggacatcatcaagaagcactccgaattcatcagcttccccattgaactccaagtcgaaaagactactgaaaaggaagtcagtgacgatgaagatgaacctgaaaagaaggatgagaataaggaaggcgaagaaactgaaatcaaggaagaaaaggaaaagaagaagaagaaggttaaggaagtcaccactgatttcgaagcccttaacaagaccaagcccatctggatgagaaagcccgaaaccatcaccaaggaagaatactctgccttctacaagtccctcaccaacgattgggaagaccatttggccgtcaagcatttctccgtcgaaggtcaactcgaattcagagctatcctcttcgtccccaagagagctcctttcgatctcttcgaatccaagaagaagaagaacaacatcaagctctacgtcagaagagtcttcatcatggacgactgtgatgaattgatccctgaatacttgagcttcgttaagggtgttgtcgactccgaagatctccccttgaacatttccagagaattcttgcaacaaaacaagatcctcaaggtcatcaagaagaacatcgttaagaagtgtatggaactcttccaagaaatcgctgaaaacaacgaagactacaagaagttctacgaacaattctccaagaatttgaagctcgccatccacgaagacaccaccaacagagccaagctcgctgatttcctcagataccactccaccaagtctggtgacgaacaaatttccttcaaggaatacgtcgctagaatgaaggaaggccaaaaggacatctacttcatcaccggtgaatccagaactgccgttcaaaattctcccttcattgaatccctcaagaagagaggttacgaagtcctctacatgattg

SEQ ID NO: 38427 - protein, 492 aa, Panicum virgatum
  misc_feature: Ceres CLONE 1993887
  misc_feature (184)..(492): Pfam Name: HSP90 Pfam Description: Hsp90 protein
  misc_feature (26)..(181): Pfam Name: HATPase_c Pfam Description: Histidine kinase-, DNA gyrase B-, and HSP90-like ATPase
MSQDTFTFSADIQQLMGLIINTFYSNKEIFLRELISNASDALDKIRYKSITGHPVDKEPNFRIRIIPDKTNNTLTLEDTGIGMTKQELVNNLGTIAKSGTKAFMEALQSGADISMIRQFGVGFYSAFLVADKITVSSKSDDDEKQHKWESTAGGTFTVVDDDTNPDQLVRGTRITLHMKSDNLDFLEEKTIKDIIKKHSEFISFPIELQVEKTTEKEVSDDEDEPEKKDENKEGEETEIKEEKEKKKKKVKEVTTDFEALNKTKPIWMRKPETITKEEYSAFYKSLTNDWEDHLAVKHFSVEGQLEFRAILFVPKRAPFDLFESKKKKNNIKLYVRRVFIMDDCDELIPEYLSFVKGVVDSEDLPLNISREFLQQNKILKVIKKNIVKKCMELFQEIAENNEDYKKFYEQFSKNLKLAIHEDTTNRAKLADFLRYHSTKSGDEQISFKEYVARMKEGQKDIYFITGESRTAVQNSPFIESLKKRGYEVLYMI

SEQ ID NO: 38428 - DNA, 625 bp, Panicum virgatum
  misc_feature: Ceres CLONE 1993887-R
  misc_feature: Encodes the peptide sequence at SEQ ID NO. 38429
tgcaagctcatcaaggaaatcctcggtgataaggttgaaaaggtcgtcgtctccaacagaatctccgactctccttgcgtcttggtcaccggcgaattcggctggtccgccaacatggaaagaatcatgaaggctcaagctttgagagactccactatgggctcttacatggcctccaagaagactatggaaatcaatcccgaccaccctatcgtcagcgacttgaagaaaaagagcgatgccgatactagcgacaagaccgttaaggatttggtctggttgttgttcgaaactgccctcttgacttccggattctcccttgacgatccctctcaattctccaacagaatccacagaatgatcaagctcggtctctccatcgaagacgataagatcgaagaagaagacctccctcctcttgttaaggatgctgaaggcgaaaccgctggctccaagatggaagaagtcgattaatcaagttagtcccctctcccctcatatttaaatagctttatatattaaatgctttgtaatccaataattacattcatctagtttatatataaatgttaggtgtgcttttataagaaggtatcaaaatatttgagtcaagattccatattcc

SEQ ID NO: 38429 - protein, 157 aa, Panicum virgatum
  misc_feature: Ceres CLONE 1993887-R
  misc_feature (1)..(157): Pfam Name: HSP90 Pfam Description: Hsp90 protein
CKLIKEILGDKVEKVVVSNRISDSPCVLVTGEFGWSANMERIMKAQALRDSTMGSYMASKKTMEINPDHPIVSDLKKKSDADTSDKTVKDLVWLLFETALLTSGFSLDDPSQFSNRIHRMIKLGLSIEDDKIEEEDLPPLVKDAEGETAGSKMEEVD

SEQ ID NO: 38430 - DNA, 1996 bp, Panicum virgatum
  misc_feature: Ceres CLONE 1993894
  misc_feature: Encodes the peptide sequence at SEQ ID NO. 38431
cccctgttctctccttaccttccccccggcccgctccctcgccagctttgcgggaaaccagagccgccagcagacaaacccctctctccgcctcgctccccctcctccccaaaaccataacccctccgcccccgatggcgtcgccgccgccgccgccgcccgccggagccgccgcgcccggatcgccgccgccggcgcaagtggtgggcaacgcgttcgtgaaccagtactacaacatcctgcaccagtcgccggagctcgtccaccggttctaccaggacgccagccgcctcggccggcccgccggcgccggcgccgacggcatggacaccgtcaccaccatggacgcgattagcgacaagatcgtgtccatgggcatcacgcgcgcggagatcaaggcggtggacgcgcaggagtcgctcggcggcggcgtcaccgtgctcgtcatgggccacctcacggggaggaccagcgtcggccgcgagttcgtgcagtccttcttcctcgcgccgcaggagaagggctacttcgtgctcaacgacatactgcgctacgtcggggacggggraggggaggagggagccgggcacccgccgccgccaccgcagcagccggtgcaggagacagtcacgggcgcggaggccgtccctgctcccatcctggccaatggcactgtcgggggagacaacgagaccctgccttgcgaacaggatgcttcaccgcagcctgagcagcctgcagctgagtccgcacctcctactccagaggaggaagatctctacggagaggaggtttacaacccgccgaatgatatggagaagcctgttgttcaggaaacaccggttgccgaggtcataaatgaagtgccgaataatgtagcagtggctgcgccaagttcgtctccctctataccgatcgaggaggccccaaagaagtcatatgcttcgattgtaaaagtcatgaaagaatatccaccaccagctcctgcagttccctccaggcctgcacccccaaaaccagagaaacaagcccctcctgcaccttctctggttgctgatgctccagctttcagtcctaacactcagggtggcagctttcaagatccagaagttgatgcacatgccatatatgtgcggaatctgcctttaaacgccacaccacaacaattagaagaagaattcaagcgatttggcaccattaagcatgaaggcatccaagttagaagcaacaagatccaagggttttgttatggctttgtagaatttgaggatgccaacgcagtccaaactgcaatagaggcttctcctgttatgattagtgaacggcaatgttatgttgaagagaaaagaactactggttctcgtggcagtaaccgaggaggaaggtttgcaccaggtagaggtggtaacttccgaggtgaaggccttaggggccgtggtacttacaatggaggcagaggctatgggaggggcgagttcagttaccgatctgattatggcggccgaggtggtggcaggggtggctcatcgcgcggagaagttggctatcagcgggttgaccactctggtacagccggtggccgtggcacccggccagcatctgctgctactgctgcaaagtgagttcttggtagctgtgcgtcagtaatagttcagagttctacggccaccatcatggttgaccaaaagcgtggcaggtgtgctgtatttgggttcatgtgaggtttatcagcaaaagttgggtcataaattgatgtttatccttgttttgtggcaaggtaaagcagtggttatatcggttactaattgtagaatatacgtctattgagcttcgttgagcagctgatttgtgttttcccgttttttaacttgttccgaaattagaggggttgatttgaggtgccagtgatttatagcttttattgactgttattaaaatagaagttatggtttagagcttgtaagattggtaagataagtttcttgtttctggaatc

SEQ ID NO: 38431 - protein, 495 aa, Panicum virgatum
  misc_feature: Ceres CLONE 1993894
  misc_feature (24)..(140): Pfam Name: NTF2 Pfam Description: Nuclear transport factor 2 (NTF2) domain
  misc_feature (331)..(401): Pfam Name: RRM_1 Pfam Description: RNA recognition motif. (a.k.a. RRM, RBD, or RNP domain)
  misc_feature (145)..(145): Xaa is any aa, unknown, or other
MASPPPPPPAGAAAPGSPPPAQVVGNAFVNQYYNILHQSPELVHRFYQDASRLGRPAGAGADGMDTVTTMDAISDKIVSMGITRAEIKAVDAQESLGGGVTVLVMGHLTGRTSVGREFVQSFFLAPQEKGYFVLNDILRYVGDGXGEEGAGHPPPPPQQPVQETVTGAEAVPAPILANGTVGGDNETLPCEQDASPQPEQPAAESAPPTPEEEDLYGEEVYNPPNDMEKPVVQETPVAEVINEVPNNVAVAAPSSSPSIPIEEAPKKSYASIVKVMKEYPPPAPAVPSRPAPPKPEKQAPPAPSLVADAPAFSPNTQGGSFQDPEVDAHAIYVRNLPLNATPQQLEEEFKRFGTIKHEGIQVRSNKIQGFCYGFVEFEDANAVQTAIEASPVMISERQCYVEEKRTTGSRGSNRGGRFAPGRGGNFRGEGLRGRGTYNGGRGYGRGEFSYRSDYGGRGGGRGGSSRGEVGYQRVDHSGTAGGRGTRPASAATAAK

SEQ ID NO: 38432 - DNA, 2028 bp, Panicum virgatum
  misc_feature: Ceres CLONE 1993943
  misc_feature: Encodes the peptide sequence at SEQ ID NO. 38433
ccacccccactcccctcgccgccgccgccgccgccgccatggcgtcctccaccgcggcctcgccgctcacctgccaccacctcggcgccagcgccgccccccgctcccgcctccccgccctctccttctccctccgccgccgctcctccaagcccatctccctctcccactcccactccctcccctccaagcccctcttcgccccaccccccgccgccgccgcctccccctccccctcccgcggcgccctccagcccgcctccgcctccgccgcggcggcccccgccccgccgccgaagcctgcgctgcagggcgcggccatcaagccgctcctcgccaccatcgcgacgggcgtcctcatctggctcgtcccggcccccgccggcgtgccccgcaacgcgtggcagctgctcgccatcttcctctccaccatcgtcggcatcatcacccagccgctgccgctcggcgccgtcgccctgctcggcctcggcgccgccgtgctcacccgcacgctcaccttcgccgccgccttctccgccttcggcgaccccatcccctggctcatcgcgctcgccttcttcttcgcgcgcggcttcatcaagaccggcctcggctcccgcgtcgcctacgccttcgtcgcccagttcggctcctcctccctcggcctcggctacgcgctcgtcttcgccgaggcgctcctcgcccccgccatcccctccgtctccgcccgcgccggcggcatcttcctcccgctcgtcaagtcgctctgcgaggcatgcggctcgcgcagcggcgacggcaccgagcgccgcctcggggcctggctcatgctcacctgcttccagacctccgtcgtctcctccgccatgttcctcaccgccatggccgccaacccgctctcggcaaacctcacggcggccaccatcggggaggggatcggctggacgctctgggccaaggccgccattgtgcccgggctgctctcgctcgtgctcgtgccgctcattctgtacgtgatctacccgccggaggtgaaatccagccccgatgcgccacgcctggccaaggagcgccttgccaagatggggcccatgagcaaggcggagacgatcatggctggcacgctgctgctcacggttggtctttggatctttggaggaatgctgaatgtggatgcagtgtctgcagccattcttggcctatctgtcctcctaatcacaggggttgtcacatggaaagagtgtttggcagagtctgtggcgtgggatacccttacttggtttgctgcactaattgcgatggctggctatctcaacaaatatgggctgatctcttggttcagtgagactgttgtgaagtttgttggaggccttggtttgtcctggcaactttcgttcggcgtcttggtgctgctgtacttctactcccactatttcttcgccagtggcgctgcacacatcggagcaatgttcgccgcgttcctgtcagtggcgagtgccctgggcaccccttcactctttgccgccatggttctctcattcctctcaaaccttatgggtggcctcacccactatgggatcggttctgcccctgtcttctatggcgctgggtatgtcccgttggctcaatggtggggctatgggttcgttatctccgttgtgaacatcctcatctggctgggcgcgggaggcttctggtggaagatgatcgggctgtggtgagcagcgcagtaaaactgcgagcttcatttgtttcccgtttgttttggtagaaggggagaaggaaaactatcccaaatttgtggtggcacaggctcccaatccacaagttttgtcgtcgacatgattgcaacccattcttttagttggtatcggtggtacatttgtttcgaaccttccaagcggctaattgcgatgccagggtgcagttctactggcaaaattaattatatggtgttatgcatttatgctcaatggatatggtgttatgcatttatgctcaatggatctgggtgagatcccttggtgt

SEQ ID NO: 38433 - protein, 560 aa, Panicum virgatum
  misc_feature: Ceres CLONE 1993943
  misc_feature (92)..(560): Pfam Name: Na_sulph_symp Pfam Description: Sodium:sulfate symporter transmembrane region
MASSTAASPLTCHHLGASAAPRSRLPALSFSLRRRSSKPISLSHSHSLPSKPLFAPPPAAAASPSPSRGALQPASASAAAAPAPPPKPALQGAAIKPLLATIATGVLIWLVPAPAGVPRNAWQLLAIFLSTIVGIITQPLPLGAVALLGLGAAVLTRTLTFAAAFSAFGDPIPWLIALAFFFARGFIKTGLGSRVAYAFVAQFGSSSLGLGYALVFAEALLAPAIPSVSARAGGIFLPLVKSLCEACGSRSGDGTERRLGAWLMLTCFQTSVVSSAMFLTAMAANPLSANLTAATIGEGIGWTLWAKAAIVPGLLSLVLVPLILYVIYPPEVKSSPDAPRLAKERLAKMGPMSKAETIMAGTLLLTVGLWIFGGMLNVDAVSAAILGLSVLLITGVVTWKECLAESVAWDTLTWFAALIAMAGYLNKYGLISWFSETVVKFVGGLGLSWQLSFGVLVLLYFYSHYFFASGAAHIGAMFAAFLSVASALGTPSLFAAMVLSFLSNLMGGLTHYGIGSAPVFYGAGYVPLAQWWGYGFVISVVNILIWLGAGGFWWKMIGLW

SEQ ID NO: 38434 - DNA, 656 bp, Panicum virgatum
  misc_feature: Ceres CLONE 1993955
  misc_feature: Encodes the peptide sequence at SEQ ID NO. 38435
gtgaaacacaagagcaaggacaggcagagagagaatgggcagcagctccgtcgcaaagcggcagctggtcctcttcgccgccgctctcgtactcgccgtggcctccgcccggcggcgcccggtgcacctgcggctgtacatgcacgacatcaccggcgggccggggcagacggcggtgccgctggtcaacggcaccgggccgctgaacccgtccatgccggcgggcagccggttcggcgacacgacggcgatcgacgacctcctgacggagggccccggcgtggagtcgaagcccgtcggccgggcgcaggggacgtacacgctggcgtccctgcgggagccggtgctggtggtgaccatgaccgtcgcgctcaccgcggggccctacaacgggagcacgctcgtggtggccggccgcgacagcgtcctggacgagacgagggagctcgcggtggtcggcgggacggggcagctccggcgggcctccgggcacgtgctgtggaggacggccaagctggagtcggcggttcactgggtgctggagctgcaagtgcacgcgtccgtgccggccgacagacactctcataaggttgctattatccagtaactttgtgtgtgaaaatgactaaataattgatcacaaaaagttgggttaa

SEQ ID NO: 38435 - protein, 190 aa, Panicum virgatum
  misc_feature: Ceres CLONE 1993955
  misc_feature (10)..(177): Pfam Name: Dirigent Pfam Description: Dirigent-like protein
MGSSSVAKRQLVLFAAALVLAVASARRRPVHLRLYMHDITGGPGQTAVPLVNGTGPLNPSMPAGSRFGDTTAIDDLLTEGPGVESKPVGRAQGTYTLASLREPVLVVTMTVALTAGPYNGSTLVVAGRDSVLDETRELAVVGGTGQLRRASGHVLWRTAKLESAVHWVLELQVHASVPADRHSHKVAIIQ

SEQ ID NO: 38436 - DNA, 1124 bp, Panicum virgatum
  misc_feature: Ceres CLONE 1993955-R
  misc_feature: Encodes the peptide sequence at SEQ ID NO. 38437
aggggtgcggtggtgcagtagcttggtgggtgaaagtgactaaatgattgatcacaaaaggttgggttaaggggtggtgcgtgaatgggggacctgatccagatccagctgcctagcagcaggaggtacggtgaagacggtgacaagaagccacgtcaccaccagcagcacctacgtgttcttttcatgacagcagcgacagatgaaccaacgtcctgtgcttgcctgacagttttcttcatggagaaatgaaaggaaaccaaacaaacgataaagacctggcagcagctccgtcccactaattaagtatcgtccctctcatcagtcagatcattttctgtccatcaattccataccagaaagatcgagcaacaagcaagctaggacacccccggccggcacggcaaagtcggcaacgatggccaactcgggtgcaagcaccaccactagcaataataagcgccgcctcctgctcctgctcgtcgccggcgccgtcctgctggcgccggcgtcggcccggcggcgccccgtgcggctgcgggtgtacatgcacgacatcgtgggcgggccggggcagacggcggcgctgctggtgaggggccccgggccggagaacccgtcgatgcacccgggcaactacttcggcgacacggtggcggtggacgacctcctcaccgagggcctcgccgcgggctccgcccccgtcggccgcgcgcagggcacctacatgacggggtccatgagccgccccgtgttcgtggtgagcgtgacgctgcacctcaccgcggggccctacaacggcagcacgctcgtggtggccggccgcgacgacaccttggagccggtcagggagctcgccgtcgccggcgggacgggggcgctccggcgggcccaggggcacgtgctgtggagcacggccagggtggagtcgccgctgcacgccgtgctggagctggacgtgcacgcgtccgtgcccgtgccggcgacgacgaccaccagaggcacagcggctgcgatgatggctgcttctcatctatctcaagtctgaccgacctgtatgaatgatcgagtagattactcgatcgaattaagataacgaaactaatcggcaaccttttactatg

SEQ ID NO: 38437 - protein, 209 aa, Panicum virgatum
  misc_feature: Ceres CLONE 1993955-R
  misc_feature (18)..(185): Pfam Name: Dirigent Pfam Description: Dirigent-like protein
MANSGASTTTSNNKRRLLLLLVAGAVLLAPASARRRPVRLRVYMHDIVGGPGQTAALLVRGPGPENPSMHPGNYFGDTVAVDDLLTEGLAAGSAPVGRAQGTYMTGSMSRPVFVVSVTLHLTAGPYNGSTLVVAGRDDTLEPVRELAVAGGTGALRRAQGHVLWSTARVESPLHAVLELDVHASVPVPATTTTRGTAAAMMAASHLSQV

SEQ ID NO: 38438 - DNA, 672 bp, Panicum virgatum
  misc_feature: Ceres CLONE 1993962
  misc_feature: Encodes the peptide sequence at SEQ ID NO. 38439
acaccccaaagcagcgcagccgcctcattcctcctctccatcctcctctcctctctctctctctctctctcgcgccactcttcccgttccgttccaggagagcagtgaggcgggtagtagtggtcggggaggggaggcaagatgttcatcgagagcttccgcgtggagagcccgaacgtgcggtacggcccgtcggagatcgagtcggagtaccggtacgacacgacggagctggtgcacgagggcaaggacggcgcctcccgctgggtcgtccgccccaagtccgtcaagtacaacttccggaccagcaccgccgtccccaagctcggggtgatgctcgtggggtggggcggcaacaacgggtccacgctgacggctggggtcatcgccaacagggaggggatctcatgggcgaccaaggacaaggtgcagcaagccaactacttcggctccctcacccaggcctccaccatcagggttggcagctacaacggggaggagatctacgctccgttcaagagcctcctgcccatggtaaaccctgatgacattgtgttcggaggctgggacatcagcaacatgaacctggccgatgccatgacaagggccaaggtgctggacattgacctgcagaagcagctcaggccctacatggagttcatggtggcactc

SEQ ID NO: 38439 - protein, 176 aa, Panicum virgatum
  misc_feature: Ceres CLONE 1993962
  misc_feature (62)..(176): Pfam Name: NAD_binding_5 Pfam Description: Myo-inositol-1-phosphate synthase
  misc_feature: SWISSPROT Homolog: EC 5.5.1.4 Inositol-3-phosphate synthase
MFIESFRVESPNVRYGPSEIESEYRYDTTELVHEGKDGASRWVVRPKSVKYNFRTSTAVPKLGVMLVGWGGNNGSTLTAGVIANREGISWATKDKVQQANYFGSLTQASTIRVGSYNGEEIYAPFKSLLPMVNPDDIVFGGWDISNMNLADAMTRAKVLDIDLQKQLRPYMEFMVA

SEQ ID NO: 38440 - DNA, 1450 bp, Panicum virgatum
  misc_feature: Ceres CLONE 1993977
  misc_feature: Encodes the peptide sequence at SEQ ID NO. 38441
ctacatagcctgggcctcctccgtccttctctctctttctctcaacggatcggagcaccaatttctcctcctgatctagctagagagggaagggaagagatcgaggaggccgggtcagtttcagcaatggggagggccttattcttgtcgctgctttgggtcgccatgttgagtgcttctcgcgtggtgcaagctcttccttacgactactcgtcgagctctgagtgcttgccggagccgctggagcctcactacggcggcggcatcatccggaacgccgacttcagcgccggcctccaggggtggtcggcgttcggttacggcgtcgtcgaggaaggcgcgtcggcgagcggcaacaggtacgccgtggcgcggaaccggacgcggccgtaccagagcgtcagccagaaggtgtacctgcagaacgacacgcactacactctgacagcttggttgcaggtcagtaatggcagcgccgacatcacagccgtcgtgaagaccaacggcgagttcatccacgccggcggcgtcgaagcgcggtccgggtgctggtccattctcaaaggcggcttcaccgcccccgccgccgggccggcagaactctacttcgagagcaacgcgacgggggagaaggtgatggtggacaacgtctcgctgcagcccttctcccaggaagagtgggcggcgcaccaccacgccgccatcaagtcggcgcgcaagaagacggtgcggctccgcgcccgggactccgctggcaagcccgtgcccggcgcgcaggtgcgcatcgagcacgtccggagcggcttcccgctgggttccgccatgagcgccgagatcctgcacaacccggcgtaccagcagtggttctcgtcgcggttcacggtgaccaccttcgagaacgagatgaagtggtacagcacggagcccgtccagggcagcgaggactactccgtcccggacgcgatgctccggttcgccaggagccacggcatccgcgtgcgcgggcacaacatcttctgggaccagccgagccagcagccggcgtgggtgcagtcgctgccgtaccagcagctccggcaggcgacggcgcggcggatcaagtcggtgatgtcgcggtacgccgggcaggtgatcgcgtgggacgtggtgaacgagaacctccacttcaacttcttcgagggcaggttcgggggcgacgcgtcggcggccttctaccggcaggcgcaccagatggacggcggcgcgctcatgtccatgaacgagttcaacacgctggagcagccgggcgacccgaacgcggtgcccggcaagtacctcggcaagctgttccagatcaagaagttccccggcaacaccaacgacggcaagatggccatcggcctcgagggccacttcaccacccccaacatcccctacatccgcgccgcgctcgacaccatgtccggtgccg

SEQ ID NO: 38441 - protein, 441 aa, Panicum virgatum
  misc_feature: Ceres CLONE 1993977
  misc_feature (45)..(180): Pfam Name: CBM_4_9 Pfam Description: Carbohydrate binding domain
  misc_feature (218)..(435): Pfam Name: Glyco_hydro_10 Pfam Description: Glycosyl hydrolase family 10
  misc_feature: SWISSPROT Homolog: EC 3.2.1.8 Endo-1,4-beta-xylanase
MGRALFLSLLWVAMLSASRVVQALPYDYSSSSECLPEPLEPHYGGGIIRNADFSAGLQGWSAFGYGVVEEGASASGNRYAVARNRTRPYQSVSQKVYLQNDTHYTLTAWLQVSNGSADITAVVKTNGEFIHAGGVEARSGCWSILKGGFTAPAAGPAELYFESNATGEKVMVDNVSLQPFSQEEWAAHHHAAIKSARKKTVRLRARDSAGKPVPGAQVRIEHVRSGFPLGSAMSAEILHNPAYQQWFSSRFTVTTFENEMKWYSTEPVQGSEDYSVPDAMLRFARSHGIRVRGHNIFWDQPSQQPAWVQSLPYQQLRQATARRIKSVMSRYAGQVIAWDVVNENLHFNFFEGRFGGDASAAFYRQAHQMDGGALMSMNEFNTLEQPGDPNAVPGKYLGKLFQIKKFPGNTNDGKMAIGLEGHFTTPNIPYIRAALDTMSGA

SEQ ID NO: 38442 - DNA, 697 bp, Panicum virgatum
  misc_feature: Ceres CLONE 1993979
  misc_feature: Encodes the peptide sequence at SEQ ID NO. 38443
aagtactagaaagccggcaccatggaggataagctacttctcgccgtcgccgccgccgccgtgctcgtcgtcctctcctggaggctcatcatccggccttccctcgccgccaagccgaagctcaaccttcctcccggcccgcggatgctgccggtgatcggcagcctccaccacctgctcagcagcccgctgctcttccgggtcctgcgcgggctcgccaagaagcacgggccgctcatgacgctccgcctcggcgaggtgcccgcgctggtggcgtcgtcgatggaggccgcgcaggcgatcctgaaggtgcacgacactaacttcgccgaccggttcaccccggccaccttcgcgacggtcgcctatgggggcaccaacctgatactctcgccctacggcgagcggtggcgccatctccgcaagatcgtcgtgcaagagatgctcaccgccacacgggtgcagtccttcaagcacatccgccaggaggaggtgggccggtttctgcagggcatggccgcatccgccgccgccggcaccgcggtgaacttctccacggcggtctccaagctcatcaacgacgcctttctgagggagtgcgtcggcagccggtgcaagtaccaggacgagttcctcgacgccgtccacacggcgtctctactggcgtcgggtgtaaccatcgccgacctctacccgt

SEQ ID NO: 38443 - protein, 225 aa, Panicum virgatum
  misc_feature: Ceres CLONE 1993979
  misc_feature: SWISSPROT Homolog: EC 1.14.13.21 Flavonoid 3'-monooxygenase
MEDKLLLAVAAAAVLVVLSWRLIIRPSLAAKPKLNLPPGPRMLPVIGSLHHLLSSPLLFRVLRGLAKKHGPLMTLRLGEVPALVASSMEAAQAILKVHDTNFADRFTPATFATVAYGGTNLILSPYGERWRHLRKIVVQEMLTATRVQSFKHIRQEEVGRFLQGMAASAAAGTAVNFSTAVSKLINDAFLRECVGSRCKYQDEFLDAVHTASLLASGVTIADLYP

SEQ ID NO: 38444 - DNA, 1364 bp, Panicum virgatum
  misc_feature: Ceres CLONE 1993981
  misc_feature: Encodes the peptide sequence at SEQ ID NO. 38445
atttccctgatctgatcccaacggggttttgcctcaagaaaccaacagcccccgtctgctcctccacctccacagctccccccctcccggcgaccgacccgcggctgcggcgagcgaacccggcgcggattcctcccccgcccgatccggccatggacgccgggtctaggccgcccccgccgaccggcgcaggggttcgcgtccgcgcgccgctggtggagtctgtctcctgctactgcagattagatacaggccttaaaactgttgttgatgctagaaagtttgttcctggtgcgaagatgtgcatgcaacctgaggtcaaacaaagcaagcgcaagtcaaggggctcgagaaaggaaagatgcagaacacaagcaccacttttacctggccttcctgatgaccttgctattgcctgccttatacgggttcctcgagttgaacaccccaatctcaggatggtttgcaaaagatggaaccgccttttgtctgggaattatttctactccttgcgtaagaaaattggagtggcagaagaatgggtttacgtctttaaaagggaccgtgaagggaagatatcctggcatgcctttgatccactacaccagctatggaagtcactcccaccagttccatcagagtattcagaagcattgggctttggctgtgctgttctgagtggttgctatctgtacttatttggtgggaaagatcctttgcggggttctatgaggcgtgttgtattctataatgctcggacaaacaaatggcaccgagctccagatatgctgaggaaacgtcacttttttggttcttgtgtaataaacaattgtctttacgttgctggtggggagtgtgaaggaatacagaggacactgcagtctgcggaagtttatgatccaaataggaacaaatgggcctgcattactgaaatgaacaatgggatggtgcctttcatcggagtggtatatgatggcaagtggtttctaaaggggctcgattcccatcgccaagtgaccagtgaagtctacttaccatcatccaatgtctggtcaacaatcgatgatgagatggttacaggatggcggaacccgagcatttccttcaatggtcggctctactcagctgactgtcgggatggctgcaagcttagagtttatgatgacaacacaggaacatggacaagattcatggacagcaagcaccatttgggtagctcacgtgccttcgaagctgcagctttggtgtcactaaatgggaaactttgtattatccggaacaacatgagcataactcttgttgatgtctcggacccaacaatgagtgtcgagacagatagtgtacgcatgtgggagactgttgct

SEQ ID NO: 38445 - protein, 403 aa, Panicum virgatum
  misc_feature: Ceres CLONE 1993981
  misc_feature (215)..(262): Pfam Name: Kelch_1 Pfam Description: Kelch motif
  misc_feature (167)..(213): Pfam Name: Kelch_1 Pfam Description: Kelch motif
  misc_feature (76)..(123): Pfam Name: F-box Pfam Description: F-box domain
MDAGSRPPPPTGAGVRVRAPLVESVSCYCRLDTGLKTVVDARKFVPGAKMCMQPEVKQSKRKSRGSRKERCRTQAPLLPGLPDDLAIACLIRVPRVEHPNLRMVCKRWNRLLSGNYFYSLRKKIGVAEEWVYVFKRDREGKISWHAFDPLHQLWKSLPPVPSEYSEALGFGCAVLSGCYLYLFGGKDPLRGSMRRVVFYNARTNKWHRAPDMLRKRHFFGSCVINNCLYVAGGECEGIQRTLQSAEVYDPNRNKWACITEMNNGMVPFIGVVYDGKWFLKGLDSHRQVTSEVYLPSSNVWSTIDDEMVTGWRNPSISFNGRLYSADCRDGCKLRVYDDNTGTWTRFMDSKHHLGSSRAFEAAALVSLNGKLCIIRNNMSITLVDVSDPTMSVETDSVRMWETV

SEQ ID NO: 38446 - DNA, 1695 bp, Panicum virgatum
  misc_feature: Ceres CLONE 1993985
  misc_feature: Encodes the peptide sequence at SEQ ID NO. 38447
agcaaaaacaggtttttggtaacatgcctcatcaaaataatgagctagattactttcaatcgcttgaaaatctgagtggatgtttcccatgacgaacctattatctccagcacacagaatagagacgttcctggtgctacacaaaggacctcccctgacattctttctgatttctttgccaatgctaactctgcagcacaatcatccagtcctttcattgatcctgtccatagcttaaacatgcctaattatgaaccccagcggtggtcattcttcagaaatcttgcacaaaacgagtttccacaaaaggatgagacccaagatctggcaaagattgaggagggagcttatccctttgattacttggagcatgatacaactaatgtgaagaattcagctcctcagaatgatattcagattgacaatccaacggcaatgaagaatgttgaagggttccaagttgataatcctttcacaaatatgcgtgaaatgatgccacctcatcctgattttgaggaacagaagactgaagaggctaaagctgttggaccagtcatggatgcttcctttaaggacactgattttgaatacttgcagatcatcaagaatgaagaccttgaagagcttagggaacttggttcaggtacatttggaactgtgtaccatggaaaatggaggggaagtgatgtagccattaagagaattaaaaaaagctgcttcacaggacggtcttcagagctagaaagactagcacatgagttctggcgagaagctgaaattctttctaagcttcatcatccaaatgttgtggcgttttatggtgttgtgaaagatgggccaggaggtacattggcaactgtgactgagttcatggttaatggctcacttcgacatgttttgcagcgcaaggacaaatatctcgatcgtcgtaagaggcttatcatagcaatggatgctgcatttgggctggagtatttgcactcgaaaaacattgtgcactttgatttgaagtgtgataacttgctcgtaaatcttaaagatcaatcacgtcccatatgtaaagttggtgactttggcttgtccaaaataaaaagaaataccctggtttcaggtggcgtgagagggactctcccatggatggctccagagttactcaatggaagcagcaataaggtgtcggagaaggttgatgtattttcctttggtattgttatgtgggaaatcctcactggcgaagaaccatatgccaatatgcactatggagcaattatagggggcatcgtaaacaacacactgaggccacctgtgccagcgtcatgtgatccagagtggaggaggctcatggagcagtgttgggccccagatccggcacagcgcccagctttcacagagattgctggcaggcttcgggccatgtcggttgctgcgaatcaggcgaaggcaaacaaatgagatgcaggtggaatacttccttccaggctccaatatgttgagggttctcttcttcttcttcttcttcttcttcttcttcttcttcttcttcttcttcttcttcttcttcttcttctttttggctggagagtaatacatatacatgtatgttatagagtgctgtaaacattagtccttcatttatacatctcatgggctggactgtatccgtcaatatatactggactcggtttgaaggttgcg

SEQ ID NO: 38447 - protein, 403 aa, Panicum virgatum
  misc_feature: Ceres CLONE 1993985
  misc_feature (126)..(389): Pfam Name: Pkinase_Tyr Pfam Description: Protein tyrosine kinase
  misc_feature: SWISSPROT Homolog: EC 2.7.11.1 Non-specific serine/threonine protein kinase
MPNYEPQRWSFFRNLAQNEFPQKDETQDLAKIEEGAYPFDYLEHDTTNVKNSAPQNDIQIDNPTAMKNVEGFQVDNPFTNMREMMPPHPDFEEQKTEEAKAVGPVMDASFKDTDFEYLQIIKNEDLEELRELGSGTFGTVYHGKWRGSDVAIKRIKKSCFTGRSSELERLAHEFWREAEILSKLHHPNVVAFYGVVKDGPGGTLATVTEFMVNGSLRHVLQRKDKYLDRRKRLIIAMDAAFGLEYLHSKNIVHFDLKCDNLLVNLKDQSRPICKVGDFGLSKIKRNTLVSGGVRGTLPWMAPELLNGSSNKVSEKVDVFSFGIVMWEILTGEEPYANMHYGAIIGGIVNNTLRPPVPASCDPEWRRLMEQCWAPDPAQRPAFTEIAGRLRAMSVAANQAKANK

SEQ ID NO: 38448 - DNA, 752 bp, Panicum virgatum
  misc_feature: Ceres CLONE 1994004
  misc_feature: Encodes the peptide sequence at SEQ ID NO. 38449
accagggccaccattccaccaagctctcccatcccctttgctcagcagcgtcctcctcatcagaagcctagcagctcttcctcgccccaacagccgtttctcagatctttttcaacaccggcactccagcagggcacagcaagggcatctgctctgcatttcttcgcctgatccagtccaaccggagagagttgaaaccattggacgccgcttagaaacttcttgatatttctaaggggcgataaggcagggaatgagtacaaccaaggtgaagagacgtgtggggaagtatgagctcggtcggaccataggtgaaggcacattcgcaaaggtcaggttcgcaaagaacactgagacaggcgaaccggtagccatcaaggtcgtagataaggagaaggtcctcaagcacaagatggttgaacagattaagcgggaaatttcgacaatgaagttgataaagcatcccaatgttgttcgcatatatgaggtgatgggaagtaaaacaaagatctacattgtgttagaatatgctacaggtggcgagctctttgacataattgctaaccatggtcgaatgagggaagatgaggccaggaggtacttccaacaattaatcaatgcagttgattattgtcacagcaggggtgtgtaccaccgggatctaaaacctgaaaatttactgctcgattcatatggaaacctgaaggtctctgactttgggctgagcgcgctatctcagcagatcagggatg

SEQ ID NO: 38449 - protein, 166 aa, Panicum virgatum
  misc_feature: Ceres CLONE 1994004
  misc_feature (13)..(164): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated salt sensitivity
  misc_feature: Useful for making plants with modulated biomass
MSTTKVKRRVGKYELGRTIGEGTFAKVRFAKNTETGEPVAIKVVDKEKVLKHKMVEQIKREISTMKLIKHPNVVRIYEVMGSKTKIYIVLEYATGGELFDIIANHGRMREDEARRYFQQLINAVDYCHSRGVYHRDLKPENLLLDSYGNLKVSDFGLSALSQQIRD

SEQ ID NO: 38450 - DNA, 659 bp, Panicum virgatum
  misc_feature: Ceres CLONE 1994015
  misc_feature: Encodes the peptide sequence at SEQ ID NO. 38451
atcgatcatgagcactcgcaaactacaagctaccaccttatcacaacgcgatcgatcgacccaaccaaaggtagcttaattagtgatcatcgatcactcgagggaggaggagaaaattaaagaaaaaggaagcaggtgctgcggtgaagtggccggcgagggagcgagctgatcgaccatgggtaccatcgggttcccggtgacgaggacgagcaggtcgctggtggcgccgtcgtcggcgacgccgcaggagacgctgcacctgtcggtgatcgaccgcgtggcggggctgcggcacctggtgcggtcgctgcacgtgttcgacggccgccgcggcgaggcggcggtgaggacgccggcggagacgctgcgggcggcgctggggaaggcgctggtggactattacccgctggcggggcggttcgtggaggaggacggggaggtgcgggtggcgtgcacggcggggggcgcctggttcgtggaggcggcggcggcgtgcaccctggaggaggtgaagcacctggaccaccccatggtcatccccaaggaggacctgctgccggagccggcgccggacgtcaaccccctcgacatgccgctcatgatgcaggtacgtacgacggatatccgaacgtctgtcgtctatatgtatttgttaa

SEQ ID NO: 38451 - protein, 160 aa, Panicum virgatum
  misc_feature: Ceres CLONE 1994015
  misc_feature: SWISSPROT Homolog: EC 2.3.1.167 10-deacetylbaccatin III 10-O-acetyltransferase
MGTIGFPVTRTSRSLVAPSSATPQETLHLSVIDRVAGLRHLVRSLHVFDGRRGEAAVRTPAETLRAALGKALVDYYPLAGRFVEEDGEVRVACTAGGAWFVEAAAACTLEEVKHLDHPMVIPKEDLLPEPAPDVNPLDMPLMMQVRTTDIRTSVVYMYLL

SEQ ID NO: 38452 - DNA, 1430 bp, Panicum virgatum
  misc_feature: Ceres CLONE 1994025
  misc_feature: Encodes the peptide sequence at SEQ ID NO. 38453
accagagcagagcagaagacagcggccggggcccgaacgaagcagcagagggtcaagagagcgcaaaggctttctctgcagctcgaagctcgcgtttccccgcaagaaccacctcgcgctccgctcgcggtcgcggctaggtctccgtcgaccgtcggcgaccggcatgaaggcgggggacgccatggagaggggcgagcagcgcgcgccgctcctgcccgagagccatgggccaaagattcaggacgacagcctgcaagtgccgctcttgaaggataaaaaacgcgcaggcagcaaggcaccggcagttgttctagggttcgagtgcctggagagcaccgcgttcagtggcatctcgtcgaacctggtcgtgtacctggagaccgtcctccatggcagcaacttggccagcgcctccaaagtcacgacatggttcggcaccagctacctcaccccgatcttcggcgccatcatcgccgacaccttcttgggcaactacaacaccatcctcgtctccctcgccgtctaccttcttgggatgatgttcgtgaccttctcggcgttcctgcccacggctgcagtgctgggtggctcctcggtgttcggtgcccagaccgtggcgttcgtggggctgtacctcgtcgcgatcgggagcggcggggtgcggtcgtcgctgcttccgttcggcgcggagcagttcgatgacgacaacgcgaccgaccgggagagcaaggggtccttcttcagctggttctacctctgcgtcgacttcggcccgatcgtctccggcctgttaatcgtgtggatccagaacaacgtcagctggggcctcggcttcggcatctccaccgcttgcatcgcgctcgccttcggtgccttcgtgctcgccacgcccatgtacaagcgccgcatgcccaccggcacgccgctcaagcgtctaagccaggtcatcgttgccgcctgccggaagatcaccctcaaggtgcccgccgatgcaggtatgctctacgaggtcagcgacaaggtggataaccagcccaagatcgaacacaccggcgagttctcattcctcgacaagggggccatcatcaccgagtcggactttgaggagataaccgaggaggccggatcgtcgtggaagctctgcaccgtgacgcaggtggaggagctcaagatcttgctgcggctcctacccatctgggccaccagcatcatcatgtcctcggcatacgcgcagatgaacaccaccttcatccagcagggcagcgtcatgaacatgtccatcctgtcggtgtccgtgccggcggcgtcgatgggctcgttcgaggtgacctgcgtcctgacatgggtgctgctctacagcaaggtgatcgcgccggctgtgaggggcttatcttctaatggcgacggcgagccgtcgcagctgcagc

SEQ ID NO: 38453 - protein, 421 aa, Panicum virgatum
  misc_feature: Ceres CLONE 1994025
  misc_feature (111)..(421): Pfam Name: PTR2 Pfam Description: POT family
  misc_feature: Useful for making plants with modulated nitrogen use efficiency
MKAGDAMERGEQRAPLLPESHGPKIQDDSLQVPLLKDKKRAGSKAPAVVLGFECLESTAFSGISSNLVVYLETVLHGSNLASASKVTTWFGTSYLTPIFGAIIADTFLGNYNTILVSLAVYLLGMMFVTFSAFLPTAAVLGGSSVFGAQTVAFVGLYLVAIGSGGVRSSLLPFGAEQFDDDNATDRESKGSFFSWFYLCVDFGPIVSGLLIVWIQNNVSWGLGFGISTACIALAFGAFVLATPMYKRRMPTGTPLKRLSQVIVAACRKITLKVPADAGMLYEVSDKVDNQPKIEHTGEFSFLDKGAIITESDFEEITEEAGSSWKLCTVTQVEELKILLRLLPIWATSIIMSSAYAQMNTTFIQQGSVMNMSILSVSVPAASMGSFEVTCVLTWVLLYSKVIAPAVRGLSSNGDGEPSQLQ

SEQ ID NO: 38454 - DNA, 624 bp, Panicum virgatum
  misc_feature: Ceres CLONE 1994025-R
  misc_feature: Encodes the peptide sequence at SEQ ID NO. 38455
ttctacgccgaggcgccggacaccatgaagagcacgtgcacgtcactggcgctgctcaccatcgcgctggggagctacctgagctctttcatctacgccatcgtggcggcgttcacgactacggcggacagtcccgggtggatctgcgacgacctcaatcagggacatctcgactacttcttctggaccatggccgccttgtgcacgctcaatttcgtcgtgtacagcggcttcgctaagaactacaagctcaagacggtgctctcatgacttgattccatcgcatattgctgcacataatcgttgtgcactggctcaatggttagtacataggaaacatacagcagtacagtaggaagaaaaatgcaggatttctttttgctccttttccttctcttctgattgaagaaactgcacagattcctgtggcagatttgtttttttttcttttggaatttttgtcttgttttttcacatatagttgatgagttggaagactacagacatcaatgtcaatgtatagttgtttctttttcctaacatgtattcgctccgctgatagtgcttacttgtaactccttctttactaatagaaatggcgaacaatcttgtggccgttcgttc

SEQ ID NO: 38455 - protein, 89 aa, Panicum virgatum
  misc_feature: Ceres CLONE 1994025-R
  misc_feature: Useful for making plants with modulated nitrogen use efficiency
  misc_feature: Useful for making plants with altered carbon content
  misc_feature: Useful for making plants with altered nitrogen content
FYAEAPDTMKSTCTSLALLTIALGSYLSSFIYAIVAAFTTTADSPGWICDDLNQGHLDYFFWTMAALCTLNFVVYSGFAKNYKLKTVLS

SEQ ID NO: 38456 - DNA, 1488 bp, Panicum virgatum
  misc_feature: Ceres CLONE 1994028
  misc_feature: Encodes the peptide sequence at SEQ ID NO. 38457
agagagagagagagagagaggacgcgcagccgcagccgcagccgcagcccagcaggcagcagcagcggccgccgcggcgtcattagcagcagtaactcctaatcgctgcctgcctgcccccggccaatcgcatgatttacttgctttgctaatcacgcttagcgatttagtctcctcctccttcctctacccccccccccccccgtatcgccgctccctttctcccccctgcctgcggccctgtccctgaatccgcggcggctcctgaggcgggcggcgcagcggcgggctcccgaggcgccgcctggtgagcggcgaggcgccggatctgcggcggcgatggaggagtgatttgggcgggaggtaggcgagaggtggggtgctggttttctcccgcgcaggagatggcggcgacggcggaggcgcggggaggggacttccccgtggggatgaaggtgctggtggtggacgacgacccgacttgcctcgtcgtgctcaagaggatgctcctcgagtgccgatacgacgtaacaacgtgtcctcaggctacaagagcactaactatgttgcgagagaataggcgcggttttgatgttataataagtgatgtccacatgccagatatggatggattcaggttacttgaacttgtaggccttgagatggaccttccagttattatgatgtctgctgattcaagaacggatattgtaatgaagggaataaagcatggagcatgcgactatttgataaaacccgtcagaatggaggaattgaaaaacatctggcaacatgttgttaggaaaaaattcagtgaaaacaaggatcatgagcattcaggtagcctagatgacactgatcgtaacagaccaactaataatgataatgaatatgcttcctctgcgaatgatggaggcgatggtagttggaaatctcagaaaaagaaaagagagaaagaagaggatgaagctgatcttgaaaatggcgatccttcttctacatcaaagaaaccaagagttgtttggtcagttgagcttcatcaacaatttgtaaatgcagtcaatcaccttggaatagacaaagctgttccgaagaaaattttggagttgatgaatgtccctggcttaactagggaaaatgttgccagccatttgcagaaattcagactctatctgaagagaatagctcagcatcatgcaggaatacctcatccatttgttgcgcctgcttctagtgctaaagttgccccactaggaggattggaatttcaagctttggctgcttccggtcagatccctcctcaggctctggctgctttgcaggatgaactcctaggtcgacctacaagcagtttggcgttgcctggaagggaccagtcatccttacgactcgctgcaatcaaaggaaacaagccccatggagagagagaaatagcatttggtcaacccatatacaagtgtcagaataatgcttatggggcattccctc

SEQ ID NO: 38457 - protein, 361 aa, Panicum virgatum
  misc_feature: Ceres CLONE 1994028
  misc_feature (16)..(129): Pfam Name: Response_reg Pfam Description: Response regulator receiver domain
  misc_feature (204)..(254): Pfam Name: Myb_DNA-binding Pfam Description: Myb-like DNA-binding domain
  misc_feature: SWISSPROT Homolog: EC 3.1.4.17 3',5'-cyclic-nucleotide phosphodiesterase
  misc_feature: The sequence is a functional homolog of SEQ ID NO 238 in the 10/666,642 US patent application
  misc_feature: The sequence is a functional homolog of SEQ ID NO 912 in the 10/412,699 US patent application
  misc_feature: Useful for making plants with altered lignin content
  misc_feature: The sequence is a functional homolog of SEQ ID NO 172 in the 10/666,642 US patent application
  misc_feature: The sequence is a functional homolog of SEQ ID NO 2510 in the 10/374,780 US patent application
  misc_feature: The sequence is a functional homolog of SEQ ID NO 686 in the 10/412,699 US patent application
  misc_feature: The sequence is a functional homolog of SEQ ID NO 976 in the 10/225,066 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
MAATAEARGGDFPVGMKVLVVDDDPTCLVVLKRMLLECRYDVTTCPQATRALTMLRENRRGFDVIISDVHMPDMDGFRLLELVGLEMDLPVIMMSADSRTDIVMKGIKHGACDYLIKPVRMEELKNIWQHVVRKKFSENKDHEHSGSLDDTDRNRPTNNDNEYASSANDGGDGSWKSQKKKREKEEDEADLENGDPSSTSKKPRVVWSVELHQQFVNAVNHLGIDKAVPKKILELMNVPGLTRENVASHLQKFRLYLKRIAQHHAGIPHPFVAPASSAKVAPLGGLEFQALAASGQIPPQALAALQDELLGRPTSSLALPGRDQSSLRLAAIKGNKPHGEREIAFGQPIYKCQNNAYGAFP

SEQ ID NO: 38458 - DNA, 676 bp, Panicum virgatum
  misc_feature: Ceres CLONE 1994028-R
ttcaaagtgggaataatccttatgtggttaatcagaatgctatggggttagctcaagaccaccaggtgttctgaagaccgagagcactgacccgctgagtcgtagttatggctacggtggcagcagcagcgtggactctggtttgctctcttctcagtccaaaaatccacagtacggtttattgcagaatccaagtgatgttacgggcaggtggtctccttcacaagatattgatagttatggaaatactattgggcaaggccaccctgggtcctcttcatctaactaccagagttccaatgtggcccttgggaagttgcccgatcaaggacgagggaggaatcatgggtttgttggcaaaggtacttgcattccaatccgctttgcagtggatgaggttgagtctccaactaacaacttgagccacagcattggaagcagtgcagacatagtgaatccggacattttcgaatttagtggacagatgtgaaactttcttgaatttgtaagtagggttgatcagtgggcactggaaagaaatttagtggtttgatgaatggttgcttcaattttcatttcatccttttcctctgtaattggtttataaagggaataatttatgtgacagcatgtggaatcttgctttatagaagtttgttcagtttaaagaacttcg

SEQ ID NO: 38459 - DNA, 684 bp, Panicum virgatum
  misc_feature: Ceres CLONE 1994057
  misc_feature: Encodes the peptide sequence at SEQ ID NO. 38460
aagcaggcgaagcaggagagcaagaagtggggcggcagcagggggaagggaaagagaaaggatcataagaaggatggtgatgaggagattgcggattttgatgaattggctgatgaactggtcagacagtcaaggggtcagtcacctctgcactctgtgcggtgggagcggatcatcttggatgaggctcacttcattaaagatagacggtgtaatactgcaagggctatttttgcattggagtcagaatacaagtgggctctgagtgggacacctttgcagaaccgcgttggagaactttactcacttattcgcttcttgcaaatcttcccctattcaaactatttctgcaaggactgtaactgtgagatactagataccagtatgaagaagcagtgcgactgtggtcactcatctgttaggcacttctgctggtggaataagtacatagcaagggcaatacagtcgggttcagcaagtgatgaaggcaaaagagccatgatgcttctgaaggagaaagttctgaaaggcatagtattaaggcgcaccaaaaaaggccgggctgcagatcttgctattccaccaaagattgtgactttgaggcgggactcttttgataaaaacgaaatggaattctatgaagctttgtatactcaaagcgtcacacagtttgattcatatgta

SEQ ID NO: 38460 - protein, 227 aa, Panicum virgatum
  misc_feature: Ceres CLONE 1994057
  misc_feature (2)..(227): Pfam Name: SNF2_N Pfam Description: SNF2 family N-terminal domain
KQAKQESKKWGGSRGKGKRKDHKKDGDEEIADFDELADELVRQSRGQSPLHSVRWERIILDEAHFIKDRRCNTARAIFALESEYKWALSGTPLQNRVGELYSLIRFLQIFPYSNYFCKDCNCEILDTSMKKQCDCGHSSVRHFCWWNKYIARAIQSGSASDEGKRAMMLLKEKVLKGIVLRRTKKGRAADLAIPPKIVTLRRDSFDKNEMEFYEALYTQSVTQFDSY

SEQ ID NO: 38461 - DNA, 687 bp, Panicum virgatum
  misc_feature: Ceres CLONE 1994076
  misc_feature: Encodes the peptide sequence at SEQ ID NO. 38462
ggtccgcgtcacgcacgcaggcgcgcagcccccggccgttttctacgggcggtgcgtgtagcgcacacttcgtttttctgtcttcgagaaggcggccggcggcggaggcggcgtgtagcataaaccccgagcccggcggccccgcccgtcacgccgcccgcccgtgcgttttccttcccttgtctcttgcttgcctgctcgcgaggctttgcgtcacccgccgatcgagttctccagactccaggctcctccgctcctggctccggaggccggggcgatcggcgcgcagcttcggatagagtactagagaatggccgacgaggatattcagcctattgtgtgtgacaatggcactggaatggtcaaggctggttttgccggtgatgatgcaccaagagctgtctttcccagcatcgtgggaaggccacgccataccggcgtcatggttggcatgggccagaaggatgcctatgtgggcgatgaagctcaggcgaagagaggtatcctgacactgaagtacccaattgagcacggcatcgtcaacaattgggatgacatggagaagatctggcatcacaccttctacaacgagctccgtgtagcgcccgaagaccaccctgtactgctgaccgaggcccctctcaaccctaaggccaacagagagaagatggctcagatcatgtttga

SEQ ID NO: 38462 - protein, 125 aa, Panicum virgatum
  misc_feature: Ceres CLONE 1994076
  misc_feature (3)..(125): Pfam Name: Actin Pfam Description: Actin
  misc_feature: SWISSPROT Homolog: EC 2.7.10.2 Non-specific protein-tyrosine kinase
  misc_feature: Useful for making plants with modulated biomass
  misc_feature: Useful for making plants with modulated flowering time
MADEDIQPIVCDNGTGMVKAGFAGDDAPRAVFPSIVGRPRHTGVMVGMGQKDAYVGDEAQAKRGILTLKYPIEHGIVNNWDDMEKIWHHTFYNELRVAPEDHPVLLTEAPLNPKANREKMAQIMF

SEQ ID NO: 38463 - DNA, 680 bp, Panicum virgatum
  misc_feature: Ceres CLONE 1994084
  misc_feature: Encodes the peptide sequence at SEQ ID NO. 38464
aggtgcaaagcatgatccatctgacaaggacgacaacagaaggatgcacccaaggttgtccttcaaggcattccttgaggttgtcaagatgaagagtctgccatggaatgactacgagatggatgctattcactcattgcaacttatacttagaggtacactgaatgatgccacgaagccggcccagacatctggtttagataaccagattggtgatctcaaacttgatgggcttgctgaattgcaggtggtgacaagtgaaatggttcgcctgatggaaactgcaactgttccaatcttagcagtagatggcaatggattggtcaatgggtggaatcaaaaggtagcggaattgacaggattgagagttgatgaggctataggaagacacatacttacacttgtggaagattcttctgtatcaactgttcagaggatgctatacttggctctgcagggcagagaagagaaggaagttcgatttgagttgaaaacacatggctccaagagggatgatggccctgttatcttggttgtaaatgcctgtgccagtcgtgaccttcatgaccatgttgttggggtgtgctttgtagcccaggatatgactgttcataagttggtcatggacaaatttactcgtgttgaaggggactacaaggcaatcgttcataacccgaacc

SEQ ID NO: 38464 - protein, 226 aa, Panicum virgatum
  misc_feature: Ceres CLONE 1994084
  misc_feature (86)..(201): Pfam Name: PAS Pfam Description: PAS fold
  misc_feature: SWISSPROT Homolog: EC 2.7.11.1 Non-specific serine/threonine protein kinase
  misc_feature: Useful for making plants with modulated biomass
  misc_feature: Useful for making plants with modulated light quality response
  misc_feature: Useful for making plants with modulated light quality sensitivity
  misc_feature: Useful for making plants with altered low light response
  misc_feature: Useful for making plants with modulated flowering time
GAKHDPSDKDDNRRMHPRLSFKAFLEVVKMKSLPWNDYEMDAIHSLQLILRGTLNDATKPAQTSGLDNQIGDLKLDGLAELQVVTSEMVRLMETATVPILAVDGNGLVNGWNQKVAELTGLRVDEAIGRHILTLVEDSSVSTVQRMLYLALQGREEKEVRFELKTHGSKRDDGPVILVVNACASRDLHDHVVGVCFVAQDMTVHKLVMDKFTRVEGDYKAIVHNPN

SEQ ID NO: 38465 - DNA, 1771 bp, Panicum virgatum
  misc_feature: Ceres CLONE 1994093
  misc_feature: Encodes the peptide sequence at SEQ ID NO. 38466
acggcggccgccgccaaaacccgctatacccaagttgccgaccaccgcccctcctccgctgctctcctccccgtcccctgcagtcacagctccgccgccggcgaccacccacctccgccgagttctattctgaaaaagttgttccactcatgggtcgcaccatcaagaaggccaagaaggccaaatccaagaaggccaagaaagttgaagcttcctcgtcatctaatcctgcggttgcctctggtccggccaaggtctggcaaccgagtgtagatacactggaagatggggaggaactccagtttgatcctgaggcttacaattatctccgagggttcgacattggctggtcttgcttgagttttgatattgtgcgcgatcaacttggactcatacgatcagagttcccccatacattatatggtgttgctggaacccaggctgagaaggcttcatcaaattatattggcattttcaagctttctaacataagggggaagaagcgggaacctataccagcttcaacagttgatggtgacacgaatgcggatagtgacagcagcagcgacgaagaagacgaagaaattaatgaggatacaaagcccattctacatctaaaaaaggtggctcatgcgggtagtgtaaatcggatacgctcaatgactcaaaaaccacatctatgtgctacgtggggagatactggtcatgttcaggtgtgggacttcagctcctaccttaattccttagcagatgcagagtcaggggcgcctgcacccaaagaagatgacataatcaacaaacacttgcctctgaaagtatttagtggccataaagatgagggatatgcaattgattggagtccgcttgttactggaagacttgtttctggcgactgcaataagtgcattcacctgtgggagccaactcagaacaactggaacgtagatgcaaatccatttgttggacacactgcaagtgttgaagatctacagtggagtcccacggaagctgacgtatttgcctcttgttctgtggatggtacgatagcgatatgggatatacgtacagggaagaaaccttgtatttctataaaagctcatatggccgatgtgaatgttatctcatggaataggcttgctagctccatgatagcttcagggtgtgatgatggcagtttctcagttcgtgatctcagatcaattcaggaggactcattggtagcgcattttgagtatcacaagaaagcagttacatctattgagtggagtccacatgaagcggcatcactagctgtaacgtctgaagatcatcaactcacaatttgggacctttcactggaaagagatgcagaagaggaggctgagttcagagcaaagatgaaggagcaggcgaatgcacctgaagatctacccccacaacttctctttgttcatcagggccaaaaagacttgaaagaactgcattggcacccgcagataccctcaatgataatatctacagcaattgacggctttaatgtgttgatgcccagcaacattgatacaactattcctggcaacactgatgcaaccatggcatctgctgagtcatagatgtatccagtagtatccctgtttagctgccggccatttgtgttgagcggatgaggatgataaattttgtttggctgacattctatgctatatagataaagatgtaatgtgcacagtttttgctatgtagtctaatggtggcacagcatatatatcagtcgatactgtggcgttgaagc

SEQ ID NO: 38466 - protein, 480 aa, Panicum virgatum
  misc_feature: Ceres CLONE 1994093
  misc_feature (264)..(303): Pfam Name: WD40 Pfam Description: WD domain, G-beta repeat
  misc_feature (218)..(257): Pfam Name: WD40 Pfam Description: WD domain, G-beta repeat
  misc_feature (354)..(393): Pfam Name: WD40 Pfam Description: WD domain, G-beta repeat
  misc_feature: SWISSPROT Homolog: EC 2.3.1.48 Histone acetyltransferase
MGRTIKKAKKAKSKKAKKVEASSSSNPAVASGPAKVWQPSVDTLEDGEELQFDPEAYNYLRGFDIGWSCLSFDIVRDQLGLIRSEFPHTLYGVAGTQAEKASSNYIGIFKLSNIRGKKREPIPASTVDGDTNADSDSSSDEEDEEINEDTKPILHLKKVAHAGSVNRIRSMTQKPHLCATWGDTGHVQVWDFSSYLNSLADAESGAPAPKEDDIINKHLPLKVFSGHKDEGYAIDWSPLVTGRLVSGDCNKCIHLWEPTQNNWNVDANPFVGHTASVEDLQWSPTEADVFASCSVDGTIAIWDIRTGKKPCISIKAHMADVNVISWNRLASSMIASGCDDGSFSVRDLRSIQEDSLVAHFEYHKKAVTSIEWSPHEAASLAVTSEDHQLTIWDLSLERDAEEEAEFRAKMKEQANAPEDLPPQLLFVHQGQKDLKELHWHPQIPSMIISTAIDGFNVLMPSNIDTTIPGNTDATMASAES

SEQ ID NO: 38467 - DNA, 738 bp, Panicum virgatum
  misc_feature: Ceres CLONE 1994106
  misc_feature: Encodes the peptide sequence at SEQ ID NO. 38468
gactgtgctttttgccccagaacgaggtaaaccagatacagacacctctgttcatcctcaacgcagcatatgattcttggcaggtaaggaacattttggtgcccggagttgctgaccctccgggtacatggcatagctgtaagcatgacatagaccagtgttctgcagcgcagctccgggtactacagggattcagggatgattttctgaaggcagtggcggaacaagggaattccgcctccagagggctgttcataaactcatgcttcgttcactgccagtccgagacacaggagctgtggttttcatctgactcccccatgctcggaaacacgacgatagcagacgccgttggcgcctggttcttcgaccgaagcccgttccagaagatcgactgcccgtacccttgcgactcgacctgccacaaccgggtctacgatgacccatcacgagcatagcaattacagcagcctcacttcctactgccattcgtcacgctactacatttgacgctccagcattgctaaccggtatagggcaatgcgttgatagcaattgattgattgaataaaaagatccggtgccggaagcttccaacggcaggtacaggataggagcagcttcctatgtttccactgccctgtattttcgtctgatacttacatgagccacattggttcttcagaagtgaggcgggacagattatttttacaggaaatatgatttcaccttttatag

SEQ ID NO: 38468 - protein, 151 aa, Panicum virgatum
  misc_feature: Ceres CLONE 1994106
  misc_feature (1)..(130): Pfam Name: PAE Pfam Description: Pectinacetylesterase
  misc_feature: Useful for making plants with altered cell wall content and/or composition
  misc_feature: Useful for making plants with altered carbohydrate content
LCFLPQNEVNQIQTPLFILNAAYDSWQVRNILVPGVADPPGTWHSCKHDIDQCSAAQLRVLQGFRDDFLKAVAEQGNSASRGLFINSCFVHCQSETQELWFSSDSPMLGNTTIADAVGAWFFDRSPFQKIDCPYPCDSTCHNRVYDDPSRA

SEQ ID NO: 38469 - DNA, 1962 bp, Panicum virgatum
  misc_feature: Ceres CLONE 1994114
  misc_feature: Encodes the peptide sequence at SEQ ID NO. 38470
atgtcgcccggacgcggaggagggctactgcgaccttgccattgccacgcccgccaagtcagaccaagcagggagacgcccgcagacgcaccaaccaccagcacagcacagcagagcagaggaggactagagcgcggcgccaccacccgggaccaagagagccaacaggcagatcgcgcgcgatccatccatccgatcccgccgatcgccatggccccgccgccgccggtggacccgcgcagcggctactgcgccgccacgcgctccttccgcagcaagcgcgccgacgtcccgctccccgccgaccgcgacctcgacgtcgtcaccttcctcgcctcccgccgccacgcggccaccgcgctcgccgccccgccgctctccctccgcaagggccaggccgcgctcatcctctcccccaactccgtccacttccccgtcgccgcgctcgccgccatgtccctcggcgccgtgctcaccaccgccaacccgctcaacacgcccgccgagatcgccaagcaggtcgccgacgcgcgccccgtcctcgccttcaccacccgggacctcctccccaagctccccgccgccggcctccgcgtcgtgctcctcgagcccgagcgcctcccctccgaccccgccgccgtcgtcgccaccatcggggagatctccgccacgacgcccgaccccgcgcgccgcagggagcgcgtcacgcaggacgaccccgccacgctgctctactcctcggggaccacggggcccagcaagggcgtcgtcgccacgcaccggagcctcatctccatggtgcagatcatcatgacgcggttccgcctcgagagctccgacaggaccgaggccttcctctgcaccgtgcccatgttccacgtctacggcctcgtcgccttcgccacggggctgctcggctgcggcgccaccatcgtcgtgctctccaagtacgagctccccgagatgctgcgcgccatcaacgagtacgggatcacctacctgccgctcgtgccgcccatcctggtcgccatggtggcgcaccccaagccgctgccgctcggccagctgcgcaaggtgctctccggcggcgcgccgctgagcaaggagatcatcgaggggttcagggacaagtacccgcaggtggagatcctgcaggggtacgggctcacggagagcacggccatcggcgcgtccacggactctgcagaggagagccgccgctacggcacggctgggctgctctcgcccaacaccgaggctaagatcgtcgattcggacaccggtgaggcgctcccggtgaaccgcacaggcgagctctggatccgggggccatacgtcatgaaagggtacttcaagaacacagaggcaacacagtcaacgttgacacctgacggatggctcaagactggggacctctgctacatagacgaggatgggtatctcttcgtggttgatcgcctcaaagagctgatcaaatacaaagggtatcaggtgcctccggcagagttggaggctcttttgctaacacatccggaaattgcagatgtcgctgttataccgtttcctgatcgtgaggttggccagttcccgatggcctacgtagttaggaagaaggggagcaacttgtcagatcgcgaggtgatggagtttgtggcgaaacaggtagcgccttataagaaggttaggaaggtggcatttgtgacagaaattcccaagaatgcgtccggcaagatactgaggaaggatctcatcaagctcgccacatcaaaattgtgagatgtctactggtccgaatttactgtgttggcatcaagcgggcagtgagctctgcactttcccagtactggcgagtgttaactgaagatcccattgggggctatttgcctgtctaagctgttcatgtacaaggttattgcgtctgtaaccaggaatgaataatcaatttggtaaataattccgagt

SEQ ID NO: 38470 - protein, 521 aa, Panicum virgatum
  misc_feature: Ceres CLONE 1994114
  misc_feature (40)..(448): Pfam Name: AMP-binding Pfam Description: AMP-binding enzyme
  misc_feature: SWISSPROT Homolog: EC 6.2.1.12 4-coumarate--CoA ligase
  misc_feature: Useful for making plants with altered carbohydrate content
  misc_feature: Useful for making plants with altered cell wall content and/or composition
MAPPPPVDPRSGYCAATRSFRSKRADVPLPADRDLDVVTFLASRRHAATALAAPPLSLRKGQAALILSPNSVHFPVAALAAMSLGAVLTTANPLNTPAEIAKQVADARPVLAFTTRDLLPKLPAAGLRVVLLEPERLPSDPAAVVATIGEISATTPDPARRRERVTQDDPATLLYSSGTTGPSKGVVATHRSLISMVQIIMTRFRLESSDRTEAFLCTVPMFHVYGLVAFATGLLGCGATIVVLSKYELPEMLRAINEYGITYLPLVPPILVAMVAHPKPLPLGQLRKVLSGGAPLSKEIIEGFRDKYPQVEILQGYGLTESTAIGASTDSAEESRRYGTAGLLSPNTEAKIVDSDTGEALPVNRTGELWIRGPYVMKGYFKNTEATQSTLTPDGWLKTGDLCYIDEDGYLFVVDRLKELIKYKGYQVPPAELEALLLTHPEIADVAVIPFPDREVGQFPMAYVVRKKGSNLSDREVMEFVAKQVAPYKKVRKVAFVTEIPKNASGKILRKDLIKLATSKL

SEQ ID NO: 38471 - DNA, 689 bp, Panicum virgatum
  misc_feature: Ceres CLONE 1994116
  misc_feature: Encodes the peptide sequence at SEQ ID NO. 38472
accacacgccgagacttgctcttcttcttcttgttgttgaggaatagatagatagaattctggggcagccggggcccgagatcggcgaggagccgtccggccggccgtgcttgcttgcgccattgatacatccttccatctcatctactagagagggagttgtagcagcagatccacccaacacaatggagacctgggacagcgttccctccaccacgccgctcccctacgcctactcgccgctcccggccgccgacgccgcctccgccgaggtctccggcgccggccgagccaacggccgccgcaggccgctctgcgccgccgcgctcgtgctgtccgccgcgctgctcctggccgtcgcggcgctggccggcgtccgcgtcgcgccctcgcgccccatcacggtgggagtgggagagacgacgactgcggcgaggagcaggggccccgcggccggcgtgtcggagaagacgtccggcgcgcaggggatgctgcgcggcggcaacgccttcccctggagcaacgcgatgctgcaatggcagcgcacgggattccacttccagccgcagaagaactggatgaacgatcccaacggccctgtgtactacaaggggtggtaccacctcttctaccagtacaaccccgacggcgccatctggggcaacagatcgcgtggggccacgccgtgt

SEQ ID NO: 38472 - protein, 167 aa, Panicum virgatum
  misc_feature: Ceres CLONE 1994116
  misc_feature: SWISSPROT Homolog: EC 3.2.1.26 Beta-fructofuranosidase
  misc_feature: Useful for making plants with altered carbohydrate content
METWDSVPSTTPLPYAYSPLPAADAASAEVSGAGRANGRRRPLCAAALVLSAALLLAVAALAGVRVAPSRPITVGVGETTTAARSRGPAAGVSEKTSGAQGMLRGGNAFPWSNAMLQWQRTGFHFQPQKNWMNDPNGPVYYKGWYHLFYQYNPDGAIWGNRSRGATP

SEQ ID NO: 38473 - DNA, 675 bp, Panicum virgatum
  misc_feature: Ceres CLONE 1994123
  misc_feature: Encodes the peptide sequence at SEQ ID NO. 38474
acgaagccagcgaaaatccagtagagagagaggggcagaggggagggaggcagccggcagccattactcccaccagccagcaccaccaccgctgctgctggggacgcctgcagcaagtacaggcggatatccgcttccattactgtgtctcgcggcggcggaccagcggcggggcagagggttcgcttcggcggccgcaataaattccgcccccccccccccccctccccccatggcacggagggccgcctcctcgctcgtctcccgctgcctcctcgccagcagggccgcctcggcaggtgccgcgcccgctgtcccctccgcgctccgcaggccagataggacgcgcggactgttgccaggggtccttcaaaggttcagcactgcagcagcagcagaagagcccatctcgcccccagtccaagtgaactacacaaagctcctcatcaatggcaactttgttgattccgcatccggcaagaccttcccaacactggaccctcgtacaggggagttaattgctcatgtggctgaaggtgacgcggaggatgttaaccgtgccgtcgctgcagcacgcaaggcttttgatgaggggccgtggccgaagatgactgcatatgagaggtcccttatcctgctacggtttgctgatttgatcgagaagcacattgacga

SEQ ID NO: 38474 - protein, 147 aa, Panicum virgatum
  misc_feature: Ceres CLONE 1994123
  misc_feature: SWISSPROT Homolog: EC 1.2.1.3 Aldehyde dehydrogenase (NAD(+))
MARRAASSLVSRCLLASRAASAGAAPAVPSALRRPDRTRGLLPGVLQRFSTAAAAEEPISPPVQVNYTKLLINGNFVDSASGKTFPTLDPRTGELIAHVAEGDAEDVNRAVAAARKAFDEGPWPKMTAYERSLILLRFADLIEKHID

SEQ ID NO: 38475 - DNA, 664 bp, Panicum virgatum
  misc_feature: Ceres CLONE 1994128
  misc_feature: Encodes the peptide sequence at SEQ ID NO. 38476
aggagaggagaccagaccaccaccaccaccactccacccccatcacagaaacagagagagccctgcctacaatggcggcggccctcgagtccggctggcaggtcctgaccgccaacttcaccgagttccagctcgccaccgtcttcaccttcctgatccacgaggccgccttcttcctctccggcctcccctccctcctcttcgagcgcttcgggctcttcgccaagtacaagattcaggtacgtttgccgacgtttagttcctcttcagccaacgccaatctatctgatctgattcagttcattcgtcgatagattatcagtagtgctctgctcactagtcacccctgctggtgctgtgtttaatttctggtgaatgtttccttttctccgtcaaggaaatactactgtatgtattgcctagtatgctgtaaaagaatgtatataatatataggacaataattaagacaactggagataatgtcgagaaaggcaggcaaccagtttttctttctttttacctgtcagtcaaggattcggtgagcaaaggcccggaaagattatgacagcgatagatcagatgcttcttgttgttttggcttctagtatggcccaaaacaaggctagctaggcaacctttcgctttcttcttctttcatcctcc

SEQ ID NO: 38476 - protein, 80 aa, Panicum virgatum
  misc_feature: Ceres CLONE 1994128
  misc_feature: SWISSPROT Homolog: EC 1.14.13.72 Methylsterol monooxygenase
  misc_feature: Useful for making plants with modulated cold sensitivity
MAAALESGWQVLTANFTEFQLATVFTFLIHEAAFFLSGLPSLLFERFGLFAKYKIQVRLPTFSSSSANANLSDLIQFIRR

SEQ ID NO: 38477 - DNA, 675 bp, Panicum virgatum
  misc_feature: Ceres CLONE 1994128-R
  misc_feature: Encodes the peptide sequence at SEQ ID NO. 38478
ggtgcatcgccaaggccgtggagttcctcctcctgggcgccgccatcgccgccgcgttcgcggacccgctcgtggacgccgtccacaacttctccaacgccacgcacatcccgtccttcttcatctccttcatcgccctcccgctggcgaccaactctagtgaggccgtctccgccatcatcttcgccagcaggaagaagcagaggacctgctccctcaccttctcggaggtgtacggcggcgtgacgatgaacaacacgctgtgcctgggcgtgttcctggcgctcatctacttccggaacttgacgtgggacttctcatcggaggtgctcatcatcctggtcgtctgcgtcatcatggccctcttcaccagcttccggaccacgttcccgctatggacctgcctcatcgcctacatgctctaccccctctcgctggtcatcgtctacatcctcgactacgtcttcggctggtcataggcgcattggctctcctcaagtgaacgcctgtttttttggcggccacaagtcggtttggtcctgtaattttgactgctgtgggcagagactgtttctcgtgttgatctaatcatgctcaaacctttccttgtgtatccaaaccacgcgtacttcactacttcttcacattctaacaacagctacattcttgagctcc

SEQ ID NO: 38478 - protein, 158 aa, Panicum virgatum
  misc_feature: Ceres CLONE 1994128-R
  misc_feature (14)..(148): Pfam Name: Na_Ca_ex Pfam Description: Sodium/calcium exchanger protein
CIAKAVEFLLLGAAIAAAFADPLVDAVHNFSNATHIPSFFISFIALPLATNSSEAVSAIIFASRKKQRTCSLTFSEVYGGVTMNNTLCLGVFLALIYFRNLTWDFSSEVLIILVVCVIMALFTSFRTTFPLWTCLIAYMLYPLSLVIVYILDYVFGWS

SEQ ID NO: 38479 - DNA, 1495 bp, Panicum virgatum
  misc_feature: Ceres CLONE 1994132
  misc_feature: Encodes the peptide sequence at SEQ ID NO. 38480
acacacgctcccattccgtccgcttcccaaaatttcaccaccgccacaagcaaagacctccccttcctctccgattctcccgtccccaaaatttctctggcttccccgcccccacactctcaccggcgcatccccgacgagaaccccagagctccccggctcccgcccagcgcggccgtcctatcctattccttccctccgccacccgcctcgcgtgtgcgcacatgcgatgcttcctccgcggaggcggccacgcgcggcgcggtgactgagatggtgcgctttttccgcagcgggaacctcgcctccagggtcttcgaccgccagcttctctccccgcgccccggcgctgcggttaacactattagacagttctatgagaatttggttccaagctacacagtatatgacatagattgcccggactattcatttcgcaagttcactgatgatgggaaatatcttgtggcttttagccgaaaccaccaagatttgattgtataccgccccatctggttgacatattcatgcactgaagaatgtgattctcatgatcttccaccaaaagcaaagaagtttgatagcttctttaagcagctctactcaattccacttgcatccagcaatgaatacatttgcaaggactttttcctgtacatggaatgccatcaatttggcttatttacaacatcaaccgcacaaagtaatgattcaactgccgctgagggtgcaatatatggcgtgccatcaattgagaaaataactttctaacttgtgaggctagaagatggcgtcgtactggatgaaaaggctttctgcaatgattttatcaatctggcacatagtattggtgcttacttgtatgaagacctgctttgtattgtttcgctgagatatcaaacaatacatatcctacagatccgagattcaggcaaccttgttgaggtacgcagcattggtgctttctgccgggaagatgatgagctatttcttcactcacatgttcaggtatctgcaaatggtgggaccacagctttgttggattttactttgcattatgttttcttctttttaggtaaacacttgtaaagtgcacatgttaaatggtctgtacatattatcactaatatatcaattaggacatgcctacggcgttttgcatggtcatcactcatcaaacattccctaatctatatgaaagtatcattgtaatactgaccacattatcattgtacttgctctgtttcaaaattgaggttttagttttgtcctaagtcaaacttatgtaactttgaccaagtttatttgaaaaatgttaaacatttacaataccaaataaatgtactatcaagacatatttaatgaaactaacttgatgttgcagatgttggtgattttttttcatgaacttggtcaatgaagaagtttgacttaggacaaagctagaacctcttacattttggaatggagggagtagattacgaggtggtctgtc

SEQ ID NO: 38480 - protein, 165 aa, Panicum virgatum
  misc_feature: Ceres CLONE 1994132
  misc_feature: Useful for making plants with modulated light quality sensitivity
  misc_feature: Useful for making plants with modulated low light sensitivity
MVRFFRSGNLASRVFDRQLLSPRPGAAVNTIRQFYENLVPSYTVYDIDCPDYSFRKFTDDGKYLVAFSRNHQDLIVYRPIWLTYSCTEECDSHDLPPKAKKFDSFFKQLYSIPLASSNEYICKDFFLYMECHQFGLFTTSTAQSNDSTAAEGAIYGVPSIEKITF

SEQ ID NO: 38481 - DNA, 716 bp, Panicum virgatum
  misc_feature: Ceres CLONE 1994132-R
tcagcttgattttgccgctgggtcgtacgccatggaagaggagcgacaaaagcaggggtggtgcgcgaggagagtggatggagcaggggtgacgtgcagtggagggagagcggaaggagcaggggtgatgcgccgtggaggggaggcgggctgctgtgcgcaccactgccgaggatgtggccagcgccggagagattcagcgtgcagaggaagagattgggggagatacgactggcggcggctacacgtctgtgttgagtgtcctctgtcatggaggtgctagggcatatgagatgcacatgggctgtaatttggcccatgtaggttagttggcatattggcctttcatcgtattatgggccgagatcggtaagaaaatagcccaaatattctttgttattattttattgatatatatatgtaacgtttaatcacgattaatcaacatttaatcttcctaggtactaggcagtgacctagcgcctagcgttttcttgaaccttgcttcaaagttaacagattagaaaaaaattactataagtgccactggtctaagtactggtttgtcctattatggactgcaatgtgtgagaaatgtagttgttgctagacgatatgattgattgcaggaagaaagcagatgccaagatttatgtgcagtctgtctagttttgatggatcatgagatatagaatatagttgaataacttccacgg

SEQ ID NO: 38482 - DNA, 398 bp, Panicum virgatum
  misc_feature: Ceres CLONE 1994137
  misc_feature: Encodes the peptide sequence at SEQ ID NO. 38483
gcgacggcgctgttcgtggtgctgacgccgggcctgctctgcacgctgccggggcgcggccgggtggcggagttcggcagcatgcacaccagccccgtcgccatcatcgtccacgccgtcctctacttcgcgctcatcaccatcttcctcatcgccatcgggatccacatctacgccggctagccggcaccagcagccgccggccgatcgatcgagccggggggggggggggggcgtcaggcggcggcggccgccggcgtgtgattcaaaactagatcgggcttttcctcctgtccctctctctcctgctgatcagttcctccccccgctgcgggagtaggactcgatgatttattaagactgtgctctgtgctggttgttatggatcaagactttgc

SEQ ID NO: 38483 - protein, 60 aa, Panicum virgatum
  misc_feature: Ceres CLONE 1994137
  misc_feature: Useful for making plants with altered cell wall content and/or composition
ATALFVVLTPGLLCTLPGRGRVAEFGSMHTSPVAIIVHAVLYFALITIFLIAIGIHIYAG

SEQ ID NO: 38484 - DNA, 678 bp, Panicum virgatum
  misc_feature: Ceres CLONE 1994140
  misc_feature: Encodes the peptide sequence at SEQ ID NO. 38485
cagaggttcagtcagaggctaccttctaaacggcctgaaaaggaggccaagctaaggtagcctgctttggccacaagagccgtgcgccaagtcaatccctgcccggcccggccctcatataattgccatcgcaattcacaactccctaaagtcaaggtcacgggcaggacacggcggcgcggcgagctagctcccggtgccacagctgagcgacgacctcgatcggcgccggccgatcgacatgggtaagaaggacgggccgccggaggcggccaagaagaaggcggcgccggcgctgcggtcgttcgcgtcggtgttcatgcacgcggacgcgacggacgtggcgctcatggtgctcggcctggtgggcgccatgggcgacggcctgtccacgcccgtcatgctcctcatcaccagccgcatcttcaacgacctcggcagcggcccggacgccctccagcagttcagctccaagatcaacgagaacgcgcggaacctcctcttcctggcgctcggcaactgggtggtggcgttcctagagggctactgctgggcgcgcacggcggagcggcaggcgtcgcggatgcgggcgcggtacctgcgggcggtgctccggcaggacgtggagtacttcgacctgaacgccggctccacatcggaggtgatcaccagcgtctc

SEQ ID NO: 38485 - protein, 145 aa, Panicum virgatum
  misc_feature: Ceres CLONE 1994140
  misc_feature: SWISSPROT Homolog: EC 3.6.3.44 Xenobiotic-transporting ATPase
MGKKDGPPEAAKKKAAPALRSFASVFMHADATDVALMVLGLVGAMGDGLSTPVMLLITSRIFNDLGSGPDALQQFSSKINENARNLLFLALGNWVVAFLEGYCWARTAERQASRMRARYLRAVLRQDVEYFDLNAGSTSEVITSV

SEQ ID NO: 38486 - DNA, 115 bp, Panicum virgatum
  misc_feature: Ceres CLONE 1994140-R
tgtgtatgtgtgtgagtgtgtctgtgtgtactgtgtgtgtgtgtatgtatgtgtgtgtgtgtgtgtgtactgtgtgtgtgtgtgcgtgtgtgtgtgtgtgtgtgtgtgtgtgtgt

SEQ ID NO: 38487 - DNA, 1365 bp, Panicum virgatum
  misc_feature: Ceres CLONE 1994165
  misc_feature: Encodes the peptide sequence at SEQ ID NO. 38488
accacaaccagctatcacgtccaaggcttctcgccgccgccgccgccgccgccgcgcaataatgagcatcacgacggaggtgtccctggaggccggcaacctggccgcctccgccgtgctcgacgacgacggccgcccgcgccgcacgggcacggtcctcactgcgagcgcgcacatcgtcaccgccgtcatcggctccggcgtgctctcgctgccctgggcggtggcgcagctcggctgggcggcggggcccccggtcatgctcctcttcggcggcgtcatgtactacacctccacgctcctcgccgagtgctaccgcgccggggaccccgccacgggccgccggagctactcctacaccgacgccgtccgcgccatcctcggcggcaccaaggtcaccctctgcggcgtcgtccagtacgtcaacctcgccgccatcgccgtcggctacaccatcgccgcctccatcagcatgcaggccgtctggaaggccaactgcttccacgccaggggccacgacgcccacgcgtgccgcagctccagcgtgccctacatgatcgccttcggggccgtccaggtcgtcttctcgcagatacccaacttcgaccagatcaagtggctctccatcgtcgcctccgtcatgtccttcacctactcgggcatcggcctcggcctcgccgtcgcccagaccgtggccaacggcgcgttccggggcaccctcaccggcgtcgccgtcggcgctggcggcctcaccgtcatgcacaaggtctggcgcacgatgcaggcgctgggcaacatcgccttcgcctactccttctccaacgtgctcatcgagatccaggacaccatcaaggcgccgccgccgtcggaggcagcggtcatgaagaaggccacggcgatcagcatcgccacgaccacggcgttctacacgctgtgcgggtgcatgggctacgcggccttcgggaacgccgcgccggacaacctcctcacggggttcggcttctacgagcccttctggctcgtcgacgtcgccaacgccgccatcgtcgtccacctcgtcggtgcgtaccaggtcttctgccagcccatcttcgccttcgtcgagagccgggccgccgccgcgtggccggacagcgccttcgtctccaaagagctccgcgtggggcccttcgcgcccaccgcgctccgtctcgcgtggcgctcggcgtacgtgtgcctcgccaccgtggtagccatggcgctgcccttcttcgggagcgtcgtcggtctcatcggcgccttctccttctggccgctcaccgtctacttcccagtcgagatgtacatcaagcagcgcgccgtgacgcgcggcagcaccaagtggat

SEQ ID NO: 38488 - protein, 434 aa, Panicum virgatum
  misc_feature: Ceres CLONE 1994165
  misc_feature (28)..(434): Pfam Name: Aa_trans Pfam Description: Transmembrane amino acid transporter protein
MSITTEVSLEAGNLAASAVLDDDGRPRRTGTVLTASAHIVTAVIGSGVLSLPWAVAQLGWAAGPPVMLLFGGVMYYTSTLLAECYRAGDPATGRRSYSYTDAVRAILGGTKVTLCGVVQYVNLAAIAVGYTIAASISMQAVWKANCFHARGHDAHACRSSSVPYMIAFGAVQVVFSQIPNFDQIKWLSIVASVMSFTYSGIGLGLAVAQTVANGAFRGTLTGVAVGAGGLTVMHKVWRTMQALGNIAFAYSFSNVLIEIQDTIKAPPPSEAAVMKKATAISIATTTAFYTLCGCMGYAAFGNAAPDNLLTGFGFYEPFWLVDVANAAIVVHLVGAYQVFCQPIFAFVESRAAAAWPDSAFVSKELRVGPFAPTALRLAWRSAYVCLATVVAMALPFFGSVVGLIGAFSFWPLTVYFPVEMYIKQRAVTRGSTKW

SEQ ID NO: 38489 - DNA, 1309 bp, Panicum virgatum
  misc_feature: Ceres CLONE 1994167
  misc_feature: Encodes the peptide sequence at SEQ ID NO. 38490
gttaccagtgcggcagcgcctcgccgtcgccggcaatccggttggctcaccggccgactggtcccgtcgccgggctcgcccctccgccacccaactggtggaggtggagcaggagtactcgagtatgaatcctgtggggcctctgtctcgcgctccctcctcagtcgcttactcctgccaagcgcgcagcctcactcaaaccctgctctccagcctcgccggcgaccgcctccgacgcctcctcccggcttcccatgcccgcgccgtcgtctcagaaggtctcggtaacctgttcctcgccaaccttctcctccgtggttactccaagctcggtctcctcctcgacgcccgccgcctgttcgacggaatgctgcaccggaacctcgtatcctggtcatcggccatctccatgtacgcgcagcatggcggcgacgaccaagctcttttcctctttgcagcgttcaggaaatcatctgacgaggtgcccaacgagttcttgcttgccagtgtcctgcgggcctgcacgcagtccagggctgttcctttcggcgagcaagtgcatggtactgccctcaagcttggcctggatgttaatctctacgttggcacagcgttgatcaacctgtatgcaaaggttgccttcatggatgcggcgatgcgggtgttccatgccctccccgcaaagaacccagtcacttggacagcagtcatcactggctactctcagatttgccagggcggacgtgccctggacttgtttcaaaagatgggggttcaaggtgtccgtcctgacaggtttgtgctagcaagtgctgtcagtgcctgctctgcgcttgcctttatacaaggaggcaggcaaatacatggttatgcttatcgaagtgcagcaggaatggatgcttcagtgatcaatgcactgatggatctttattgcaagtgctctagaccgttagtggctcggaagctgtttgatcacacaaagaaccataatcttgtgtcttggacaacaatgatcgctggttatatgcagaattcacttgatgctgaagccatggacatgttctggcggatgtgtcgagttggatggcagccagatgtctttgcttgcacaagtaccttgaattcgtgtggctcattggaggctatatggcaaggaaggcagatacatgcacatgccataaaggctaacctggagactgatgagtatgtcaagaatgctctcattgacatgtatgctaagtgcgatcatttaactgctgcaagagcagtatttgatgccttggcgcatgatgatgtgatttcttacaag

SEQ ID NO: 38490 - protein, 394 aa, Panicum virgatum
  misc_feature: Ceres CLONE 1994167
  misc_feature (291)..(325): Pfam Name: PPR Pfam Description: PPR repeat
  misc_feature (190)..(224): Pfam Name: PPR Pfam Description: PPR repeat
MNPVGPLSRAPSSVAYSCQARSLTQTLLSSLAGDRLRRLLPASHARAVVSEGLGNLFLANLLLRGYSKLGLLLDARRLFDGMLHRNLVSWSSAISMYAQHGGDDQALFLFAAFRKSSDEVPNEFLLASVLRACTQSRAVPFGEQVHGTALKLGLDVNLYVGTALINLYAKVAFMDAAMRVFHALPAKNPVTWTAVITGYSQICQGGRALDLFQKMGVQGVRPDRFVLASAVSACSALAFIQGGRQIHGYAYRSAAGMDASVINALMDLYCKCSRPLVARKLFDHTKNHNLVSWTTMIAGYMQNSLDAEAMDMFWRMCRVGWQPDVFACTSTLNSCGSLEAIWQGRQIHAHAIKANLETDEYVKNALIDMYAKCDHLTAARAVFDALAHDDVISY

SEQ ID NO: 38491 - DNA, 722 bp, Panicum virgatum
  misc_feature: Ceres CLONE 1994171
  misc_feature: Encodes the peptide sequence at SEQ ID NO. 38492
cacttgctgcgagcagccgcagtacacacacacgcacaccacctcgactcgacctctcccctgttctcggcgtgcctgccctgtttcgagctctgctccggctcgcctgcgcgccgtacagaccagactttaccagacaaccatggtggtgctcgccaacccgcctgtcgtcgaccagatcccgctcctgcggtccccggggcccagggacagcttcgccgccgtgccggtcgtcgacctgtccagccccggcgcggcgcgggcgatcgtcgacgcctgcgagcgcttcgggttcttcaaggtcgtcaaccacggcgtcgccggggacaccatggagcgggccgagaccgaggctgtcaagttcttcgcgcaggcccaggccgacaaggaccgcgcgggcccggcctacccgccgttcgggtacggcagcaagcgcatcggcctcaatggcgacatggggtggctcgagtacctcctcctcgccgtcgactccgcgtcgctctccgacgcctgcaccgtccccgccgccgccgcgttccgggccgcgttgaacgagtacatcgcggcggtgcggaaggtggcggtgcgcgtgctggaggcgatggcggagggcctgggcattgcgcccgcggacgcgctgagcgccatggtgacggagctggggagcgaccagctgttccgcgtgaaccactacccgccctgccccgcgctccagggcctgg

SEQ ID NO: 38492 - protein, 193 aa, Panicum virgatum
  misc_feature: Ceres CLONE 1994171
  misc_feature: SWISSPROT Homolog: EC 1.14.11.13 Gibberellin 2-beta-dioxygenase
  misc_feature: The sequence is a functional homolog of SEQ ID NO 4 in US patent 7154028
  misc_feature: The sequence is a functional homolog of SEQ ID NO 2 in US patent 7262340
MVVLANPPVVDQIPLLRSPGPRDSFAAVPVVDLSSPGAARAIVDACERFGFFKVVNHGVAGDTMERAETEAVKFFAQAQADKDRAGPAYPPFGYGSKRIGLNGDMGWLEYLLLAVDSASLSDACTVPAAAAFRAALNEYIAAVRKVAVRVLEAMAEGLGIAPADALSAMVTELGSDQLFRVNHYPPCPALQGL

SEQ ID NO: 38493 - DNA, 1493 bp, Panicum virgatum
  misc_feature: Ceres CLONE 1994195
  misc_feature: Encodes the peptide sequence at SEQ ID NO. 38494
aagcggcaagcaagacgccaagcccggcgtcccccctccctccaccctcctcttcctcgtcctcggccaccaccaccaggccagccaccccaaatcccccgcccgcgccgccaatcaacccagccccgcccaccacacgcgcaacccccgcgccctatgccgccgcggcagctgcgcccatgagggacggcgacgacgacttcggccccgcctcctccgcagcccgcgcgaagaaggagcagccctcgccgtccccccgcgacagggcggcgcgcccgcgcgccgacggcgggatgcgcatcgtcgtgccgctgcagggggtcgtgcagggccggggcggcctggtgctcggctccctcatcccctgcgcgctcttctacttcctccagctctacatcaagcgcaaccgccccccggcgcccgcgcccggatccccgcctccgggctccgacgccgccgccgccgcggggaacgccaactccgcctcctcctcgatccaccgctccctctcgcggggcctcctcaccccgcgcgccgcgctcccgtcgctctccgcccgcggcgccgtcgtgcgggccggggacgaggactcgctctactacgcggggctccgacgatgcgccgacgacccgtaccaccgggcgtgcaaccccgacggcctcatcaacctcggcctcgccgagaaccacctgtcgctggatttggtggggcgctggatggaggagcacgcgggggcggcgatgctggacgggattgcgggagtcggggaggacgccagggacctcaccatccgggggctcgccacctaccagccgtacgacgggatacttgccttgaagatggctcttgctggattcatgaggcaaatcatgcatgaatcagtatcctttgatccatctcaaatggtgattacatctggtgcaactcctgccatggaaatactgagtttctgtattgctgatccaggaaatgcatttcttgtcccatcaccttactaccccggttgggatagggacataaaatggcgaactggcgttgagttgatacctgttccatgccgtagcactgataactttaacattagtatcactgctctcgaaatagcttacaaacaggcaaagaagcgaggagtaagggttcgtggggttctcatatctaacccttccaacccaacaggaggcattgtgccaagggaaacactgcatgatcttctagagtttgctgcagagaagaacatacacttcatttctgatgaaatatttgctggttcaacatatggaagtgacaaatttgtcagtgtggcagaagttgtggatgagctagaagacttcgataaaggcagggttcacatcatatatggactctcaaaagacctatctcttgctgggtttcgagttggagtgatatattcctacaatgaaaacattgtggcagctgctgctaaaattgctcgattctcatcagtgtcaactccaacacaacgcctgcttgtt

SEQ ID NO: 38494 - protein, 399 aa, Panicum virgatum
  misc_feature: Ceres CLONE 1994195
  misc_feature (123)..(399): Pfam Name: Aminotran_1_2 Pfam Description: Aminotransferase class I and II
  misc_feature: SWISSPROT Homolog: EC 4.4.1.14 1-aminocyclopropane-1-carboxylate synthase
MRIVVPLQGVVQGRGGLVLGSLIPCALFYFLQLYIKRNRPPAPAPGSPPPGSDAAAAAGNANSASSSIHRSLSRGLLTPRAALPSLSARGAVVRAGDEDSLYYAGLRRCADDPYHRACNPDGLINLGLAENHLSLDLVGRWMEEHAGAAMLDGIAGVGEDARDLTIRGLATYQPYDGILALKMALAGFMRQIMHESVSFDPSQMVITSGATPAMEILSFCIADPGNAFLVPSPYYPGWDRDIKWRTGVELIPVPCRSTDNFNISITALEIAYKQAKKRGVRVRGVLISNPSNPTGGIVPRETLHDLLEFAAEKNIHFISDEIFAGSTYGSDKFVSVAEVVDELEDFDKGRVHIIYGLSKDLSLAGFRVGVIYSYNENIVAAAAKIARFSSVSTPTQRLL

SEQ ID NO: 38495 - DNA, 251 bp, Panicum virgatum
  misc_feature: Ceres CLONE 1994209
  misc_feature: Encodes the peptide sequence at SEQ ID NO. 38496
ctgcgaggtatgcacgacctacgagggagtccttgccgaggccggccccgctggggctggtgcccgctacaggcccggagcaggtggaggccgtctcgatgggctccgcctcgcagacccacaaggatcagcaggagaaggaggcggccacagcctgctgcggggtcaaagacccctaccctcaggacaggaccactgatgagttcgcattatctccctgggcctactccgtcgcgagcggttacaccctc

SEQ ID NO: 38496 - protein, 82 aa, Panicum virgatum
  misc_feature: Ceres CLONE 1994209
  misc_feature: SWISSPROT Homolog: EC 1.1.1.40 Malate dehydrogenase (oxaloacetate-decarboxylating) (NADP(+))
ARYARPTRESLPRPAPLGLVPATGPEQVEAVSMGSASQTHKDQQEKEAATACCGVKDPYPQDRTTDEFALSPWAYSVASGYT

SEQ ID NO: 38497 - DNA, 1383 bp, Panicum virgatum
  misc_feature: Ceres CLONE 1994224
  misc_feature: Encodes the peptide sequence at SEQ ID NO. 38498
aacggaagcggcgggcgcgagaacgaaaaggttagagagagggagtgagaggaggtggaggagagagacagagaggcttacaaaacccctcccattaattccaccgtgattccatctcctttgtcctcctcctcggctcctccccctcttctcgctcgcagcagccgtcccgtccttcccgatcccaccgcttctttttaagctcggccctctcctctctctctctctctctctctctctctctctctgcttgtataaatcactctctttgtcgtgccctccctcgtcgtcgctgctagtagccaagtgcggaaggtgtttgcgggcacggaaacctcgctctgccgcttggatcacggctgaagcgaaggcgcggggcggggatgagggcgggcgggatgctgtgccggtcgcaggcggcgacggcggtgtgcgtgccgggggacgcgcggtccatggtggtggcccgtcgcgccgccggggacggcgccgcccgcgccctgcacgacgtcaggtacgcgcgcctcggcggcagcaccgcggccgagggcggcggccggcgctccgcgtcgtcgcgccggctcgcggcgcccaccagggacaggcagcakgccgccgcggcggcccctccgccgccgcccgccgtcgtcgtctccggtggcgccgcgtcgtgcaagccgcgcgtggagatggcgaggcggcgccccgccgcccgggcgcccgtggccgtgacgctgcccatggtgaccaagagccccagcaaggaggcccccgccaaggacctcgcggcggcggccaagcgcgccgccgccgccgtggccgcgcccggcgaccaggtgctccaggtggtggtgatgaaagtggccatccactgccagggctgcgccggcaaggtcaggaagcacatctccaaaatggaaggggtgacgtcgttcagcatcgacctggagagcaagaaagtgacggtgatgggccacgtgtccccggccggcgtcctcgagagcatctccaaggtcaagaaggccgagctcctcgcctgacctccgatgaatcaaatcctccggctggctacatgcgtcgaccaaccaagaagaagaacaacaagaggagagagctgggggttctggctggggacaaatagaaaagtaaaggacagatcagacagtggtatgtgcatgcgtgtcatggtgtagcgatcgggtgcggtgcaggcatgcatgcgcgcgcagtggtggtggtggtgaactgatgagaaaccgtgtgtcgtcgtcgtcgtctcagcacctgctgggtgtagctagctatagggtccggtcggtccgagtgtgcatgctgcttgctttgtttattacagcgggtttacatatactcctctccctgctc

SEQ ID NO: 38498 - protein, 218 aa, Panicum virgatum
  misc_feature: Ceres CLONE 1994224
  misc_feature (156)..(216): Pfam Name: HMA Pfam Description: Heavy-metal-associated domain
  misc_feature (76)..(76): Xaa is any aa, unknown, or other
MRAGGMLCRSQAATAVCVPGDARSMVVARRAAGDGAARALHDVRYARLGGSTAAEGGGRRSASSRRLAAPTRDRQXAAAAAPPPPPAVVVSGGAASCKPRVEMARRRPAARAPVAVTLPMVTKSPSKEAPAKDLAAAAKRAAAAVAAPGDQVLQVVVMKVAIHCQGCAGKVRKHISKMEGVTSFSIDLESKKVTVMGHVSPAGVLESISKVKKAELLA

SEQ ID NO: 38499 - DNA, 681 bp, Panicum virgatum
  misc_feature: Ceres CLONE 1994227
  misc_feature: Encodes the peptide sequence at SEQ ID NO. 38500
agaccagtcgcagcagcagcggtggtagctcaccgctggggaccggcacagcgctccgcccgtcggaaggaaggagtagcccgctgtaccagctgccttcctactcgcttcccttgccgtcctcctcgcctacttcgcccccccgccctcttcgccgccgccccccctcatccggcgtcgtcttccaccgtcctccgccgggacacgcaaagatcttgtttcttcgatagaatatgtcgtgctttggatgctgtggtgatgaagatgcacaaggagtaccagactccaggaatccgtacccaggacaccatccagcaaggaatgatgcataccgtcctgctgatcaacctcccaagggtcctctgcctgtcaaaatgcaacccattgcagtccctgccattcctgtggatgagattagggaggtgactaagggttttggtgatgaagctctgattggtgagggctcctttggaagagtatatcttggtgttctaagaaatggtaggagtgcggcggtcaaaaagttggattctaataagcagcccgaccaagaattcttggcgcaggtgtctatggtgtcaaggttgaagcacgaaaatgttgttgagttgcttggttattgcgctgatgggaccctacgtgtccttgcttacgagtttgctactatgggctctcttcatg

SEQ ID NO: 38500 - protein, 149 aa, Panicum virgatum
  misc_feature: Ceres CLONE 1994227
  misc_feature: SWISSPROT Homolog: EC 2.7.11.1 Non-specific serine/threonine protein kinase
MSCFGCCGDEDAQGVPDSRNPYPGHHPARNDAYRPADQPPKGPLPVKMQPIAVPAIPVDEIREVTKGFGDEALIGEGSFGRVYLGVLRNGRSAAVKKLDSNKQPDQEFLAQVSMVSRLKHENVVELLGYCADGTLRVLAYEFATMGSLH

SEQ ID NO: 38501 - DNA, 681 bp, Panicum virgatum
  misc_feature: Ceres CLONE 1994247
  misc_feature: Encodes the peptide sequence at SEQ ID NO. 38502
aatccgaaacattcctccactcccacccgaggtggagggaagggagagagagagagagagggagagggtgagataagagaacagtcctccgataaggaggaattcgtgagggggagggcgagatagagtgagtcctccgcggatgaagttcgggaaggatttccggaaccacctggaggagacgctgccggcgtggagggacaagtacctggcctacaaggccctcaagaagctcatcaagaacctgcggccccccgagcccgccgtccctcctcttcctcccccgcccgccgccgtgggacccggggatggggccggccaggggaacgtcgcgctcgggaactggtttgccagcatcctcgacatggagctcctcaagctcaacgagttctacatggagagggaggagtggtacgtcatccgcctccaggtgcttaaggagaggattgagcgcgtcaaagctaagaagaatgatgcttttacatccaggagtgaatttacagaagagatgctagagatacgcaaggactttgtgatcatacacggcgaaatgattcttctgcaaacctacagttccctaaattttgctggactagtgaagatattgaagaagtatgacaagagaacaggcggtttgctcagcctgcctttcactcagcgtgctcgtcatcagcctttttt

SEQ ID NO: 38502 - protein, 179 aa, Panicum virgatum
  misc_feature: Ceres CLONE 1994247
  misc_feature (1)..(175): Pfam Name: SPX Pfam Description: SPX domain
MKFGKDFRNHLEETLPAWRDKYLAYKALKKLIKNLRPPEPAVPPLPPPPAAVGPGDGAGQGNVALGNWFASILDMELLKLNEFYMEREEWYVIRLQVLKERIERVKAKKNDAFTSRSEFTEEMLEIRKDFVIIHGEMILLQTYSSLNFAGLVKILKKYDKRTGGLLSLPFTQRARHQPF

SEQ ID NO: 38503 - DNA, 679 bp, Panicum virgatum
  misc_feature: Ceres CLONE 1994261
  misc_feature: Encodes the peptide sequence at SEQ ID NO. 38504
agctacagcagcggcagcccaccgatcccctgactaagagtctaagaccggcgagagcatcaagacgccggcgatctcctcctctgtcgccttccccgacgccggcgaccctgtccgggatcaccgcccgactccacctcctaactcagaagcagccatgaattacatcatcggcgccttcaagccgccttgcgacatcttcgtcaccttctccgatgagaggacccggaagcaggtggcaattaagaaggacaacgggaagacggccacggtgccagccttccagagcctggagaccatcgctggagaggtgtccattgctccggtccctggtaaaaggctcgagcacaccagtattaagatcgagctgctgggtcagatagagctatattttgacaaaggcaatttctacgacttcacttcattagtgcgcgagttagaggttcctggtgagatctacgaaagaaagacttacccgtttgagtttgctactgttgaaatgccatatgagacatataatggaacaaatgtcagattaagatacatattgaaagtgacaattggcagaaattatgtcggcaatattgtggaaacccgggatttctgtgtaaggaactactctcctgttcccacaattaacaatagcatcaagatggaagttggaattgaagattgcttg

SEQ ID NO: 38504 - protein, 173 aa, Panicum virgatum
  misc_feature: Ceres CLONE 1994261
  misc_feature (8)..(173): Pfam Name: Vps26 Pfam Description: Vacuolar protein sorting-associated protein 26
MNYIIGAFKPPCDIFVTFSDERTRKQVAIKKDNGKTATVPAFQSLETIAGEVSIAPVPGKRLEHTSIKIELLGQIELYFDKGNFYDFTSLVRELEVPGEIYERKTYPFEFATVEMPYETYNGTNVRLRYILKVTIGRNYVGNIVETRDFCVRNYSPVPTINNSIKMEVGIEDC

SEQ ID NO: 38505 - DNA, 624 bp, Panicum virgatum
  misc_feature: Ceres CLONE 1994264
  misc_feature: Encodes the peptide sequence at SEQ ID NO. 38506
gcaacgacctctcctccgtcctcactcccactctcgacctctctacaatggcaagaaggtgcaggagcagcggcggcggcaacgtgccgggcttggccgcggcggcggcggcttcctggctcctggtggcggtggcgctcgccggcgtccccgacgcccagctgcaggtggggttctactccaggtcctgcccgggcgccgagtccaccgtcgcggacgtcgtccggcatgccagctccaccaaccccaccatcctgccggagctcctccgcctccagttccacgactgcttcgtccggggctgccacggctccgtcctcatcaaaggcagcggcggcggcagcgccgaggtggacaacagcaaacaccagcgcctccgcgggctctagatcatcgagggcaccaagacgcagctcgaggcccagtgccccggcgtcgtctcctgcgccgacatcgtcgccctcgccgcccgctgacgccgtcgcattcaccgactggccgtcgttcgaggtgccgaccgtgctgcgccactggaaggtgtcgaacctgccggacacgcacgcgctgccggacgtgcgcgacggcatcagcgctctcccctccaagatccacgccatcgggctg

SEQ ID NO: 38506 - protein, 113 aa, Panicum virgatum
  misc_feature: Ceres CLONE 1994264
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MARRCRSSGGGNVPGLAAAAAASWLLVAVALAGVPDAQLQVGFYSRSCPGAESTVADVVRHASSTNPTILPELLRLQFHDCFVRGCHGSVLIKGSGGGSAEVDNSKHQRLRGL

SEQ ID NO: 38507 - DNA, 1424 bp, Panicum virgatum
  misc_feature: Ceres CLONE 1994273
  misc_feature: Encodes the peptide sequence at SEQ ID NO. 38508
ctatcccccaaaccttaggatcaccggcgggccaccggagctgagccccacacatccacgcggtttggtggtgtggtgactggtgagggagagcacaagaacacaacaagaaggcgagagacagagggaggaaggggacgaatagggagctgaaaaaaggcggaacagacccggcttttgaccccgccaagcccaccttcgccggcaatggcggccgcctccgaggaggccatcaagcagttctcctcgcttatggagcagctggaggagccgctcaagaccacattccagaatgtgcatcaaggaaatctgagggggactttggtgcgttttctgaaggccagagaatggagtgtacctaaagctcataaaatgcttatagattgcttaaattggagaatacaaaatggtattgacagcgtgttggctaaaccctttgtgccatctgatttatatagagctatccgggatactctacttgttggattgacagggtactccaagcagggacaacctgtttatgcatttggtgttggtctcagtaccttcgataaggcttcggtgaactactatgttcagtcacacatacagatgaatgaatatcgagaccgtgttgtcctgccgactgcatcgaagaagtttgggagacagattaatacctgcttgaaggttatggatatgactggcctcaagctgtctgcattgagccaaataaagatgttgaccatgattacaactgttgatgaccttaattatcctgagaaaacggagacttattacattgtgaatgcaccatatgttttttcggcatgttggaaggttgtgaagccacttttacaagaaagaactaaaaagaagatccaagtcctgtatggctctgggagggatgagttattgaaggttatggattatgagtcacttccacacttttgcaagagggaaggatcaggttcatccagtgactctcttgatggagttgactgctattcctatgaccatcctttccaccagcagctgtacaactacatgaagcagcaatctctgaaactggactctgttggccccataaaacaaggctccctccatgtggatgtgccctcgcctggccttgaggaagtcaagatcgccgagaccatcgaatcagagctccacaagttgaggggaggcaacggcctcactcactcattcaacagaatcaagatcgaaggtccatgagggcgcggtgattgagaagcgtgcgcccaagacaatggtctatggtccacggaggtgatcttgttatctgaaccccaggagcctatggtgggggtggtagtagtgcctcttgcttgcaatcactggctgcaggcttgagtaggacaagtagagaatgtagtagagaacgcgggattctaataaccggtatccgagattgttatcatcct

SEQ ID NO: 38508 - protein, 335 aa, Panicum virgatum
  misc_feature: Ceres CLONE 1994273
  misc_feature (91)..(275): Pfam Name: CRAL_TRIO Pfam Description: CRAL/TRIO domain
  misc_feature (10)..(72): Pfam Name: CRAL_TRIO_N Pfam Description: CRAL/TRIO, N-terminus
MAAASEEAIKQFSSLMEQLEEPLKTTFQNVHQGNLRGTLVRFLKAREWSVPKAHKMLIDCLNWRIQNGIDSVLAKPFVPSDLYRAIRDTLLVGLTGYSKQGQPVYAFGVGLSTFDKASVNYYVQSHIQMNEYRDRVVLPTASKKFGRQINTCLKVMDMTGLKLSALSQIKMLTMITTVDDLNYPEKTETYYIVNAPYVFSACWKVVKPLLQERTKKKIQVLYGSGRDELLKVMDYESLPHFCKREGSGSSSDSLDGVDCYSYDHPFHQQLYNYMKQQSLKLDSVGPIKQGSLHVDVPSPGLEEVKIAETIESELHKLRGGNGLTHSFNRIKIEGP

SEQ ID NO: 38509 - DNA, 705 bp, Panicum virgatum
  misc_feature: Ceres CLONE 1994292
  misc_feature: Encodes the peptide sequence at SEQ ID NO. 38510
aacttttttcgaccacaaagcacttcaaatatggctaggtcccacgcagctcttctgctcgtcttggtcggcgccatagcggcgtcgggttatcagtatcaacgggactcggtgggctcgacgttcttcctccagcacgatctgtaccccgggtccaagatgacgctccatttcagccccacagcgccgggggtgcccgcgctcacgcgcgcccgcgccgacgccatccccttcgcctccgccaagatccgggagatcctcgccctcttctccatcccggcgggctcccccgcagccgacgcggtgcgcttcaccctggccgagtgcgaggccccaccagtgccgggcgtggcggcgcagcggtgcgccacctccccggaggccatggtcgacttcgcggcctcctggctcggcacccgggccatccacgcgggcaccaccaggctcggcagcagcagggacggaggggcggcggcgccgccgaggcaggcgtacgtgctggagtccgtccggccgctgccggtggtcggccgggacatggtggcctgccactccctgccctacccgtacgcggtgttcgggtgccacaccaccaccgccgccgtgttcagggtggcgcttgccggggccgacgggagcagggctgaggctctggcggcgtgccacaaggacgcgacgccgggcatcccctggccgacgtacaaa

SEQ ID NO: 38510 - protein, 224 aa, Panicum virgatum
  misc_feature: Ceres CLONE 1994292
  misc_feature (30)..(224): Pfam Name: BURP Pfam Description: BURP domain
MARSHAALLLVLVGAIAASGYQYQRDSVGSTFFLQHDLYPGSKMTLHFSPTAPGVPALTRARADAIPFASAKIREILALFSIPAGSPAADAVRFTLAECEAPPVPGVAAQRCATSPEAMVDFAASWLGTRAIHAGTTRLGSSRDGGAAAPPRQAYVLESVRPLPVVGRDMVACHSLPYPYAVFGCHTTTAAVFRVALAGADGSRAEALAACHKDATPGIPWPTY

SEQ ID NO: 38511 - DNA, 732 bp, Panicum virgatum
  misc_feature: Ceres CLONE 1994294
  misc_feature: Encodes the peptide sequence at SEQ ID NO. 38512
attccaagcagcccagtttcaaacccgcatcgccttctccgccgccgccgctcgatctagaccggaggttctcccccaagcccgttcggcgatggcgacgatccagtccgtgaaggcccgccagatcttcgacagccgcggcaaccccaccgttgaggttgatgtgtgctgctcagatggaaccttcgcacgtgctgctgttcccagtggtgcatcaactggtgtttatgaagctctggagttgagggatggtggatctgactacctgggcaagggagtttccaaggctgttaacaatgtgaactctatcattggacctgctcttgttggcaaggaccctacagctcagaccgacattgacaactttatggtccagcagcttgatggcactaagaatgagtggggatggtgcaagcaaaagcttggtgctaatgccatcttggctgtgtcgctagctgtttgcaaagctggagctagcatcaagaaaatccctctataccagcacattgccaatcttgctggcaacaagcaactagttttgcctgtcccagcatttaacgttatcaatggtggttcccacgctggaaacaagcttgctatgcaggagttcatgatcttgcctactggagctgcctctttcaaggaggctatgaagatgggtgttgaagtttaccaccacctgaagtctgttatcaagaagaagtatgggcaggatgccactaatggtggtga

SEQ ID NO: 38512 - protein, 213 aa, Panicum virgatum
  misc_feature: Ceres CLONE 1994294
  misc_feature (3)..(139): Pfam Name: Enolase_N Pfam Description: Enolase, N-terminal domain
  misc_feature: SWISSPROT Homolog: EC 4.2.1.11 Phosphopyruvate hydratase
MATIQSVKARQIFDSRGNPTVEVDVCCSDGTFARAAVPSGASTGVYEALELRDGGSDYLGKGVSKAVNNVNSIIGPALVGKDPTAQTDIDNFMVQQLDGTKNEWGWCKQKLGANAILAVSLAVCKAGASIKKIPLYQHIANLAGNKQLVLPVPAFNVINGGSHAGNKLAMQEFMILPTGAASFKEAMKMGVEVYHHLKSVIKKKYGQDATNGG

SEQ ID NO: 38513 - DNA, 386 bp, Panicum virgatum
  misc_feature: Ceres CLONE 1994300
  misc_feature: Encodes the peptide sequence at SEQ ID NO. 38514
ccggtgctccgccccccccccgacctacaccctcacgctcctcccccggcaccgcatccggccggatgcgctcgccgccgcctacgaccttctctccctcgccgtagcacctcccggcgtcaagctcccgttccaccacaagctgatgggccgctcggccctccatgcctcccgcctacctctcccccaccaaacgctcgcggcaacaagggattccgatgccgtccccctcggagccatacgccggtataactgggacaacaacgcgcagcacctctagcctgatacacgcttgctccatctccgtgctgcgctccctgtgcttgccactctgcgtccagccgcggcactgccgcatctagtcaatgcatctactccgaagaaag

SEQ ID NO: 38514 - protein, 92 aa, Panicum virgatum
  misc_feature: Ceres CLONE 1994300
  misc_feature: SWISSPROT Homolog: EC 1.1.1.85 3-isopropylmalate dehydrogenase
RCSAPPPTYTLTLLPRHRIRPDALAAAYDLLSLAVAPPGVKLPFHHKLMGRSALHASRLPLPHQTLAATRDSDAVPLGAIRRYNWDNNAQHL

SEQ ID NO: 38515 - DNA, 704 bp, Panicum virgatum
  misc_feature: Ceres CLONE 1994304
  misc_feature: Encodes the peptide sequence at SEQ ID NO. 38516
gaggcagccagcgaattgtgctcggggggaggccgggggatggcggcgaggcggggcagggggtgggcgcgcggcgcggcggcgttcgcggccgtggcgctggcggtgggcgcgggccggcggtacggctgggacggggcctccgcggtggcggcgttccgcgaggcccgcggcgcgctggggccctgggcggcgccggcctacgtggccgcgcacgcgctcacgctcgcgctctgcccgccctacgccatcttcttcgagggcggcgccgcgctcatcttcggcttcctgccgggcgtcgcctgcgtcttctccgccaaggtcctcggggcatccatctccttctgggtcggcagggcagttttcagatatttcacttcagcaatggaatggctacagaggaacaagtacttccatgttgtggttaaaggagttgagcgggatggctggaaattcgtattgcttgcaagattctctcctttgccttcctacatcatcaactatgctctatcagccacggatgttggatttttcagagattttctccttcccacaattattggctgcttaccaatgatactacagaatgtttcaatcgtaagccttgctggtgcagcagtggcctccactacaggatctaagaagtcccatatctactcttacctgtttccagcaattggcattgtgtccagcattctgatttc

SEQ ID NO: 38516 - protein, 221 aa, Panicum virgatum
  misc_feature: Ceres CLONE 1994304
  misc_feature (66)..(189): Pfam Name: SNARE_assoc Pfam Description: SNARE associated Golgi protein
MAARRGRGWARGAAAFAAVALAVGAGRRYGWDGASAVAAFREARGALGPWAAPAYVAAHALTLALCPPYAIFFEGGAALIFGFLPGVACVFSAKVLGASISFWVGRAVFRYFTSAMEWLQRNKYFHVVVKGVERDGWKFVLLARFSPLPSYIINYALSATDVGFFRDFLLPTIIGCLPMILQNVSIVSLAGAAVASTTGSKKSHIYSYLFPAIGIVSSILI

SEQ ID NO: 38517 - DNA, 681 bp, Panicum virgatum
  misc_feature: Ceres CLONE 1994311
  misc_feature: Encodes the peptide sequence at SEQ ID NO. 38518
attttcctccacctcccgagccctccccacttcaccccggcggcggcgcagcagcagcagcagcagctgaagatggtgaagttcctgaagcccggcaaggccgtgatcctccttcagggccggttcgccggccggaaggcggtgatcgtgcgcgtgttcgaggagggcacccgcgaccgcccctacgggcactgcctcgtcgccggcctcgccaaataccccaagaaggtgatccgcaaggactccgccaagaagacggccaagaagtcccgtgtcaagtgcttcatcaagctcgtaaacttcacccacctcatgcccacccgctacacccttgacgttgacttcaaggacgtcgcctcgggcgggcccgacgcgctctccacccgggacaagaaggtcgccgcctgcaaggccgcgaaggcccgcctcgaggagaggttcaagacaggcaagaacaggtggttctttaccaagctccgcttctagatgccgggcgtccagcatagtacctgctttagttgtcaatttcatgtatcgcaaacccttatctatgttttggtattgccatgaagacttcgtgcttactgttatggatcttggagaggttgacatgtcgatgatgttttaaatgatgtcaatcatagaccttgtccaaaaccaccaccaccaccaccaccaccc

SEQ ID NO: 38518 - protein, 137 aa, Panicum virgatum; identical to SEQ ID NO: 10158
  misc_feature: Ceres CLONE 1994311
  misc_feature (52)..(137): Pfam Name: Ribosomal_L27e Pfam Description: Ribosomal L27e protein family
  misc_feature (7)..(40): Pfam Name: KOW Pfam Description: KOW motif

SEQ ID NO: 38519 - DNA, 732 bp, Panicum virgatum
  misc_feature: Ceres CLONE 1994324
  misc_feature: Encodes the peptide sequence at SEQ ID NO. 38520
acaaagcaccagaccatctcagctctgctcagtctctagtagctagctaggctccggtcgctgcagcaaaaccatggaggggaaggaggaggatgtccgccttggcgccaacaagtactctgagcggcagcccatcggcacggcggcgcagggcaccgatgacaaggactacaaggagccccctccggcgccgctcttcgagcccggcgagctcaagtcctggtccttctaccgcgccggcatcgccgagttcgtcgccaccttcctcttcctctacatcagcatcctcaccgtcatgggcgtctccaagtcctcctccaagtgcgccaccgtcggcatccagggcatcgcctggtcctttggcggcatgattttcgccctcgtctactgcaccgccggcatctccggtggacacatcaacccggcggtgaccttcgggctgttcctggcgaggaagctgtcgctgaccagggccgtcttctacatggtgatgcagtgcctgggcgccatctgcggcgccggagtcgtgaagggattccagcagggactgtacatgggcaacggcggcggcgccaacgtcgtcgcggccgggtacaccaagggcgacggcctcggcgctgagatcgtcggcaccttcgtcctcgtctacaccgtcttctccgccaccgacgccaagaggaacgccagggactcccacgtcccgatccttgctcccctgcccattggattcgc

SEQ ID NO: 38520 - protein, 219 aa, Panicum virgatum
  misc_feature: Ceres CLONE 1994324
  misc_feature (46)..(219): Pfam Name: MIP Pfam Description: Major intrinsic protein
  misc_feature: Useful for making plants with modulated water use efficiency
  misc_feature: Useful for making plants with modulated drought sensitivity
  misc_feature: Useful for making plants with modulated cold sensitivity
MEGKEEDVRLGANKYSERQPIGTAAQGTDDKDYKEPPPAPLFEPGELKSWSFYRAGIAEFVATFLFLYISILTVMGVSKSSSKCATVGIQGIAWSFGGMIFALVYCTAGISGGHINPAVTFGLFLARKLSLTRAVFYMVMQCLGAICGAGVVKGFQQGLYMGNGGGANVVAAGYTKGDGLGAEIVGTFVLVYTVFSATDAKRNARDSHVPILAPLPIGF

SEQ ID NO: 38521 - DNA, 660 bp, Panicum virgatum
  misc_feature: Ceres CLONE 1994329
  misc_feature: Encodes the peptide sequence at SEQ ID NO. 38522
gaccaagctcccttccagaagccgagcaaggacaggcgtgccagcagccaccgacaggcgacagcagccatggcgcgccggtctctagctccgctcgcgccgccgccgtcgctggccctcgccgccgccgtcgttgcgctcgcgttctgcttccatcccgcctcggcgcagtcggcctggctcgaggagttccgcacggacggcgaggtccgctccgacttcgacgcctcgggcaagcaggtggcgtcgctgatcctcgacgagaactccggcgccggattcaactccacggagaagtacctcttcggcgagttcagcgtcgagatgaagctggtccccggcaactccgctggcaccgtcacctccttctacctgacgtccggcgagggcgacgaccacgacgagatcgacatggagttcatgggcaactcgagcggcgcaccgacggtgctcaacaccaacgtgtgggccagcggcgacggcaagaaggagcaccagttctacctctggttcgacccctccgccgacttccacaagtacaccatcatctggaacgccaagaacatcatcttccgcgtcgacgacgtcaccgtgcgcgccttccgccgctacgccgacctcccctacccggacgccaggcccatggcggtgcacgccacg

SEQ ID NO: 38522 - protein, 196 aa, Panicum virgatum
  misc_feature: Ceres CLONE 1994329
  misc_feature (37)..(196): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MARRSLAPLAPPPSLALAAAVVALAFCFHPASAQSAWLEEFRTDGEVRSDFDASGKQVASLILDENSGAGFNSTEKYLFGEFSVEMKLVPGNSAGTVTSFYLTSGEGDDHDEIDMEFMGNSSGAPTVLNTNVWASGDGKKEHQFYLWFDPSADFHKYTIIWNAKNIIFRVDDVTVRAFRRYADLPYPDARPMAVHA

SEQ ID NO: 38523 - DNA, 630 bp, Panicum virgatum
  misc_feature: Ceres CLONE 1994335
  misc_feature: Encodes the peptide sequence at SEQ ID NO. 38524
aggacacgatgggcaccgtgaccgcggggatttccgtatccgccgacgcggcggtggtggtgccccgcccagccggccgccaacgccaccgcggccccgccgcctttcgctgctcggcctccgcggccagcgagcggcaggcgctcttcagccgcatcacccccgtctacgaccatctgaaccacctgctcagcctggggcaccaccagacgtggaagcgcatctgcgtctcatggtcgagggctaagatggaggatcggattcttgatctctgctgcgggagcggggatttggcgttcctgctgtctcataaggccggcttagatggacaggtgatggccgtcgatttctcgaggcagcaactgcatactgctgctgaccgtcaggatcaactctggaagctgtgctacaacaacatcaaatggatagagggtgatgcacttgatttaccggacacacactgctactttgatgctgtaacggatggctaccgattgcataatgtggttgacaagcccagagcaatgcaagaaatatatacggtccttaaaccaggatctctaccatctattcttgattttaacgagagctcgtcacttttcacggcatcattacagatttgggaaatca

SEQ ID NO: 38524 - protein, 127 aa, Panicum virgatum
  misc_feature: Ceres CLONE 1994335
  misc_feature (6)..(108): Pfam Name: Methyltransf_11 Pfam Description: Methyltransferase domain
  misc_feature: SWISSPROT Homolog: EC 2.1.1.137 Arsenite methyltransferase
MEDRILDLCCGSGDLAFLLSHKAGLDGQVMAVDFSRQQLHTAADRQDQLWKLCYNNIKWIEGDALDLPDTHCYFDAVTDGYRLHNVVDKPRAMQEIYTVLKPGSLPSILDFNESSSLFTASLQIWEI

SEQ ID NO: 38525 - DNA, 1294 bp, Panicum virgatum
  misc_feature: Ceres CLONE 1994341
  misc_feature: Encodes the peptide sequence at SEQ ID NO. 38526
tcggcgtggtggtgggcatagtcgcgctcctcttcgtgctcgtcctcgtcgtcaccatcgagggcgtctgcaagcgcccctccgcctcctgattctgattcgcccgctcccgcccgcaaaaccccccgcgcgcaacaatgcgccgccgcagcctcgccgccctcctgctgctcctggcggccgctgtggccgtgcccgcccccgccgccggccactcggactcctcctgccccttccacgaccacgccggccacggccacggcgagccgccgcacgaccacggccacgggcacgggcacagctgcggcggcggcggcggggaccacgagcaccaccaccaccaccatgcccacggccgcgacgagatccagcggcggctgcttcccgaggagatggccgaggaggcggatctcgagctcgagtccttcggttacgacgagaacgaccacggccaccaccgcggccacggcgacatggaggcgtcgcccatgggtgtgtggctgagcgcgatggggtgctcgctgctggtcagcatggcgtcgctcgtctgcctcatcctcctcccggtcatcttctttcagggaaaaccatcgaaggccatggtggatgcacttgcagtgttttgggcaggagcaatgcttggagattcatttcttcatcaactgccacatgcttttggtggagggcattctcactcacatgatcatgagggtcacgaccatgctcatgagcatgcacacgcacactcactggaagatctttctgtggggttatctatactatttggcattgttctcttttttattgttgagaagattgtaaggtatgttgaagacaattctcaaaatggggcacacagcatgggtcatgggcaccaccatcaccatcataaacggcatgattctagtgataaggacaaattgaatcatcaaaagagtgatgacgatggtaaagagatcaatcaaactgatgaggaacctttggttgatggcacgactgcaaaagtaactactatacggaagagaagctcttctgctagttccaaagccactgatggagagcacgccaattctgaaaatgaccctgcccctgataaagcattatcaagtgatggttcttccatttcaaactctaatttggtgtttggctacctcaaccttttctcagatggtgttcataacttcactgatgggatggctcttgggagtgcctttttgctacatggttccgttggtggctggtccaggactttattccttcttgcacatgaacttccccaagaggttggagattt

SEQ ID NO: 38526 - protein, 300 aa, Panicum virgatum
  misc_feature: Ceres CLONE 1994341
  misc_feature (33)..(300): Pfam Name: Zip Pfam Description: ZIP Zinc transporter
MAEEADLELESFGYDENDHGHHRGHGDMEASPMGVWLSAMGCSLLVSMASLVCLILLPVIFFQGKPSKAMVDALAVFWAGAMLGDSFLHQLPHAFGGGHSHSHDHEGHDHAHEHAHAHSLEDLSVGLSILFGIVLFFIVEKIVRYVEDNSQNGAHSMGHGHHHHHHKRHDSSDKDKLNHQKSDDDGKEINQTDEEPLVDGTTAKVTTIRKRSSSASSKATDGEHANSENDPAPDKALSSDGSSISNSNLVFGYLNLFSDGVHNFTDGMALGSAFLLHGSVGGWSRTLFLLAHELPQEVGD

SEQ ID NO: 38527 - DNA, 491 bp, Panicum virgatum
  misc_feature: Ceres CLONE 1994341-R
  misc_feature (158)..(158): n is a, c, t, g, unknown, or other
gatcaggattcacggtgtctaaggcctttttttcaattttctctctcattggttgctcttgctggaacagcactagcattgtctttgggtaaagatccagggcattcttccctgatagagggattcactgccggtggtttcatttacatcgctgtcgncgggagtccttccgcagatgaacgaccagaaaacaaccctccaaagctcaattgttcagttgatttccttggcgatggggatgctggtcgctctaggcatttctctggtagaatgatctgaacctccagttcacccgttgcagctttaggtggcacaacagttactccaatccggtataattcttgaacagctccagcctggaagacgggagctctaagtggaaaacctgatagaaattttgacatctgattatagattcacctgcatggtcggtagttttcttgtttaggagaaacacaagagtcataataaatcacaacaggattacaatc

SEQ ID NO: 38528 - DNA, 1237 bp, Panicum virgatum
  misc_feature: Ceres CLONE 1994349
  misc_feature: Encodes the peptide sequence at SEQ ID NO. 38529
atcttttccccttcgctttttttcctttccttttccccccgcgcatgcacgggctctgattgacgccacggcatgggggacgccgccgccgccgccgccgcggcggcatccacgtccgctcccgccacgcccacctccatcctcatctgccgggaggacggcagcgaccttttccacgacgccgacgatggcggcgccagcgcggacctcttcgtcgcccgcgatgaccgcctcctggtcgtggaccaggacgacgagtatgttgcggtgctcctgtccaaggagagcgcttccgcagccgccggctgcggcgccgccatggcggaggaaatggaggagtggatgaaggccgagcgctccgggtgcgtccgctggataatccagacgacggcgatgttccggttgagcgggaagaccgcgtacgtcgcggtgacttacctcgatcgcttcttggcgcaacggcgagtcgatagggggaaggagtgggcattgcaactgctcgcggtggcgtgcctgtcgctggcgagcaaagtggaggagcaccgcgcgccgcggctgtcggagctccggctcgacgcgtgcgagttcgacagcgagtccatcctgcggatggagctcctcgtcctgggctcgctccagtggcagatgatcgccgccaccccgttcccctacatcagctgcttcgcggcgcggttccggcaggacgagcgccgggcgatcgtcctccgcgccgtcgagtgcgtcttcgccgcgatcaaagccatgagctcggtggagtaccagccatccaccatggccgttgcatccatcctcgtcgcgcgcggcaacgacgcgacacccgccgccaatctggacgagctcatggcgatcctgggcccatcatggccgcaattagacaccgggcatgtgtactcctgccacagcgcgatggctcaggaggacaagtcgtggatgcactcggcggaggtggcgtcctcgggcgtctctgtcgccgcgcacgtcgggagcccggacgcctccgtgggcaccaataatgcggctggcaccgccccgccggcaaccccggacaacaacaacaagaggagacggttgcgctcacctcagcgccagtaggagcgagcctctgctgcctcctgggcagtggagtccagctgcattttcggctcaccatttttctcttcgttgaatgaatgaattcaggctgctgctcgctggtgattgtttctccggggaggcc

SEQ ID NO: 38529 - protein, 346 aa, Panicum virgatum
  misc_feature: Ceres CLONE 1994349
  misc_feature (62)..(193): Pfam Name: Cyclin_N Pfam Description: Cyclin, N-terminal domain
MGDAAAAAAAAASTSAPATPTSILICREDGSDLFHDADDGGASADLFVARDDRLLVVDQDDEYVAVLLSKESASAAAGCGAAMAEEMEEWMKAERSGCVRWIIQTTAMFRLSGKTAYVAVTYLDRFLAQRRVDRGKEWALQLLAVACLSLASKVEEHRAPRLSELRLDACEFDSESILRMELLVLGSLQWQMIAATPFPYISCFAARFRQDERRAIVLRAVECVFAAIKAMSSVEYQPSTMAVASILVARGNDATPAANLDELMAILGPSWPQLDTGHVYSCHSAMAQEDKSWMHSAEVASSGVSVAAHVGSPDASVGTNNAAGTAPPATPDNNNKRRRLRSPQRQ

SEQ ID NO: 38530 - DNA, 686 bp, Panicum virgatum
  misc_feature: Ceres CLONE 1994374
  misc_feature: Encodes the peptide sequence at SEQ ID NO. 38531
gcttctgtctcctctctccacacgacttgctcgggccgccgcctacgccgtcgtcgcagcagtcaccgtgacctgcaaccagagaaagcatggatactcaggttaagcttgccgtcgtggtcaaggtgatgggccgcaccggttccaggggtcaggtgacccaggtcagagtgaagttcctggacgaccagaaccgtctcatcatgaggaacgtcaagggccctgtccgtgagggtgacatcctcaccttgctcgagtctgagagggaggccaggaggctgcgctgaagcagctggttgttgtgtcagttgttcgctgttcttgtcttaaacaagttgatgatggattgattaccccttgcctagtgtactgctttcgcatcaagttcttgaagaatgctactttgtcttttgcataggctatggagaatgagttaagagcaatggaaatgtaatttgtgcaaatgtcctgttgcaagttttggtctgttaccctgaatgaatttaagtgcaaaaataaaaaaaaaaaccagcctccgcctccgaatctcgcaagtagcgaaaaagctgtcaaggcgatggcggcggccggcggcgtttcctccgacgatgttccgatcctccagacggagaatctctccagcaacgtcaagtccatctactacagtcgaacattcttgtcgatca

SEQ ID NO: 38531 - protein, 65 aa, Panicum virgatum; identical to SEQ ID NO: 9766
  misc_feature: Ceres CLONE 1994374
  misc_feature (1)..(65): Pfam Name: Ribosomal_S28e Pfam Description: Ribosomal protein S28e

SEQ ID NO: 38532 - DNA, 1848 bp, Panicum virgatum
  misc_feature: Ceres CLONE 1994375
  misc_feature: Encodes the peptide sequence at SEQ ID NO. 38533
acccagctcccactcaccgccgcaccgagagtccggcgatccccaccgtctccggcggcagcggcatggagcgcccgaagaagaacggcgcggtggctggcctccccgacgaccccctcgtggagatcctctcgcgcgtccccgtcaaggatctccaccgatccaagtgcgtctccaaaggctggcgcgacctcatcgccgaccccctccaccgcaagaagctcccccaaaccctagaggggtttttccacgccggggatttcatcggtctgtctgggggctcgccgcctcccgtcaacccttcattcccctttctgaggaagctgcccggcattggcgagatctgtctcagggggtcctgcaatggcctcctcctcttcaggcacgctcccagtcccacgatcagctacattgtgtgcaaccccgcgacagagcaatgggcggcggtgcccagcgagcacactccggcggataagcaagatggagagagccgcacctatttgctcttcgacccggctgtctcctcccacttccacttggtcaccatctgtgcggaggaacggagcctggcaacattgcacacctactcctcaaaaacaggggtgtggaggcaccgccatactgattgggctgaagaagaaaagcagttaggacagtggagagggggggagtcctcagatcactgccacggtccatggtgctgccttttttaatggcatgctgcatgtgatgttgagtgattatcagattgctgtggtggatatggaagggaagatacaagggatcatcccgacgtcgtctatccggctggacatagcaggactcgagaggtggctggagctggtttgctttctagcccagccggtttcgtccagccaaacagggcacatagtggatccgcgccaccttccacttttcattggtcaatcccaagggcgcctgtattgcgtctctgaagaattgggggtgaatggtgttcgtgatctagtgtcattctgggttcttgaggactatgatacaaaaaaaatgggtacttaaggaccgtgtgtggcgtatgcttctattggggatcaggtcttccgaaggtagttgtgactatgatgtggatgcgcatatgggtctgttcgggatcaggccttatggagctagtcgtggctatgatgtggttgccattcatccagacagcaatttggttttcatttttctacacgggagtcgggagctgatatcttttggcctggatagcaatgaagtgcatgctcttggcacacttgaacaagaccctctatggtttactccttatgttcccggtttcttggatttcttatcagtgccggagcatgatgacaaactagggggtggggggcctcaatccaagttggaaggttgtcatcagagcagttgagcgcagcggccagtgattgctcagggtggagagcgcagaggctggcaaatagaaccatgcgccagctgctgagctcatgtggtcgttctagatgcacaagcttttatatttgcttatgaaatgggctatctgcttgtgcagttatagttttgtttgggggatgggtgctacggccccttttgcggccataactaccctcaccaccgcttcgtatccaattaatatttagcactgcaagtcagttgggctcccgcaagaaaaacactgcatgctgggcagctagtcaatagagtcgaggtatatatgtaaggttgctttaattgccagttagcccaacggatgcagttttcccaagttgtccaacttagatgttttgcattcaagtaatatgtttcaaatgtacctctagtgttcccagaattgcaatcatcttcgttgccgtt

SEQ ID NO: 38533 - protein, 215 aa, Panicum virgatum
  misc_feature: Ceres CLONE 1994375
  misc_feature (8)..(55): Pfam Name: F-box Pfam Description: F-box domain
MERPKKNGAVAGLPDDPLVEILSRVPVKDLHRSKCVSKGWRDLIADPLHRKKLPQTLEGFFHAGDFIGLSGGSPPPVNPSFPFLRKLPGIGEICLRGSCNGLLLFRHAPSPTISYIVCNPATEQWAAVPSEHTPADKQDGESRTYLLFDPAVSSHFHLVTICAEERSLATLHTYSSKTGVWRHRHTDWAEEEKQLGQWRGGESSDHCHGPWCCLF

SEQ ID NO: 38534 - DNA, 1171 bp, Panicum virgatum
  misc_feature: Ceres CLONE 1994386
  misc_feature: Encodes the peptide sequence at SEQ ID NO. 38535
agtcgccgccgttccgcgagcacctccctcccccaccgcaatggcctcctccctcgccgcgcgccgcctcctctcccgcgccgccgccgcgcgccggcttcccctctcctccgcccccgccccctcccccgcggtagctccccgccgtttctccgccgacgcggggccgcctccgccgacgccgacgctcccgccgcctccgatggagcccgccaccgagccgcccaggtcggagggcgcgggcgcctcgtcctcgtcctcgtcctccgccaccgccggtgccggaggggaccacaggtcgtcgccgggggcctcggcgggggcgcggcgccagggcggcacgggctacgaggaggagcaggagaaggtcctccgcgcgtcgctgctccacgtgccgcgcatggggtggagcgagtcggccatggtcgctggggccagggacgtcggcatttcaccggccatcgttggcgcgttcccaaggaaggaggccgccctggttgagtttttcatggatgactgccttcaacaactgatggatcgcattgacgctggcgaaggagagcagttgaagaacttaatactgagtgagaggctcgcaaaacttgttcggatgaggctggaaatgcaggcaccttatatatcaaagtggcctcaagcactgagtatccagtctcaaccagcaaacgtctcaacaagcttgaagcagcgagctgtcctggttgatgagatttggcatgcagctggagatactggatcagatattgattggtatgtgaagcgtactgtgcttggtggtatctactcaacctctgaggtgtatatgttgacggacaattctccagagtttcgcgatacgtggatgtttgtgaaccgccgcatcaaggatgctcttgatcttcagaaaaccttccaagaggcggcgtacctagctgaagccgtgggagcaggaatgggtggtaccgtgcagggggtcctgaaccgaggttcatgaactggagtagttccgcaggatgcatcgactgcctttttcattctcaaatgtctctcccttgcaccggcgcctttttcgttctccagttggcatgttgtttttaataaagcgaattgtgctgtgattccatatcacgtttcggtttggtgacagtgtatataatagccctaggttcatttc

SEQ ID NO: 38535 - protein, 316 aa, Panicum virgatum
  misc_feature: Ceres CLONE 1994386
  misc_feature (213)..(291): Pfam Name: COQ9 Pfam Description: COQ9
MASSLAARRLLSRAAAARRLPLSSAPAPSPAVAPRRFSADAGPPPPTPTLPPPPMEPATEPPRSEGAGASSSSSSSATAGAGGDHRSSPGASAGARRQGGTGYEEEQEKVLRASLLHVPRMGWSESAMVAGARDVGISPAIVGAFPRKEAALVEFFMDDCLQQLMDRIDAGEGEQLKNLILSERLAKLVRMRLEMQAPYISKWPQALSIQSQPANVSTSLKQRAVLVDEIWHAAGDTGSDIDWYVKRTVLGGIYSTSEVYMLTDNSPEFRDTWMFVNRRIKDALDLQKTFQEAAYLAEAVGAGMGGTVQGVLNRGS

SEQ ID NO: 38536 - DNA, 1693 bp, Panicum virgatum
  misc_feature: Ceres CLONE 1994390
  misc_feature: Encodes the peptide sequence at SEQ ID NO. 38537
tttttccctttccgccgcattccctcttcctccggcagccgtcgccagctccccccgtcgtcccatggtccggaaggagacggccaagcggctgcccccgcagcaccgggggctggaggtcaagatccccagcttcttccgctgccccatctcgctcgacgtcatgcgctcgcccgtcagcctctgcaccggcgtcacctacgaccgcgcctccatccagcgctggctcgactccggcaacaccacctgccccgccaccatgctcccgctcccctccaccgacctcgtccccaacctcaccctccgcagcctcatcgcgcactgggccgcctcggccgccgcctgctcgcccaccgccgccggaggagcctccgcggcgcggactgcctcccccgccagcctcgtccgccaggtcgcggcctccggtgccgacccctccccggccctccgcgagctggcggcctacctctccgacgacgacgtcgacgacttcgaaaagaacgcgctcgtgggcgccggccgcgccgccgagacggtcgcggcggtgctccggaggagaggcgaggaggaggccggcgccgaggccgtggaggcggccacgagggtgctcgccgcgatcgtggcttcggacggcatcgacgacgcgaacaagaagcgggtggccgcgggcctcgccgcggacgcgcccgccgcggccgcgtcgctggcgcgcgtgatgcgcggcgggagcggcctggaggcgcgggtcgccgcggcgaggctggctgagttcctgctcgccaatgccgccgaggaggcgagggcggcggcggccgagtcgtcggagctggtggccgagctgatccggctcatcggccccgtcgacgggaagggcgccctagacggggaggccgtggacgccgggctctcgtgcctggccgccatctgcgggtcgcggcgcggcgcggcgcgcgccgagatggtgcggctgggcgcggtcccggcggcggtgcgcgcgctccgcgcgacggcggagccccgcgcgtcggcgaaggcgctccgggtgctcgagtccgcggtgggctgcgccgagggccgcgccgcgctgtgcgagggcgcggaggaggccgtcccggcggtggtgggcaggatgatgaaggccgggcgcgacggcgcggaggccgcggtggccgtgctctgggcggtgtgccaccggtaccgggaccggcgggcggcggacgcggcggcggcggccgagggcgggctgacgaggctgctgctgctggtgcagagcgggtgctcgccggcggcgcggcagatggcgctggagctgctcaagatgtacagggtgaacgccaagagctgcctcgccgggtacgactccaagaccacccacatcatgccgttctgagctgagcagccagccgatcaaccgaatcgcgtggaacagaggggacggtgttcttgatcctgtgatgatgtttcttgcttcttcttttttttttttttgcccccttttcttttgatgtaagtcgatagatagagaaacaaagaagaattggttcatggcggggagggaggaggatgaataatctgtacatgggtagagagagttttgacatgatcagaacaggcacaggggacaaatttaacccaaataattgatttttttttgtggccaaggcaattgcaagtgcatgacaaagttttcagc

SEQ ID NO: 38537 - protein, 441 aa, Panicum virgatum
  misc_feature: Ceres CLONE 1994390
  misc_feature (20)..(94): Pfam Name: U-box Pfam Description: U-box domain
MVRKETAKRLPPQHRGLEVKIPSFFRCPISLDVMRSPVSLCTGVTYDRASIQRWLDSGNTTCPATMLPLPSTDLVPNLTLRSLIAHWAASAAACSPTAAGGASAARTASPASLVRQVAASGADPSPALRELAAYLSDDDVDDFEKNALVGAGRAAETVAAVLRRRGEEEAGAEAVEAATRVLAAIVASDGIDDANKKRVAAGLAADAPAAAASLARVMRGGSGLEARVAAARLAEFLLANAAEEARAAAAESSELVAELIRLIGPVDGKGALDGEAVDAGLSCLAAICGSRRGAARAEMVRLGAVPAAVRALRATAEPRASAKALRVLESAVGCAEGRAALCEGAEEAVPAVVGRMMKAGRDGAEAAVAVLWAVCHRYRDRRAADAAAAAEGGLTRLLLLVQSGCSPAARQMALELLKMYRVNAKSCLAGYDSKTTHIMPF

SEQ ID NO: 38538 - DNA, 1334 bp, Panicum virgatum
  misc_feature: Ceres CLONE 1994395
  misc_feature: Encodes the peptide sequence at SEQ ID NO. 38539
acttgccctccctcttcctcctcccacacctctccctcaattctgccggctctccctcgaactcatcgattcctacatggacaacgccgaggggccgtccccggagcccgccgatcgcgcggcaccggatcaggatggcagtgcccaagctacacctggccttaattcgcgaaggccaaacctttcgttgcagataccagccaggaccttggataccagtatacctacttcgacaagaattaatatttcctccagccccagttcaacaagagctggtttgccaccaagacctaattcaacaagaacaaaatcatctatcaagaacatcatgcctcagcacagtttcagggcaaggagttcagcccatgacggtgaccgggtgatccttctgaatcctgggacaccatctgaaggccagcaggataacccaagtacagcgagatcgttttcttttagaaaggttatcacctctttatcggcaaaacggacacactctctgccagtcacgcctgttggaactaatgacaaggtttcttctccagcaaatcaattagagagcctgccaactacatctaatcaagaagtcgaagcaaaaatcaggcgttcgctttcagtcccaggaaatcgcaaaaacagaagtttgagaagagcagattcattaggtgtcatccgtgtgattccaacaaccccacgacctgttccagtcgatacaacgacatcgaacgatgtcattgaagaaactgttgatgtccctgaagatggaggcgaagatattcctgaagaagaggcagtctgcagaatttgttttgttgaactcaatgaaggaggggaaacacttaaaatggagtgcagctgcaaaggagaacttgcccttgcacaccaagattgtgctgtcaaatggtttagcatcaagggaaacaagatatgtgatgtctgcaaacaagaagttcagaatcttcctgtgactttattgaggataccaactcaaactgcaaacagacggatagcgaatgctgctcagcagagagcagctcaacaatacagattttggcaggacattccaattctggtgatggttagcatgcttgcgtacttctgtttcttggaacaacttctggttacggatttgcagtcacgtgcactggcaatttcattgcctttctcatgtgtgttgggcctcctttcttctatgatagcatcgactatggtgtcaaagagctatctatgggcctatgcttcattccagtttgctattgtcatcctgtttgctcatatcttctacaacgtgctgaaagtgaatgcagtccttgcagtcctactctcctcattcactg

SEQ ID NO: 38539 - protein, 419 aa, Panicum virgatum
  misc_feature: Ceres CLONE 1994395
  misc_feature (240)..(287): Pfam Name: zf-C3HC4 Pfam Description: Zinc finger, C3HC4 type (RING finger)
MDNAEGPSPEPADRAAPDQDGSAQATPGLNSRRPNLSLQIPARTLDTSIPTSTRINISSSPSSTRAGLPPRPNSTRTKSSIKNIMPQHSFRARSSAHDGDRVILLNPGTPSEGQQDNPSTARSFSFRKVITSLSAKRTHSLPVTPVGTNDKVSSPANQLESLPTTSNQEVEAKIRRSLSVPGNRKNRSLRRADSLGVIRVIPTTPRPVPVDTTTSNDVIEETVDVPEDGGEDIPEEEAVCRICFVELNEGGETLKMECSCKGELALAHQDCAVKWFSIKGNKICDVCKQEVQNLPVTLLRIPTQTANRRIANAAQQRAAQQYRFWQDIPILVMVSMLAYFCFLEQLLVTDLQSRALAISLPFSCVLGLLSSMIASTMVSKSYLWAYASFQFAIVILFAHIFYNVLKVNAVLAVLLSSFT

SEQ ID NO: 38540 - DNA, 157 bp, Panicum virgatum
  misc_feature: Ceres CLONE 1994395-R
cccccccccccccccccccccatatagatatacataaatgaattttagtttccccgtactgagggctcctagtcagcgcgtgaaaaatattcagattgtgtattgtcatacagttgtattagctgtgaaccggaattgtatccaatgccagaggttg

SEQ ID NO: 38541 - DNA, 729 bp, Panicum virgatum
  misc_feature: Ceres CLONE 1994399
  misc_feature: Encodes the peptide sequence at SEQ ID NO. 38542
aaatcgagccttcctgtgcgcaaaatcgagttcctctgctccaaatcgaagattaaaccccccccccccccccaaatcgagtccccgaccatcaaatcgagttcctgcgaggtcgctggcgccgtgggttcctgccgcctacgaggtgctgctgattgtcctgcctcttccctccgctacctgggccgcacctgcactagcctccacaccgcacgcatccggcaccgcgattcgggagccggtgctacagccagacgcccagacgccgtgatctccccgccttcctctcctgtcctgcgctgcgcaatcgggaggccaccgacgaggaagcagggcaacgaagatggtccgggaggttgcggagagctgcgtcgatggggtggtcatggagatggtagcggcgtactgcggtcgcttctacgccgtcaagcccgagctcgctgcccgccgcatcgaggccattggtttccaggtcggccaccagctctccgagagatataccatggagcgccctcgatttagtgatcaccttgaagcaatcaaatttatctgcaaagatttttggtcagagctgttcaagaagcagattgataatctgaaaacaaatcacaggggtacctttgtccttcaagataaccgtttccggtggcttactcgtgtttctctagatccatctgcagagagcacagatgcaactgacaatgactctgcaccattgggtgatactgc

SEQ ID NO: 38542 - protein, 128 aa, Panicum virgatum
  misc_feature: Ceres CLONE 1994399
  misc_feature (9)..(124): Pfam Name: TRAPP_Bet3 Pfam Description: Transport protein particle (TRAPP) component, Bet3
MVREVAESCVDGVVMEMVAAYCGRFYAVKPELAARRIEAIGFQVGHQLSERYTMERPRFSDHLEAIKFICKDFWSELFKKQIDNLKTNHRGTFVLQDNRFRWLTRVSLDPSAESTDATDNDSAPLGDT

SEQ ID NO: 38543 - DNA, 667 bp, Panicum virgatum
  misc_feature: Ceres CLONE 1994402
  misc_feature: Encodes the peptide sequence at SEQ ID NO. 38544
ggttggtcgccctcgcgttccctcctctccacaggcacagctgcagcacctccccaccttatcgtcatcctcggctgcttcatcgtcgacagcagcgccagcgcctcttttcttccccaccgccgtctacatggctgctcaagaggagaagactgctcctgtcaagacagaggagccttcctcggcggcggagcagcagccacagcctcaaccggcagcaggggcgacgcgcagggctgggccatcggcgccggccaaccccttcgacttctccaccatgatgaacctgctcaatgaccccagcatcaaggagatggcggagcagatcaccaaggaccctgcgttcacagagatggcggagcagctgcaaaagatgacggtggtgtcgccgcggcaggcaccggcggcgcccacgccccaggcggcggcagcgctggacccgcacaagtacgtggcgacgatgcagcagctgatgcagaacccgcagttcgtggccatggcggagcggctgggcagcgcgctgatgcaggaccccgccatggccaccatgctgggcggcctcaccaaccccgcgcacaacgagcagctcgaggtccgcatcgcgcgcatgaaggaggaccccacgctcaagcccatcctggacgagatcgaggccggcggccccgcc

SEQ ID NO: 38544 - protein, 178 aa, Panicum virgatum
  misc_feature: Ceres CLONE 1994402
  misc_feature: The sequence is a functional homolog of SEQ ID NO 1839 in the 10/374,780 US patent application
MAAQEEKTAPVKTEEPSSAAEQQPQPQPAAGATRRAGPSAPANPFDFSTMMNLLNDPSIKEMAEQITKDPAFTEMAEQLQKMTVVSPRQAPAAPTPQAAAALDPHKYVATMQQLMQNPQFVAMAERLGSALMQDPAMATMLGGLTNPAHNEQLEVRIARMKEDPTLKPILDEIEAGGP

SEQ ID NO: 38545 - DNA, 636 bp, Panicum virgatum
  misc_feature: Ceres CLONE 1994416
  misc_feature: Encodes the peptide sequence at SEQ ID NO. 38546
agacggagaaggctttcttgaagcagcccaaggtgtttctatgtcccaagaaggccgccaaggggaacaagcctggcaagggtgggaacaggttctggaagaacatcggccttgggttcaagacccccagggaagccattgaaggaacctacattgataagaaatgcccgttcactggcactgtgtctatcaggggtcgcatcattgctggaacatgccacagtgctaagatgaacaggaccatcattgttcgtaggaattatcttcactttgtcaagaagtaccagaggtatgagaagaggcactctaacatccccgcccacatttcaccgtgcttccgcgtgaaggaaggagaccatgtgatcattggccagtgcaggccactatcaaagactgtgaggttcaatgtgctcaaagtcattccggcaggttcaaagagtggagcagtgaagaaggctttcacggctgcttaagatgatgatgagcaacccatctgaggtccggaaaagcttttgttataccattttgatgctgcctagcctttttttcatatctactgtgtagtaggaatttgacttgagtcacttccagagcttgaaatagtgaaaatttcagaaccctgtgttgctcagtatc

SEQ ID NO: 38546 - protein, 156 aa, Panicum virgatum
  misc_feature: Ceres CLONE 1994416
  misc_feature (70)..(139): Pfam Name: Ribosomal_S17 Pfam Description: Ribosomal protein S17
TEKAFLKQPKVFLCPKKAAKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 38547 - DNA, 1500 bp, Panicum virgatum
  misc_feature: Ceres CLONE 1994420
  misc_feature: Encodes the peptide sequence at SEQ ID NO. 38548
ctttttcggcgcccacacccgtcgtccgcgccgtctactcgtcggcaacccattcggcgacatgccgccgccggcgccgctcttcctctcgctcccctcgcttccccaaccactcctgcctgtccaccaccgcaaggccccgcatgccctaaaccttaatctgcccctcacctcatccaggaaacccgcccttcccgcgcgccccgtcgcctccctcgcgccagctgtgaccacacgccagtatgactggacgcgcaagcagagaatacggaggcagggtggtctatctcgtagatattcaaaaattgtgtcctattacgggctcacaactccaccatataaactggatgctctggaaccatatatgagcatgagaacagttgaacttcattggggtaaacaccatcaggattatgtggagggcttaaataagcagcttgctagcagcccgctgtatggatacactctggaggagctgataaaagaagcgtacaacaatggcaatccattaccagaatataataatgcagcccaggtctggaaccatcacttcttctgggaatctatgcaaccagaaggtggtggcttacctgagggaggtgttttgcagcagattgaaaaggattttggctcgtttactaatttcagggaagagtttatttcctcagcctcacaactattggggtctggttgggtttggcttgtcttgaagagaaatgagagaaagctttcggtggttcacacaagaaatgccatctccccacttgcttttggcgatattccaattgccagcctagacttatgggagcatgcttactacttagactacaaggatgatattcggacatatattacaaactttatggaccatctcatctcttgggacactgtcactctgcgcatgatgcgtgctgagtcttttgtgaaccttggtgagccaaatatcccagtggcatgagatgcagatacaccctggttatcaggtatcctgcgaagatttcaggtcaaatcctgcaggagcaagcagaaagttggaaaagctgcataagagttgcctatctccctattgccgtatagatgatgaacttaaagataagcttctgggttttcaccattgcccttgggccttggctattgctacaacgaagtcagcatccaatttcaagacatgcaaacagagcagctttagatacttgggacttgggacttgggagcatgtagattatggtgttgggcaaggtccaacttgggctctgaagccatggcatttcctctaggcggctattcttcagaacgagcgcccagactgcagtagattcagctctaagttttcaggactttgttatgccagcgttttgttgtagcggaatggaaccgtgttttgttttactggttgaggaatcctaataattttggattgtagggaaaccttttatgtgttagacactgcaagtcaacttctttctactaaggtagaaagaagttgactttgcagattgg

SEQ ID NO: 38548 - protein, 298 aa, Panicum virgatum
  misc_feature: Ceres CLONE 1994420
  misc_feature (175)..(281): Pfam Name: Sod_Fe_C Pfam Description: Iron/manganese superoxide dismutases, C-terminal domain
  misc_feature (85)..(170): Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
MPPPAPLFLSLPSLPQPLLPVHHRKAPHALNLNLPLTSSRKPALPARPVASLAPAVTTRQYDWTRKQRIRRQGGLSRRYSKIVSYYGLTTPPYKLDALEPYMSMRTVELHWGKHHQDYVEGLNKQLASSPLYGYTLEELIKEAYNNGNPLPEYNNAAQVWNHHFFWESMQPEGGGLPEGGVLQQIEKDFGSFTNFREEFISSASQLLGSGWVWLVLKRNERKLSVVHTRNAISPLAFGDIPIASLDLWEHAYYLDYKDDIRTYITNFMDHLISWDTVTLRMMRAESFVNLGEPNIPVA

SEQ ID NO: 38549 - DNA, 1251 bp, Panicum virgatum
  misc_feature: Ceres CLONE 1994424
  misc_feature: Encodes the peptide sequence at SEQ ID NO. 38550
aacgcgagcacttggcacggctaagatctgttcgacagcaataagctcatcagctcagtcttgtcagtgagtagcaatcaggtagatggcgtcggagaagagcaagatcctggtggtcggcggcacgggctacctgggccggcacgtcgtggcggcgagcgcgcggctgggccaccctaccttcgcgctcgtccgggacacggcgccgtccgacccggccaaggcggcgctcctcaagagcttccaggacgccggcgtcacgctcctcaagggcgacctctacgactacgccagcctagtcagcgccgccaaggtcgctgacgtggtcatctccacgctcggggcccgccagatcgccgaccagaccaggctcatcgacgccatcaaagaggccggcaacgtcaagaggttcttcccgtcggagttcgggctggacgtggaccgcacggggatcgtggagccaggcaagtcgatcctcgccggcaaggtggccatccggcgcgccaccgaggcatccgggatcccctacacgttcgccgtggccggattcttcgcgggctacgcgctgcccaacatcgggcaggtcctggcccaaggcccacccgtcgacaaggcggtcgtcctcggcgacggcgagaccaaggtcgtgtacgtggacgagggcgacatcgcgacgtacacggtgctcgccgccgacgacccccgcgccgagaacaagacgctgtacatcaagccccccgccaacacgctgtcgcacaacgaactcctggcgctgtgggagaagaagaccggcaagacgttcgagcgggtgtacatccccgaggaagccgtcctcaagcagatccaagagtcgccgattccgctgaacatcatcctggcgatcgggcacgcggcgtacgtgaggggggagcagacgggattcgagatcgacccggccaagggggtggatgcaaccgagctgtacccggacgtcaagtacaccactgtcgacgagtacctcaacaggttcctctgaagaaccgagacgcacctgctggtgtgtggacgtgctagccacagcttgcctactggtttcgcagacagcagcgagagctcgagcggttgctgatcgcgatgatgcgtcagctactagctggtgacactacacatgatgtgtgactctgttgtagatatgtctccctgtgatcgatcgagtgtgcgtactttgtacttgatcatttcaattcgacgcaaataagatctcacctctcg

SEQ ID NO: 38550 - protein, 309 aa, Panicum virgatum
  misc_feature: Ceres CLONE 1994424
  misc_feature (8)..(300): Pfam Name: NmrA Pfam Description: NmrA-like family
  misc_feature: SWISSPROT Homolog: EC 1.3.1.45 2'-hydroxyisoflavone reductase
MASEKSKILVVGGTGYLGRHVVAASARLGHPTFALVRDTAPSDPAKAALLKSFQDAGVTLLKGDLYDYASLVSAAKVADVVISTLGARQIADQTRLIDAIKEAGNVKRFFPSEFGLDVDRTGIVEPGKSILAGKVAIRRATEASGIPYTFAVAGFFAGYALPNIGQVLAQGPPVDKAVVLGDGETKVVYVDEGDIATYTVLAADDPRAENKTLYIKPPANTLSHNELLALWEKKTGKTFERVYIPEEAVLKQIQESPIPLNIILAIGHAAYVRGEQTGFEIDPAKGVDATELYPDVKYTTVDEYLNRFL

SEQ ID NO: 38551 - DNA, 1695 bp, Panicum virgatum
  misc_feature: Ceres CLONE 1994429
  misc_feature: Encodes the peptide sequence at SEQ ID NO. 38552
aaggtgagttgttcaaatgctgcagacgaacggagcgttgaagaggtacagatacgtcatcattggtggtggagtcattgggttgtcgtctgcttttagactctcgaaactcatcgagaagcagcagcgaggtcgtcgcgatgtcaacgccaacaacgttggggctgagaacgggatactggtagttgaggccaacaaggtgttctctaagaagaattgctgtcctgttggtgtgttgtggtctaaagagttcgcttcgaagattgaagaaggaagttcttcatcctcatctactttggacaacgcaaggagagtgcaggcgatattcaatggcattgggataccgtctacggagaagagctctcgtgaaagcttcaatgatttcattgctgaactcaagagtactgcgaaaggacatgaggaagatcatggtgtgacggatgacgaagagattgtaaagcaattaggtcacctcaaattgaaagagttgcgagttatcaagcccacgagcaacggtctgatcctgctgtcgaataccgctgaggacgaggtgtcatcagcaaatgaatcaaagggcgaaaagaatgaatctaagtcttctgaggcctctcctcactctcaggttctcaaattcagtgatgcaaacggaggcattctagatctcaacacagctcaagtcaatgtgtcgtcctttgcacacttactgaaggaagcatgttccaatatgggcgtaactttcaaggagaattcgatggtgactcagctcaactactccaggaacgcacctaaactggattcgatcaccattcacaacactgagaggctaaaggcgcgcgtaaggcgttacgaaagcaacttaagtgcgtctaagaaacatgaaagcctcgcttctcctgattccgatgcggagacaattgaggcagatgcctttttgatggctacagggggtaatagtcttgaaccgatgagcttcctagaatctttgtcagagaaacaaattcgtcgcaggtcatcgactcttattgcagatcctttcgtcagcaagtatctatcgagcatgatcaccaccaaggctatttccatcgaaattcacttcttgagtgacgatttcgtgcaacttcgaaaccaacttccagtaattgtcacggacgagatattgatcatcaactgggggaataagctcgttgtatctctgcgcaacgactcattcaatgacgaaatgggtataccaatatcatctaatcgaacaaagccatccacttccaccaaacaatcgctacggcataaaaatcgagtatcatccacaacaacaccatccaaatggtcatcaccatccttgctttcgtcatccgttaaccaatctaaatcagcggtgagaaacaagtacctcttcaacaaagtactcgagttgattccacaactcaaagatgtgcactgcatcgtgacatcttgggatggcagcaccacggagacacccaccaaagagcctctgctgggcaacgttcctaccgcacgaaatttgtttctatctgtgggctactccaactatgggttagaagtctgccccttcgcttcctcagcctctgcatcgcagatgttcaactacgtcaacgacgctctccaggatgaacaacagtcgcagaaaaatcacaatgcaacttcttcttccgatcggtgacaataataacccaatag

SEQ ID NO: 38552 - protein, 553 aa, Panicum virgatum
  misc_feature: Ceres CLONE 1994429
  misc_feature (12)..(526): Pfam Name: DAO Pfam Description: FAD dependent oxidoreductase
MLQTNGALKRYRYVIIGGGVIGLSSAFRLSKLIEKQQRGRRDVNANNVGAENGILVVEANKVFSKKNCCPVGVLWSKEFASKIEEGSSSSSSTLDNARRVQAIFNGIGIPSTEKSSRESFNDFIAELKSTAKGHEEDHGVTDDEEIVKQLGHLKLKELRVIKPTSNGLILLSNTAEDEVSSANESKGEKNESKSSEASPHSQVLKFSDANGGILDLNTAQVNVSSFAHLLKEACSNMGVTFKENSMVTQLNYSRNAPKLDSITIHNTERLKARVRRYESNLSASKKHESLASPDSDAETIEADAFLMATGGNSLEPMSFLESLSEKQIRRRSSTLIADPFVSKYLSSMITTKAISIEIHFLSDDFVQLRNQLPVIVTDEILIINWGNKLVVSLRNDSFNDEMGIPISSNRTKPSTSTKQSLRHKNRVSSTTTPSKWSSPSLLSSSVNQSKSAVRNKYLFNKVLELIPQLKDVHCIVTSWDGSTTETPTKEPLLGNVPTARNLFLSVGYSNYGLEVCPFASSASASQMFNYVNDALQDEQQSQKNHNATSSSDR

SEQ ID NO: 38553 - DNA, 707 bp, Panicum virgatum
  misc_feature: Ceres CLONE 1994431
  misc_feature: Encodes the peptide sequence at SEQ ID NO. 38554
gaaaaaactggcttctcctgccacaagcgccgcagcgccatggacgccggcgcgaaggagcagagggaccccgcgtggtggggccgccgagcgtggtcgctcctctcggccgtccgcgtgcgggcgccgctggtgcagtgcatcaccaacctggtctccatggacatcgccgccaacgcgctcctcgcggcgggggcgtccccggccatggtccactccctccgcgaggtgcccgacttcaccccgcgctgcgacgccgtgtacgtcaacgtcggcacgctctccgaggactggctcccctctatgcgcgccgcggcctcgaccggccggccatgggtgctcgatcccgtggccgccgccgcttccgggttccggatggaggcctgccttgagctgctcgcgctccgccccgccgtcgtcaggggtaacgcctcagagatcctcgcgctcgccgaccgctcggtacccgcctcgtccaactttaagggtgctgacagttcacatgagtctgtggacgccctcgaagctgcaaaagcattagcactgtccagcggcactgtcgttgcggtatccggagctgttgatttcatcaccaatggggagcaggttgtcggcgcaagcaatggtgtgcccatgatgcaaaagatcacagcgacagggtgcgctgtgaccgcccttattgcggctttttgttgccgtcgaacctt

SEQ ID NO: 38554 - protein, 222 aa, Panicum virgatum
  misc_feature: Ceres CLONE 1994431
  misc_feature (22)..(222): Pfam Name: HK Pfam Description: Hydroxyethylthiazole kinase family
  misc_feature: SWISSPROT Homolog: EC 2.7.1.50 Hydroxyethylthiazole kinase
MDAGAKEQRDPAWWGRRAWSLLSAVRVRAPLVQCITNLVSMDIAANALLAAGASPAMVHSLREVPDFTPRCDAVYVNVGTLSEDWLPSMRAAASTGRPWVLDPVAAAASGFRMEACLELLALRPAVVRGNASEILALADRSVPASSNFKGADSSHESVDALEAAKALALSSGTVVAVSGAVDFITNGEQVVGASNGVPMMQKITATGCAVTALIAAFCCRRT

SEQ ID NO: 38555 - DNA, 1655 bp, Panicum virgatum
  misc_feature: Ceres CLONE 1994434
  misc_feature: Encodes the peptide sequence at SEQ ID NO. 38556
agaccgtccgcgccgcgcacgctccatccgatggccgccgccgtccacctccgccctctccactcgctcgccccccgcccccccgcggcgaaggccgtgcccagctgtcttcccttcccggcgaaacccagggcacggaggagggacagccgcctcgccctgctcgtatgctccgcgtcgccccccgcgcccgcggctccctcgtcctcgggaagggacaacaccgcggcggccaggtgggcagagtggatcccgcgggtggcggcgggccgtgcgggggcgggcccggagcaggtgctcaggcttatctccggcgctgcggccgcgcccgtttgccagttcgtcgacaaaccgcgcaccttcctccactccgtcgacccgcgcgtcaagctggtgtggcttttggcccttgttgtcttaccagccaggtcaaacatttatatgcggttcggtttggtagtattcctggctcttctttcagtgtgggttttgccaaatcatgtttggaaggatcaacttggaagggttgctctcctttcaggattcatattcataatgctgggatttggggccgatggtgcaccttcattggttcagacgagaactcctcccccttctgttctaggcataccgaacattccttgttccgcaagtgggtattcttacacaatcatgaaactggggccactacaatttacaaggaaaggcctatcagttgcaagcacttcggcaagcctctcctttgcgatattccaaagcgcaagtctctgcttgacaacaaccacgcctgagcagcttgcttctgctttgtggtggtttatgattccactgaagcacatcggtgtaccagtacctgagataatacttacactactactgtcattgaggttcattaatttagtatttgatgaggtccgcaactcagcactggcgattgtagcacgcaggataaattggaagaagctgacagctatggaaactatagatattttcttcaactatatccgacggatattcaaaaatatatttgatcatgcagagcaaatatccaaggcaatgatatctcgagggttccgtggtgatccaagcaatcacaagatctacttccttacagaatcttcatttggctttgcggatctattttcattgctttgcctgtttgctctaatgggcctggcttcctattctgatcagttggttttgatgggacacattgagattatcatgagaacttcatttcttgctatcgcaagacatggttaaacgacttgaatggcaggacttcctgaagcagcacattcaatggtttggaaacaaagaacaagatttgttgagaacaaaaacaagggtttcaagatgtaaatatgatcccctcctttggaaactggtaggactacactaacacgatgttccaagcagtcatttgtaggcacaacgtttacatgcgtcctttgaaaggcagcgtcgacaactgatttgagtccaacttcgggaaatgcgagtgattgttgttgaatgggatctctccattatgttgtagagacatgtcaaatatccatcctgaaacctgtaacgcaaaattatagctttgcttcatttttttcttatctgtacctgaccagtgaccagagttatggtaagatacttgaagatac

SEQ ID NO: 38556 - protein, 410 aa, Panicum virgatum
  misc_feature: Ceres CLONE 1994434
  misc_feature (108)..(354): Pfam Name: CbiQ Pfam Description: Cobalt transport protein
MAAAVHLRPLHSLAPRPPAAKAVPSCLPFPAKPRARRRDSRLALLVCSASPPAPAAPSSSGRDNTAAARWAEWIPRVAAGRAGAGPEQVLRLISGAAAAPVCQFVDKPRTFLHSVDPRVKLVWLLALVVLPARSNIYMRFGLVVFLALLSVWVLPNHVWKDQLGRVALLSGFIFIMLGFGADGAPSLVQTRTPPPSVLGIPNIPCSASGYSYTIMKLGPLQFTRKGLSVASTSASLSFAIFQSASLCLTTTTPEQLASALWWFMIPLKHIGVPVPEIILTLLLSLRFINLVFDEVRNSALAIVARRINWKKLTAMETIDIFFNYIRRIFKNIFDHAEQISKAMISRGFRGDPSNHKIYFLTESSFGFADLFSLLCLFALMGLASYSDQLVLMGHIEIIMRTSFLAIARHG

SEQ ID NO: 38557 - DNA, 670 bp, Panicum virgatum
  misc_feature: Ceres CLONE 1994439
  misc_feature: Encodes the peptide sequence at SEQ ID NO. 38558
aaatccagtcatccaccactcgctcgctcgctcgtcgcggcgcggcggcggcggcaaggcaatggcgctggcctccacctacgcgccgggcggcggcgcgggggcgctcgcgccgggaagggccagggtccgcgcgcccgccggggggcccgtcctcggcccctccagggccggcggcctcccccgccccctcgccctcgccagtcggagcccgctcgcggcacgtgccggcgccgcgcggctgcggtgcgcggcgtcctcgtcgcctgcggcccccgcgcggcccgcgacggcgccgcggttcatccagcacaagaaggaggccttctggttctaccgcttcctctccatcgtctacgaccacgtcatcaacccgggccactggaccgaggacatgcgcgacgacgcgctcgagcccgccgacctctacagccgccacctcaaggtcgtcgacgtcggcggcggcacgggcttcaccacgctcgggatcgtcaagcacgtcaacccggagaacgtcacgctgctcgaccagtccccgcaccagctcgagaaggccaggcagaaggaggcgctcaagggggtcaccatcatggagggcgacgccgaggacctgcccttccccaccgacagcttcgaccgatacatctccgccggcagcaatcgagtattg

SEQ ID NO: 38558 - protein, 202 aa, Panicum virgatum
  misc_feature: Ceres CLONE 1994439
  misc_feature (130)..(202): Pfam Name: Methyltransf_11 Pfam Description: Methyltransferase domain
  misc_feature: Useful for making plants with altered tocopherol content
  misc_feature: The sequence is a functional homolog of SEQ ID NO 16 in US patent 7262339
MALASTYAPGGGAGALAPGRARVRAPAGGPVLGPSRAGGLPRPLALASRSPLAARAGAARLRCAASSSPAAPARPATAPRFIQHKKEAFWFYRFLSIVYDHVINPGHWTEDMRDDALEPADLYSRHLKVVDVGGGTGFTTLGIVKHVNPENVTLLDQSPHQLEKARQKEALKGVTIMEGDAEDLPFPTDSFDRYISAGSNRV

SEQ ID NO: 38559 - DNA, 703 bp, Panicum virgatum
  misc_feature: Ceres CLONE 1994443
  misc_feature: Encodes the peptide sequence at SEQ ID NO. 38560
actcagtcacacagcacaagaagcaagctcgatcagtccacctccaccaccacacgtctcaccacagtcagcaagctccgcttccgagccaccgcttcggccatggcccggcgggtgtcgtccctgctgctgctgggcgtgctggcggcggcggcggcggccagcttcgaccaggagttcgacatcacctggggcgacggccgcggcaagatccaggacggcggccgcctcctcacgctcacgctcgaccgcacctccggctccggcttccagtccaggcgcgagtacctcttcggcaagatcgacatgcagatcaagctcgtccccggcaactccgccggcaccgtcaccgcctactacctctcctcgcaggggagcacccacgacgagatcgacttcgagttcctgggcaacgtcaccggcgagccctacacgctgcacaccaacgtgttcacgcaggggcagggccagcgcgagcagcagttccgcctctggttcgaccccaccaccgacttccacacctactccatcctctggaaccccaagcacatcatgtaatgttgctcaatgctcactgctcttcttcatcatcatcaaacaaactgacaaactgacaatttgaaaatccatggatgatgcagcttcatggtggacgacctgcccatcagggacttccggaacctggagagcaaggggatcgcgt

SEQ ID NO: 38560 - protein, 151 aa, Panicum virgatum
  misc_feature: Ceres CLONE 1994443
  misc_feature (22)..(151): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MARRVSSLLLLGVLAAAAAASFDQEFDITWGDGRGKIQDGGRLLTLTLDRTSGSGFQSRREYLFGKIDMQIKLVPGNSAGTVTAYYLSSQGSTHDEIDFEFLGNVTGEPYTLHTNVFTQGQGQREQQFRLWFDPTTDFHTYSILWNPKHIM

SEQ ID NO: 38561 - DNA, 683 bp, Panicum virgatum
  misc_feature: Ceres CLONE 1994465
  misc_feature: Encodes the peptide sequence at SEQ ID NO. 38562
actcggcccagcccccctcgcttcctttcccctcctcgtcgctcggctcgctcgctcgtctgcacagcggaatcccccctccgccgccgccgccgctccttccggcttcggaactcgcccgagatggcaaacgcaagatcaggagtcgcggtgaatgatgactgcatgctgaagttcggcgagctgcagtcgaagaggctgcaccgtttcattgtttacaagatggatgacaagttcaaggagattattgtggataaggttggggatcgcgagaccagctatgaggatttcaccaacagcctacccgaaaatgactgccgatatgctatctatgattttgactttgttactgcagaagacgtccaaaagagcaggatcttctatatcctatggtccccgtccactgccaaggtgaagagcaagatgctttacgctagctcaaaccaaaaattcaagagtgggctcaatggcatccaggtggaactgcaggctactgatgctagtgaaatcagccttgatgagatcaaggatcgagcgcgctaggtgtcatcgcgtgtctcatgatcatgcatcgtggacttgcctactgctgtggatttgtatgccattatagacttggtgctatgaaagaccgcttggtgatttatgggtttgttgctgtgtaaaaagatcctcgtggcttt

SEQ ID NO: 38562 - protein, 139 aa, Panicum virgatum; identical to SEQ ID NO: 12693
  misc_feature: Ceres CLONE 1994465
  misc_feature (12)..(139): Pfam Name: Cofilin_ADF Pfam Description: Cofilin/tropomyosin-type actin-binding protein
  misc_feature: Useful for making plants with modulated time to senescence

SEQ ID NO: 38563 - DNA, 704 bp, Panicum virgatum
  misc_feature: Ceres CLONE 1994466
  misc_feature: Encodes the peptide sequence at SEQ ID NO. 38564
cctttcgctcctctggccgctttgggttggggtttaagcgagtgtgcgggaggccggaggcgacgacgacggcgccggcgtcggagaagaagaagcagccagctctcgtgtatatgtcttcttgccccttctccgatctggtggtcgttgcgctcatcgtcgccgtcgtcgccgtcctcctccgcgccctcgcctgctccagccgatctatgcgcaaggggctcaacggctggaacaaatcctcgtcgatgctcagggacgggttcgggatgaagtattccggattcctccacataaggccgtgtggcttctgtcgaggagactgacggatttggtcgatttcgcccggctccgtccaatttttgcacccatcggtggaagtttcttctttttagagtttttccccttcagttttggcaattttggcttcaagttttggagtccttcccggcacaagagatagaagagagatggctccgttgaaccaccagcagattctcatcaagaaggccctggcgaagaagcccaagagcaagaggatctccaggtttggccttaaaccctccgcttctctcctcaaggccaggccgcagcagcagccaccggcgcctgtcatgccgaggcgccgcgtccgcgtcctctttgaggacactgacgcgacggactcggactcagacgacgaaggcgaggccggcacggccagg

SEQ ID NO: 38564 - protein, 77 aa, Panicum virgatum
  misc_feature: Ceres CLONE 1994466
  misc_feature: The sequence is a functional homolog of SEQ ID NO 1191 in the 10/374,780 US patent application
  misc_feature: The sequence is a functional homolog of SEQ ID NO 1383 in the 10/412,699 US patent application
MAPLNHQQILIKKALAKKPKSKRISRFGLKPSASLLKARPQQQPPAPVMPRRRVRVLFEDTDATDSDSDDEGEAGTA

SEQ ID NO: 38565 - DNA, 1247 bp, Panicum virgatum
  misc_feature: Ceres CLONE 1994478
  misc_feature: Encodes the peptide sequence at SEQ ID NO. 38566
ctcgtactgtcgtacagaccatcgccgccggcgcgccgctaccatggccgccgcccgtggccaaaccctcggccggagcagcttctcccgcgccgcatccaacccagcggcctcctcttcgggcgttgccggcgtcaagcttggtccgaacggggccatcttcgtctcttcgggcatccccgacctcgacaggattttgggtggtggattccttcttggctcagttgtaatgatcatggaagactctgatgcaccacaccaccttctgcttcttcgatgcttcatggcacagggcgttatgcacaagcagcccctgctctttgcaggacctttgaaggagccacggttgttccttggtacactgcctgctcctgtttcgtcttcaaaggaggatggaaggcgccgagtgatgggggctggagcatgtagtgatggacaaagaagtgatgagggtttgaggatagcttggcagtataagaaatattttggggatgagaaggcttctagtgctgaacataaagacaataagcaagaattcagcaatgattttgatttgaggaagcccttggaaagacatttacttaatgggcagaatattgaatgtgtaagcactcaagatgctgacaatctcagagaactccaggatcattgttccactttcttatccaagcttccaggaaaagatggtggaagtttaactgctgggagaatcgctatacaatcactctgtgcaccccagtgtggatactttgagaagaactgggacatgatccaatttatcaggtcgctgaaggccatggtgcgctcatctaattctgttgctgttataacatttccaagtacagttctgtcaaattccttttgcaggagatggcaacatcttgcagatacactgttgtcgatcaaagcgattccagatgaggacaaagacttggcaaaactcctcacaggatatcaagatatggttggttttttacacgtccataaggtggcacagactaatagccaggtccctgtgatcttagaggcatccacactttctctgaagctgcataagaggcggtcactggtgctagaacggttgaaccaggctccagtcgatgggtcaagcgggccttcatctgctgcatcaggcagttactcatcgtcacaaggctcactgcttgatttctagttcagatgcagatggtatgacagatttgactctaagacgccagcacagctgtgttacatacttgttactctag

SEQ ID NO: 38566 - protein, 376 aa, Panicum virgatum
  misc_feature: Ceres CLONE 1994478
  misc_feature (12)..(376): Pfam Name: PAXNEB Pfam Description: PAXNEB protein
MAAARGQTLGRSSFSRAASNPAASSSGVAGVKLGPNGAIFVSSGIPDLDRILGGGFLLGSVVMIMEDSDAPHHLLLLRCFMAQGVMHKQPLLFAGPLKEPRLFLGTLPAPVSSSKEDGRRRVMGAGACSDGQRSDEGLRIAWQYKKYFGDEKASSAEHKDNKQEFSNDFDLRKPLERHLLNGQNIECVSTQDADNLRELQDHCSTFLSKLPGKDGGSLTAGRIAIQSLCAPQCGYFEKNWDMIQFIRSLKAMVRSSNSVAVITFPSTVLSNSFCRRWQHLADTLLSIKAIPDEDKDLAKLLTGYQDMVGFLHVHKVAQTNSQVPVILEASTLSLKLHKRRSLVLERLNQAPVDGSSGPSSAASGSYSSSQGSLLDF

SEQ ID NO: 38567 - DNA, 723 bp, Panicum virgatum
  misc_feature: Ceres CLONE 1994490
  misc_feature: Encodes the peptide sequence at SEQ ID NO. 38568
aacatttcgcccaggtaaaactcgtttaccatttcgctctcgcaactcgcgatttcttttactgtgctcgttccggcgcgcggcggcggagctcccgacgacgacgtcgtcgagatcaagcccttcgccgccaagaggacttcctccaaagatggcttaagcaccatgactactgctggttatgatggccctgcagcaaggtcagccaaaaggaagagaaagaatcaatacaggggcatccgccagcgcccttggggtaagtgggctgctgagatcagagatcctcagaagggtgttcgtgtttggcttggtactttcaacagtcctgaggaagctgcaagagcttatgatgctgaagcacgcaggatccgtggtaagaaggccaaggttaacttccctgatgcaccaacagttgctcagaagcgccgtagtgggccagctgctgctaaagcacccaagtcaagtgtggaacagaagcctaccgtcaaaccagcagtgaacaaccttgccaacgcaaatgcatcctacccacctgctgactacacctcaagcaagccatctgttcagcatgccaatatggcatttcatctagcaatgaactctgctagtcctattgaggatccagttatgaatctgcactctgaccagggaagtaactcttttgattgctcagacttgagctgggagaatgataccaagacttcagacataacatccattgct

SEQ ID NO: 38568 - protein, 185 aa, Panicum virgatum
  misc_feature: Ceres CLONE 1994490
  misc_feature (20)..(71): Pfam Name: AP2 Pfam Description: AP2 domain
  misc_feature: Useful for making plants with altered lignin content
MTTAGYDGPAARSAKRKRKNQYRGIRQRPWGKWAAEIRDPQKGVRVWLGTFNSPEEAARAYDAEARRIRGKKAKVNFPDAPTVAQKRRSGPAAAKAPKSSVEQKPTVKPAVNNLANANASYPPADYTSSKPSVQHANMAFHLAMNSASPIEDPVMNLHSDQGSNSFDCSDLSWENDTKTSDITSI

SEQ ID NO: 38569 - DNA, 1342 bp, Panicum virgatum
  misc_feature: Ceres CLONE 1994492
  misc_feature: Encodes the peptide sequence at SEQ ID NO. 38570
aaaaaaaaacatcgcactctttctccctcttcttcttcttcttctcgaagaccggcatcacaagggcatcgatccgtccgtggtgattcaattcgtagattggagtataggtggtttgggcgcttcttcatgcgacacgtcgggtgttaaccttaccttgatgaaactgaggttctgggtttcttggtcttcgaatcggagcttgtttgcatggggtgcgtgtcctccaagcagttgaagcgagacaaaggatatgaggatcccaacatcttggcgaaggagactactttttctgtgaatgaagtggaggccctctaccagttgtacaagaagataagccattccataatcaaagacggccttattcacaaggaggagttccagcttgctctcttcagaaacagtaacaagaagaaccttttcgccgatcggatatttgatctgtttgatctcaagcgcaatggggtgattgaattcggggagtttgttcggtccctcaacattttccacccagatacaccaatggcagaaaagattgcttttgcatttcggctatatgatctgaggagtaccggattcattgaacgcgaagagttgaaggaaatggtgcttgccattctgaatgaatcagaactgattctttctgacgatgctatcgaacaaattgtggatcagacattcaagcaagcagacatgaacgacgacgggaagatagactttgaagaatggaaggcttttgcaagtaaaaacccggctttgctgaagaacatgacgcttccatacctaaaggacataaccatggcatttcctagctttgttctgaactctagagctagtgatgaagagttgtagcaccctggcaagctcccccatgctcttccatatatatttcttagtgtgcgcattgccaagctgtgaggaaggacactgctagttcaggtgactcaagtttcagacatacagcggcaacaaacccctgaaggtgcaagcacagatctgtaatttgaagggtcagattgtttggaaacaaagagccccacatccaaggccatcccgtaaattagtgctggaacaaaccataaggttgttgtaacttgtgagccggtggttccgttgagagcatggttgcaagggacagaatgatgtcaggccttcctcttttgctttgttccctggggctgtaaactggtatgtgaagtggttaattattaactgatgatgtagcaccagcttgtaactgttaagggtataatagtcaatgtacttgtgtctagggtttggggtgtgtctcatgtatatatagccctttgggcctctctcaatacatacacagttcactctc

SEQ ID NO: 38570 - protein, 213 aa, Panicum virgatum
  misc_feature: Ceres CLONE 1994492
  misc_feature (152)..(180): Pfam Name: efhand Pfam Description: EF hand
  misc_feature: SWISSPROT Homolog: EC 2.7.11.17 Calcium/calmodulin-dependent protein kinase
  misc_feature: Useful for making plants with modulated salt sensitivity
  misc_feature: Useful for making plants with modulated drought sensitivity
  misc_feature: Useful for making plants with modulated water use efficiency
  misc_feature: The sequence is a functional homolog of SEQ ID NO 2 in US patent 7250555
MGCVSSKQLKRDKGYEDPNILAKETTFSVNEVEALYQLYKKISHSIIKDGLIHKEEFQLALFRNSNKKNLFADRIFDLFDLKRNGVIEFGEFVRSLNIFHPDTPMAEKIAFAFRLYDLRSTGFIEREELKEMVLAILNESELILSDDAIEQIVDQTFKQADMNDDGKIDFEEWKAFASKNPALLKNMTLPYLKDITMAFPSFVLNSRASDEEL

SEQ ID NO: 38571 - DNA, 1275 bp, Panicum virgatum
  misc_feature: Ceres CLONE 1994505
  misc_feature: Encodes the peptide sequence at SEQ ID NO. 38572
atgccatgcccatgacacacaccactcgcaggcagcagcagccagctccccctgtggccttctcccactagtcaatactcacggtgcagtacgccacccacctcctcgccattaaagaaagaggaggcaacaaggcgagtcgcgggcagcggccggcatgacgtcgggggcggcggccgcgggcggtctggggcgcacgccgacgtggaaggagcgggagaacaacaagcggcgggagcgccggcgccgggccatcgccgccaagatcttcacggggctccgcgcgctcggcaactacaagctccccaagcactgcgacaacaacgaggtgctcaaggcgctctgccgcgaggccggctgggtcgtcgaggacgacggcaccacctaccggaagggatgcaagccgccgccggggatgatgggcccgtgctcgtcgtcgcagctgctcagcgcgccgtcctcgagctacccgagcccggtcccgtcctaccacgccagcccggcgtcgtcgagcttcccgagccccacgcgcctggaacccagcagcggcagcaccaccaacaacccgggcgccgccgccgcggcctcctcgctgctcccgttcctccggggcctgcccaacctcccgccgctccgcgtctccagcagcgcccccgtcacgccgccgctctcctcgcccacggcggcgtcgcgcccgcctaccaaggtccgcaagcccgactgggacgccgtcgccgtcgacccgttccggcaccccttcttcgcggtctcggcccccgccagccccacccgcgcgcgccggcgcgagcacccggacaccattcccgagtgcgacgagtccgacgtctgctccaccgtggactccggccgatggatcagcttccagatgtccgcggcgacgaccgcgcccgcctcgcccacgtacaacctcgtcaacccgagcagcggcgcctccgcctccacctccatggagctggacgggatggcagccgcggagttcgagttcgacaagggccgcgtcacgccgtgggaaggcgagcggatccacgaggtcgccgccgaggagctcgagctcacgctcggcgtcggcgccaagtgaagcgacggccaatctcgcaaaaagctcggatctttgagctcctgtactgcaagtctgcaatgccatgagcatcgagttccgagtaccagctgatcgcggttcttgtgagatcagcggcggcaaatgtgtagtactcctagctgcgtgacgaaattgacgacgcatttcgtgctttc

SEQ ID NO: 38572 - protein, 313 aa, Panicum virgatum
  misc_feature: Ceres CLONE 1994505
  misc_feature: Useful for making plants with modulated nitrogen use efficiency
MTSGAAAAGGLGRTPTWKERENNKRRERRRRAIAAKIFTGLRALGNYKLPKHCDNNEVLKALCREAGWVVEDDGTTYRKGCKPPPGMMGPCSSSQLLSAPSSSYPSPVPSYHASPASSSFPSPTRLEPSSGSTTNNPGAAAAASSLLPFLRGLPNLPPLRVSSSAPVTPPLSSPTAASRPPTKVRKPDWDAVAVDPFRHPFFAVSAPASPTRARRREHPDTIPECDESDVCSTVDSGRWISFQMSAATTAPASPTYNLVNPSSGASASTSMELDGMAAAEFEFDKGRVTPWEGERIHEVAAEELELTLGVGAK

SEQ ID NO: 38573 - DNA, 736 bp, Panicum virgatum
  misc_feature: Ceres CLONE 1994508
  misc_feature: Encodes the peptide sequence at SEQ ID NO. 38574
gctctctcgggcgctcctgtgacgcatcgccgccgatcactctctccccccgccgctcctctggtggaggtggagatccgcgcaggcgagggcctgctccgctcgcgttgcactggttatattcctttcagctacttgtggacgaatcaggtcagaaggagcacactcgtgtacttgactgaggagattaggtctacgcatgggggctccaaagcagaggtggacttctgaggaagaggctgctcttagaactggagtcgcaaagcatggagttggaaattggcgcacaatattgaatgatccagagcttagttccatattgcgctaccgctcgaatgttgacctaaaggacaagtggcgtaacatgaatgtaactgtcaccgcatcgggttctcgtgacaaggcgaggactgccgtgaagagaacccgagctgctcctaagaacaatgatcactcggcagcaatcatcacagttacttctgatgctgatgacgagattgttgacgcaaagcctatagcatcagtgtctgctgaagcatggaatgcttctacttcaaagaaatctcactcaaggctagacaatattataatggaggctataaagaacttgaatgagcctacagggtcacacagaactactattgctaattacattgaggagcaatattggccacctagtgattttgatcacttattatccgcaaaactgaaagacttggcctccagtgggaaattg

SEQ ID NO: 38574 - protein, 178 aa, Panicum virgatum
  misc_feature: Ceres CLONE 1994508
  misc_feature (5)..(57): Pfam Name: Myb_DNA-binding Pfam Description: Myb-like DNA-binding domain
  misc_feature: The sequence is a functional homolog of SEQ ID NO 1220 in the 10/666,642 US patent application
  misc_feature: The sequence is a functional homolog of SEQ ID NO 1221 in the 10/666,642 US patent application
  misc_feature: Useful for making plants with altered alkaloid content
  misc_feature: The sequence is a functional homolog of SEQ ID NO 1374 in the 10/666,642 US patent application
MGAPKQRWTSEEEAALRTGVAKHGVGNWRTILNDPELSSILRYRSNVDLKDKWRNMNVTVTASGSRDKARTAVKRTRAAPKNNDHSAAIITVTSDADDEIVDAKPIASVSAEAWNASTSKKSHSRLDNIIMEAIKNLNEPTGSHRTTIANYIEEQYWPPSDFDHLLSAKLKDLASSGK

SEQ ID NO: 38575 - DNA, 696 bp, Panicum virgatum
  misc_feature: Ceres CLONE 1994520
  misc_feature: Encodes the peptide sequence at SEQ ID NO. 38576
actgctcgagcgagctccagctctcaagaaaccacgccggatcatggccatggcgcctttccttcgcccgctcgtcctcgcgctcctgatcgcgtcctgcgccgcgcagcaggcgccgccggcgcagcccccgcagacgccgaacgccccgccgcaggcgcctccggctccccaggcgcctccggcgggcaacccgccgccggctccccaggcgcctccggccggcaacccgcctcccgcacccaccactcctcctccggctccgacgaccacgccgcccccggcaccgaccacccctcctccggcccccaccacgccgcccccggccccggtgactcccccgccagcccccaccacgccgccgccgtcgccgccggcctctcccccgcccgctcccaccaccccgccacccgctcccgccaccccgcccccgtccccgcccatggcgccgcctccggccacgcctcctccccccgccaccccgcctccggccgcgcccacgccagccccgagcaccgccccgacgctcccgcccgtggcgacacccgccgcgtccccgaagagccccaagaccccgagccccgccgccgcgacgtccccggcgcccgcgctctcgcccgtgggcacgccgacgaccgaagactcgggtgcgagcgcgcgcgcggccggcttcgccactgtcgtggcgttggcggg

SEQ ID NO: 38576 - protein, 215 aa, Panicum virgatum
  misc_feature: Ceres CLONE 1994520
  misc_feature: Useful for making plants with altered cell wall content and/or composition
MAPFLRPLVLALLIASCAAQQAPPAQPPQTPNAPPQAPPAPQAPPAGNPPPAPQAPPAGNPPPAPTTPPPAPTTTPPPAPTTPPPAPTTPPPAPVTPPPAPTTPPPSPPASPPPAPTTPPPAPATPPPSPPMAPPPATPPPPATPPPAAPTPAPSTAPTLPPVATPAASPKSPKTPSPAAATSPAPALSPVGTPTTEDSGASARAAGFATVVALA

SEQ ID NO: 38577 - DNA, 1747 bp, Panicum virgatum
  misc_feature: Ceres CLONE 1994527
  misc_feature: Encodes the peptide sequence at SEQ ID NO. 38578
gaccccgaatcccgagggcgccgccgccacccgtgcctgcgcctcccgccgccacccgccgccgcccgccagtcccgccaccccgtgcggccccgcctcctgccgccggccgcctgcggcactgcgcccgcggcccctgcgccctgctggtgcactgctggctgctgctgggcgcctgggcgagcgcgcgcctcccgccgccctgcgcgggcacgcggccgcggcaaacccggggcgccggcgctccccgcctggccacctcccgccgtcccgcgcacccgcacggccgccgcctcgaccctgactggactaccctagtttcaattcctaggtctgccactgcggacgagggtttggaggacggtaagcttgcagtgcgcggcgcaaaaccctagctcccggccctcttcttctctccaagtgctctcctgcctcgctgatccgcgatccaagtgctctcctgcctcgctgatccgcgatgagggtgaaggtgatatcgcgatccaccgaagagttcacgcgcgaccgcagccaggacctgcacaaagtattccgcaactatgatccagggcttcgtagtcaagagaaagccgtcgagtacactcgggcacttaatgctgcaaagttagagaagatatttgctaagccatttattggagctatggatggccatattgatgcggtatcgtgcatggccaagaaccccaatcatttgaaagcaatattttctggttcaatggatggagatattcgcctttgggacattgctgcgaggaagacagtttgccagttccctgggcaccaaggtgccgtaagaagtctaacaacatctacagatggtgatcttcttgtatcatgcggcgtggactgcactgttcgactctggaaagttccaatgcttaaaatggtggacactagtgaccgtactggagatacttcccagccatcagcagtctacacctggaagcatgcattctggggtgctgaccaccagtgggacggtaatctttttgctactgttggtgctcaagttgatatatgggatcctaacaggtcggagccaataaatagctttgaatggggtaaagatacagttctttctgtgcgctttgatcctggagactgtaatgttttgattacatcagccagtgatcggagtctaacactttatgacctgcgcatgtcatctccagctagaaagctaataatgaagacaaggtgcaattcagtatgctggaaccctagggagcccatgaacttcactgctgcaaatgaagacacaaactgctactcctttgatgctaggaggctagatgaagccaaaattgttcacaaaggccatgtttcagcagtgatggatattgactactcaccaactgggcgtgaatttgttactggttcctatgatagaacagtaaggatttttaattatcttggtgatcatagcagggagatttaccacacgaagaggatgcaaagggtattttgtgtgaagtacacctacgacgggacatatctagtctctggcagtgatgatacaaatcttcggctgtggaaatccaaagcttcggaacaacttggagttcttcttccacgggagcgcaaaaagcaagaatacctggatgctgtgaaggagcggtataagcacctcccagaagtgaagcggattgtgcggcatagacacctaccgaagccaatctacaaggcggccaacctgcggcgtacgatgattgaagccgagaaccgg

SEQ ID NO: 38578 - protein, 422 aa, Panicum virgatum
  misc_feature: Ceres CLONE 1994527
  misc_feature (99)..(137): Pfam Name: WD40 Pfam Description: WD domain, G-beta repeat
  misc_feature (279)..(317): Pfam Name: WD40 Pfam Description: WD domain, G-beta repeat
  misc_feature (56)..(95): Pfam Name: WD40 Pfam Description: WD domain, G-beta repeat
  misc_feature (193)..(232): Pfam Name: WD40 Pfam Description: WD domain, G-beta repeat
  misc_feature (361)..(422): Pfam Name: Sof1 Pfam Description: Sof1-like domain
  misc_feature: SWISSPROT Homolog: EC 2.3.1.48 Histone acetyltransferase
MRVKVISRSTEEFTRDRSQDLHKVFRNYDPGLRSQEKAVEYTRALNAAKLEKIFAKPFIGAMDGHIDAVSCMAKNPNHLKAIFSGSMDGDIRLWDIAARKTVCQFPGHQGAVRSLTTSTDGDLLVSCGVDCTVRLWKVPMLKMVDTSDRTGDTSQPSAVYTWKHAFWGADHQWDGNLFATVGAQVDIWDPNRSEPINSFEWGKDTVLSVRFDPGDCNVLITSASDRSLTLYDLRMSSPARKLIMKTRCNSVCWNPREPMNFTAANEDTNCYSFDARRLDEAKIVHKGHVSAVMDIDYSPTGREFVTGSYDRTVRIFNYLGDHSREIYHTKRMQRVFCVKYTYDGTYLVSGSDDTNLRLWKSKASEQLGVLLPRERKKQEYLDAVKERYKHLPEVKRIVRHRHLPKPIYKAANLRRTMIEAEN

SEQ ID NO: 38579 - DNA, 715 bp, Panicum virgatum
  misc_feature: Ceres CLONE 1994543
  misc_feature: Encodes the peptide sequence at SEQ ID NO. 38580
aaaaaattgtgttgcattgccgtcggttatatgaacactaccctactctagtctcttgccttgtgttgcaaaattagtaccaagaaagaagatgcggggtttgaggagctcaagcagcctactagtggcggcagcagcactgctgctcttctgctgctgcttcaccattggtagtccaactctgaacacctttcatccctcactactactcttcatctcggcagcatcgccctctccggccggcgaccccttaaggccggatcgagtccctaataattgattcaactggttctgcaggggacgccaatggcggccttaggctgggttactactcggcgagctgcccgcgcgcggaggacgtcgtcagggagcaggtggcgcagctgtacgacaagcacggcaacacggcggtgtcgtggctgcgcgccctgttccacgactgcatggtcgggtcctgcgacgcgtcgctgctgctggacacgagcgccgccgcgggcgtctccgagaagtccgccccgcggagcttcggcatgcgcaacttcaagtacgtcgacgccatcaaggcggcgctggagcgggagtgccccggcaccgtctcctgcgccgacgtgctcgccctcgccgcgcgggacggcgccgccgcgctgggcgggccgcgcgtcgccatgcgcacgggccggctggacagccgggtgagccgctacgacgaggtggg

SEQ ID NO: 38580 - protein, 90 aa, Panicum virgatum
  misc_feature: Ceres CLONE 1994543
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
MVGSCDASLLLDTSAAAGVSEKSAPRSFGMRNFKYVDAIKAALERECPGTVSCADVLALAARDGAAALGGPRVAMRTGRLDSRVSRYDEV

SEQ ID NO: 38581 - DNA, 640 bp, Panicum virgatum
  misc_feature: Ceres CLONE 1994571
  misc_feature: Encodes the peptide sequence at SEQ ID NO. 38582
ctcccaccgccacccttctctccttcccgtcctccgcatctccctttagcattctctgccccctccacccatctcctcgccgccgctgacgaccgccgccgccgccgccgccgccgcgaaccctcgcgaatctccgtcctccgggttgtgggggcacgcatggcgctccggaggctgctgcatgggagcgtcctgccgcgggtgtccggccgggcctttgccccggccgtggcgccgttctccacggaggctggggagaccgtccgcgccacgctcttcccgggtgacggcatcgggcctgagatcgccgagtccgtcaagcaggtattcaatgttgcaggtgtaccaatagaatgggaagaacattatgttggcacgaaagttgatcccagaacagagagtttcttgacatgggaaagcctggagtctgtgcgtagaaacaaagttggcttaaaaggacctatggctactcctattggaaagggccatcgatcattgaatcttacattaaggaaagagcttggtctttacgccaatgtcagaccttgcaacagcctcccaggctacaagaccagatatgatgatgttaaccttgtgacaattcgtgaaaatactgaaggagaatatagtggtcttgagc

SEQ ID NO: 38582 - protein, 160 aa, Panicum virgatum
  misc_feature: Ceres CLONE 1994571
  misc_feature (36)..(160): Pfam Name: Iso_dh Pfam Description: Isocitrate/isopropylmalate dehydrogenase
  misc_feature: SWISSPROT Homolog: EC 1.1.1.85 3-isopropylmalate dehydrogenase
MALRRLLHGSVLPRVSGRAFAPAVAPFSTEAGETVRATLFPGDGIGPEIAESVKQVFNVAGVPIEWEEHYVGTKVDPRTESFLTWESLESVRRNKVGLKGPMATPIGKGHRSLNLTLRKELGLYANVRPCNSLPGYKTRYDDVNLVTIRENTEGEYSGLE

SEQ ID NO: 38583 - DNA, 142 bp, Panicum virgatum
  misc_feature: Ceres CLONE 1994579
  misc_feature: Encodes the peptide sequence at SEQ ID NO. 38584
cgacgctggcggggccttcatcggctcgcacctcgtcgatatcctcacgcagaaccagaagcaagagggccttgttgctgataacctattccctgattcacttgactacctgaaaaaaaggatcggacaaccgccattagag

SEQ ID NO: 38584 - protein, 46 aa, Panicum virgatum
  misc_feature: Ceres CLONE 1994579
  misc_feature: Useful for making plants with altered cell wall content and/or composition
  misc_feature: Useful for making plants with altered carbohydrate content
DAGGAFIGSHLVDILTQNQKQEGLVADNLFPDSLDYLKKRIGQPPL

SEQ ID NO: 38585 - DNA, 703 bp, Panicum virgatum
  misc_feature: Ceres CLONE 1994581
  misc_feature: Encodes the peptide sequence at SEQ ID NO. 38586
accgtccagcctcgtctcctcctcctgccggtctcgtcgtctcttgagttctcacgacgccgccacgccgggagagacacacgacgccggaggcggcacgggcgcgagcaggaagaagaggcgcgcagcgagctccgccagctcgctcggtcgtttcccggtgagaggtagctcgtcgcgtcgcgccacctctgcgccgccacgccccgcgctcgctctccttccctccgggtagcgctagccacagggattgccatcgatcctggaaaacacggcaaggaagtaccagtagcgagccagagggtgaagaagatgatgatggctgaagtggccaatcacagcaagaggaaccacaccgacagctacttcagcgggaaggccatcgtcaccaccagctcggaggagttcggaagcatgacctccaagaagccgaggaacccgagcccaaggacgtctccagtgtcaccgaaggagaagaaggacaagatcggcgagagggtcgcagcgctccagcagctagtgtcaccgtttgggaagacggatacggcgtctgttctgcaggaggcgtcagggtacatcaagttcctgcaccagcagctcgaggtcctgagctccccctacatgcatgctcctccggccgccggcgccgcgcctgaggatcccgagcactacagcctccggaaccgcgggctgtgcctggtgc

SEQ ID NO: 38586 - protein, 130 aa, Panicum virgatum
  misc_feature: Ceres CLONE 1994581
  misc_feature: Useful for making plants with modulated heat sensitivity
  misc_feature: The sequence is a functional homolog of SEQ ID NO 900 in the 11/435,388 US patent application
  misc_feature: The sequence is a functional homolog of SEQ ID NO 564 in the 10/666,642 US patent application
  misc_feature: Useful for making plants with altered lignin content
  misc_feature: Useful for making plants with modulated flowering time
MMMAEVANHSKRNHTDSYFSGKAIVTTSSEEFGSMTSKKPRNPSPRTSPVSPKEKKDKIGERVAALQQLVSPFGKTDTASVLQEASGYIKFLHQQLEVLSSPYMHAPPAAGAAPEDPEHYSLRNRGLCLV

SEQ ID NO: 38587 - DNA, 715 bp, Panicum virgatum
  misc_feature: Ceres CLONE 1994587
  misc_feature: Encodes the peptide sequence at SEQ ID NO. 38588
cttcacgacacacctgagaggcaaggtcccaggagagcggaggcgacaatggcagcgtcacttcaagccgcggccacgttgatgcagccggccaaggtcggcggtcgggtctccacctcacagtcgtcccgcccgtcgtcgcacctggccagagcgttcaggttggacagcggcacggctaggatcacttgctccctccagtctgacctcaaggaggttgcgagcaagtgcgtcgatgccgccaagcttgctggcttcgcacttgccacctcggctctcctcgtctcgggcgcaagcgccgagggcactcccaagaggctgacctacgacgagatccagagcaagacgtacatggaggtgaagggtactggcaccgcgaaccagtgcccgaccatcgacggcggcgtcgactccttccccttcaagcctggcaagtacaacatgaagaagttctgcctggagcccacgtccttcaccgtcaaggccgagggcatcgccaagaacgccccgcccgagttccagaagacgaagctcatgacccgcctcacctacacccttgacgagattgagggcccgctggaggtcagctccgacggcaccctaaagttcgaggagaaggacggcattgactacgccgccgtcacggtgcagctccctggaggtgagcgcgtgccattcctcttcaccgtcaagcagctcgtggccactggcaagc

SEQ ID NO: 38588 - protein, 222 aa, Panicum virgatum
  misc_feature: Ceres CLONE 1994587
  misc_feature (95)..(222): Pfam Name: MSP Pfam Description: Manganese-stabilising protein / photosystem II polypeptide
MAASLQAAATLMQPAKVGGRVSTSQSSRPSSHLARAFRLDSGTARITCSLQSDLKEVASKCVDAAKLAGFALATSALLVSGASAEGTPKRLTYDEIQSKTYMEVKGTGTANQCPTIDGGVDSFPFKPGKYNMKKFCLEPTSFTVKAEGIAKNAPPEFQKTKLMTRLTYTLDEIEGPLEVSSDGTLKFEEKDGIDYAAVTVQLPGGERVPFLFTVKQLVATGK

SEQ ID NO: 38589 - DNA, 974 bp, Panicum virgatum
  misc_feature: Ceres CLONE 1994588
  misc_feature: Encodes the peptide sequence at SEQ ID NO. 38590
atgagacgacgagcaacggcagtcagcaacaaccgaagaccaccactgccactccagattctcgagtcagcttcagctccagctagagacctgctggagtctcctccaaccgctccgacgggccctccgccgagatcagccggcatcgccacgaaagattgatggacctgtcgccgaaccccgagagcccgggcggcggcggcggtgatggcggcggcggagccggtggatcgagcagcggcgggggggcgtcctcgtcggcgggcggcggcggcggcggcgcgccgcagacgccgagccggtacgaggcgcagaagcggcgggactggaacacgttcgggcagtacctgcggaaccaccggccgccgctgagcctggcgcagtgcagcggcgcccacgtcctcgagttcctgcggtacctggaccagttcggcaagaccaaggtgcacacggcggcgtgccccttcttcgggaacccgaacccgccggcgccgtgcccctgcccgctgcgccaggcgtggggcagcctggacgcgctggtgggccgcctcagagccgccttcgaggagaagggcggccggccggagtccaaccccttcgcggcgcgcgccgtccgcctctacctccgcgaggtccgcgagcaccaggcccgcgcgcgcggcgtcagctacgagaagaagaagcgcaagaagccgcagccgccggccgatcacgccggcggcagcggacacccgccgcctccggcgccgccgcccgccggcgcgccgtgctgaggaacgacatgcacccgccaccagcgcccatttggtatgccggactgagcatattttatgtaggtttcgatcgatttccgtgtgcatgcatgcatggtttgctgccattatttcgctcgcgatgcttcagcttcttcttcctcgatcagactctgccgatcgtgtgccgggctacattgttatttcactcctgctctctct

SEQ ID NO: 38590 - protein, 203 aa, Panicum virgatum
  misc_feature: Ceres CLONE 1994588
  misc_feature: Useful for making plants with modulated low light sensitivity
  misc_feature: Useful for making plants with modulated nitrogen use efficiency
  misc_feature: Useful for making plants with modulated flowering time
  misc_feature: Useful for making plants with modulated biomass
  misc_feature: Useful for biocontainment applications
MDLSPNPESPGGGGGDGGGGAGGSSSGGGASSSAGGGGGGAPQTPSRYEAQKRRDWNTFGQYLRNHRPPLSLAQCSGAHVLEFLRYLDQFGKTKVHTAACPFFGNPNPPAPCPCPLRQAWGSLDALVGRLRAAFEEKGGRPESNPFAARAVRLYLREVREHQARARGVSYEKKKRKKPQPPADHAGGSGHPPPPAPPPAGAPC

SEQ ID NO: 38591 - DNA, 1839 bp, Panicum virgatum
  misc_feature: Ceres CLONE 1994592
  misc_feature: Encodes the peptide sequence at SEQ ID NO. 38592
aggggggaggaggcttcggttgccatctcactctatcctcttccactccggcctagtccacgccgcctccgcctccgccacctcgccggcgaccaccgtagcatcagagattccagagctcgcgcctctcgcgcatggttcttggcttctcgcttgctcgaccagcactgtaactgactgaataagcgtggtgacgagatgatgccggtggaggcggcggcggcggaggactggtcggcgtgcgcgttctcgctcacctgcgaggaagacggcgccgacctcggcgacggctccgtcgacgacggcgagctcttctcgccctacaatgcccgcgacgaggaggaagaggagtacttagagcagctggtgttcaaggaggctagcttctgctgctcctccgactccgccgccgactgcgacggcgacggcgacggcgatgtggacggggacggggaccaccagctcgtcttctccgaggagtggttccagcaagctcgcctcgccgccgtcaagtggattcttgaaacgcgcgagtacttcgggttcggccaccggacggcgtacctcgccatcgcctacttcgatagcttcctcctccggcgatgcgtcgatagggaggccatgccgtgggcggcgcggctgctgtccgtggccgccaaattggaggagtgccaggtgccggcgctgtcggagttcgacgccggcgactacgacttctgctcggcgtccatccggcggatggagctgctcgtgctgtccacgctcgggtggcgcatgggcgccgtcacgcccttcgacttcctcccctgcttctcctcgcggctccacccgcacggcggcgccggccgcgtcgccctcaaggccatcggcttcctctttgccacggccgaagctggtagcgtgcttgatcacaggccgtccactgtggctgcagctgcaatcttggcagcaacctatggacctctactaaccaaagaggcactggattccaagatgagctatcttcctccatcttgtcttattgagaaggagcatgtacatgcttgctacagtatgatggttggagacatgaacaggaggggtaacaagagatcattgccatgttcaggctccaacgaggttgccactagtacatatgattctgttcttcttgatgatgttaccgacaacgccgcctttgcgacgggcgtggcggcgaggaataagcggatcgggctggagctgccgggcatccgttgagaagctagcaccaccggggacacaatttttagccagatgtctaggggggcttggtttgatcttcccttttttttcattcttttaacttatatgttagcaaaaaaaaggaggttttttaggttctttgagccattgccatgggttggcattggctgctgtcagattggattggtttggtttgtgtgagaggtggaagagatgaacaaagcatagggatgagctttcctatggagaggagagcttaggttaataagctcaatgccagtgcccaaatggggcacattccattcaactttacttcaaagttgcactgtttgataagtcattgtggaatgtggatgccatgttgcaatgcaatttgcattgcatatggtgagatgctgctgctgctgttgcagagaagttgcaaaacaagtggtagcaacactgaggttgagggttttaccattgtttataggagagagatgtttccttttttcacttgcgcaagtggatgtgtgagtgtttcactctgcacttgcttgggttacatcggtttgtaacaaccctgtgtacttgtgtaacctctcttgttcctgtgtaatggaatcggattgcatc

SEQ ID NO: 38592 - protein, 346 aa, Panicum virgatum
  misc_feature: Ceres CLONE 1994592
  misc_feature (68)..(194): Pfam Name: Cyclin_N Pfam Description: Cyclin, N-terminal domain
MMPVEAAAAEDWSACAFSLTCEEDGADLGDGSVDDGELFSPYNARDEEEEEYLEQLVFKEASFCCSSDSAADCDGDGDGDVDGDGDHQLVFSEEWFQQARLAAVKWILETREYFGFGHRTAYLAIAYFDSFLLRRCVDREAMPWAARLLSVAAKLEECQVPALSEFDAGDYDFCSASIRRMELLVLSTLGWRMGAVTPFDFLPCFSSRLHPHGGAGRVALKAIGFLFATAEAGSVLDHRPSTVAAAAILAATYGPLLTKEALDSKMSYLPPSCLIEKEHVHACYSMMVGDMNRRGNKRSLPCSGSNEVATSTYDSVLLDDVTDNAAFATGVAARNKRIGLELPGIR

SEQ ID NO: 38593 - DNA, 724 bp, Panicum virgatum
  misc_feature: Ceres CLONE 1994616
  misc_feature: Encodes the peptide sequence at SEQ ID NO. 38594
acggcgaattccatttctcgcttcgcttgcttccacaactcgctttcttcatcttccccccctctttcctcgcctctcggtaaccgccgtagccaagaacctgacctcaccttctcctacggcggcgccggcggctagtgctgcaccggcgtcgcgtgagatggaaaactgcagcggcgtcgtcgtcggcgggagctgcagcaagaagccgttccagttggcgcggtcgctgacgtaccaccaccaccaggggcaccggccggcggcggcgtcgacggccaagtggcggcggcaccagctcgcggacgagccgcgcgcgcagcggccgcaggcggtggtgctctacacgacgtcgctgcggggcgtgcggcgcacgttcacggactgctccgcggtgcgcgccatcctgcgggggttccgcgtcgccgtcgacgagcgggatgtgtccatggacgcctcctttcgcagggagctccaggcgctgctcgccgtgcgcggccgcgccttctccctcccgcagctgctaatcggcggccgcctcgtcggcggcgctgaagaggtgcggcatctgcacgagaccggtcagctccggcggctcctcgacggcgccgcgggccaagacccggccttcgtctgcgacgcctgcggcggtgtccgcttcgtcccctgcaccggctgcggcggcagccgcaaggtcttcgtcgaggaggaagaccgcatcgtc

SEQ ID NO: 38594 - protein, 187 aa, Panicum virgatum
  misc_feature: Ceres CLONE 1994616
  misc_feature (60)..(128): Pfam Name: Glutaredoxin Pfam Description: Glutaredoxin
MENCSGVVVGGSCSKKPFQLARSLTYHHHQGHRPAAASTAKWRRHQLADEPRAQRPQAVVLYTTSLRGVRRTFTDCSAVRAILRGFRVAVDERDVSMDASFRRELQALLAVRGRAFSLPQLLIGGRLVGGAEEVRHLHETGQLRRLLDGAAGQDPAFVCDACGGVRFVPCTGCGGSRKVFVEEEDRI

SEQ ID NO: 38595 - DNA, 1056 bp, Panicum virgatum
  misc_feature: Ceres CLONE 1994622
  misc_feature: Encodes the peptide sequence at SEQ ID NO. 38596
agagagagaggcaggcggcagggcacacaagttggcgagccgcagcgagccgagccctttattccccgaatccccgcagccaaatcgaatccaatcgccgccgcattccgcagcaccggatcgagtcgcgggaaccagcggcggcggcggcggcgatggcggcggagaagccggctccggtgcgcgtgctctactgcggcgtctgcggcctccccgcggagtactgcgagttcggccccgacttcgagcgctgcaagccctggctgcgcgcccacgcgcccggcgtctacccggacgagctcatcgcctcttcctcgtccggcggcggcggcggcgacaaggacgtggacaaggtcggggagcgcctacagggcgtggggatctcggacggctccaccagcagcgctgcaggggatgcttctgcatctaagccggaggaggtgaaacgccttcctggtggtaaggtcaagaaaaaggacaagcaggaggttgtgatggagaagattgtccgcaacaagcgcaaatgcgtcactgtggtgaaaggacttgaattgtttggtgtaaagctgagtgatgcatcgaagaagcttgggaagaagtttgcaactggagcctccgttaagggcccaactgagaaggagcagattgatgttcaaggtgacatatcatatgatattgtggagtttattacagatacgtggcctgatgtacctgagtctgccattttcttcattgaagatggaaggaaggttcctgctgcttaatgtcatatggtttacaaggcccgagaccagtggatttacaaatataatacagatacaaggcaagagcatgtctgttaagggatgcagcaaccatatgagttcatctcttgtgcgaagtcatcatcttttgcttcagtttctaggctaagttcaaaagtggtattttgtttaccaccgacatctgcttccatgtatcaaatcaatatatatattttgcaatttcctgaaagcatgttttgtcgttatgctgtttgaaaatgtactaagcagttttactgcataatcaggagcc

SEQ ID NO: 38596 - protein, 202 aa, Panicum virgatum
  misc_feature: Ceres CLONE 1994622
  misc_feature (106)..(187): Pfam Name: SUI1 Pfam Description: Translation initiation factor SUI1
MAAEKPAPVRVLYCGVCGLPAEYCEFGPDFERCKPWLRAHAPGVYPDELIASSSSGGGGGDKDVDKVGERLQGVGISDGSTSSAAGDASASKPEEVKRLPGGKVKKKDKQEVVMEKIVRNKRKCVTVVKGLELFGVKLSDASKKLGKKFATGASVKGPTEKEQIDVQGDISYDIVEFITDTWPDVPESAIFFIEDGRKVPAA

SEQ ID NO: 38597 - DNA, 722 bp, Panicum virgatum
  misc_feature: Ceres CLONE 1994634
  misc_feature: Encodes the peptide sequence at SEQ ID NO. 38598
tctcgtgctcgcctcgtccgttgcgcgttcaaatttcgaatccctcctgctcctcctcctccaactcctcgaccgcctgccatcatgagcgccgccgccgcgccagccgccatgggcagcggcaaggagctcgccaacccgccctccgacgggatctccaacctccgcttctccaaccacagcaacaacctcctcgtctcctcgtgggacaagacggtgcggctgtacgacgccgacgccaacgtgctcaagggggagttcgtgcaccccggggccgtcctcgactgctgcttccacgacgactcgtcggggttcagcgctggagcagaccacaccgtgcggaggctagtatttagttcatccaaagaagatgttctggggagacacgatggtccagttcgttgtgtggaatactcgtatgctgcaggacaagtcatcactggcagctgggataaaactgttaaatgctgggatccaagaggagtgagtggaccagagcgtacacttgttgggacatacacccaaccagaacgtgtatattctctgtcattagtaggaaataggttggttgttgcaacggcagggaggcatgtcaatatttatgatttgcgcaatatgtctcaacctgagcaaaagagagactcgtctttgaaatatcaaacacgatgcgttcgatgtttcccaaacggaacaggatatgctctcagttctgtagaagggcg

SEQ ID NO: 38598 - protein, 212 aa, Panicum virgatum
  misc_feature: Ceres CLONE 1994634
  misc_feature (92)..(130): Pfam Name: WD40 Pfam Description: WD domain, G-beta repeat
MSAAAAPAAMGSGKELANPPSDGISNLRFSNHSNNLLVSSWDKTVRLYDADANVLKGEFVHPGAVLDCCFHDDSSGFSAGADHTVRRLVFSSSKEDVLGRHDGPVRCVEYSYAAGQVITGSWDKTVKCWDPRGVSGPERTLVGTYTQPERVYSLSLVGNRLVVATAGRHVNIYDLRNMSQPEQKRDSSLKYQTRCVRCFPNGTGYALSSVEG

SEQ ID NO: 38599 - DNA, 674 bp, Panicum virgatum
  misc_feature: Ceres CLONE 1994641
  misc_feature: Encodes the peptide sequence at SEQ ID NO. 38600
gtctagcagcagcacaacacacaacggagtgaggagaccaatcaatgcataaccaggctaccagctgagctgatcacctctctcctccggccactctcccccaccgtcccgttcccacaagaatcgctctctcctcagatctcgcgagcagaacagccgaagcaagctttaggctgggtacgtaaggtagttacgagcagccatgaggcggcggccacctttccattcccgtgccgccgccgccgccgccttcgtgcttctccagctgcttctctcccccgccccgacctcccagctcggcctcggttccgccattgccgcctggatcaacggctcgccgcctccgtccccaagccctgcagccgcttcctcgtcgtcctcctcgccgagccaggagtacacggcgctgcaggccctgaaggcggccgtcaccgaggacccccgcggcgcgctgtcgtcgtggcagggccccaatgtctgctcctaccgcggcgtctactgctccgccccgcccgacgccgccgccgcggggcccaccacggccacggtggttgtggccgggatcgacctgaaccgcgccaacctccgcggcacgctccccgaggcggtctccctcctcgcccacctcaccttcctccacctcaacagcaaccgcctcgcgggggccgtcccgg

SEQ ID NO: 38600 - protein, 157 aa, Panicum virgatum
  misc_feature: Ceres CLONE 1994641
  misc_feature (62)..(101): Pfam Name: LRRNT_2 Pfam Description: Leucine rich repeat N-terminal domain
  misc_feature: SWISSPROT Homolog: EC 2.7.11.1 Non-specific serine/threonine protein kinase
MRRRPPFHSRAAAAAAFVLLQLLLSPAPTSQLGLGSAIAAWINGSPPPSPSPAAASSSSSSPSQEYTALQALKAAVTEDPRGALSSWQGPNVCSYRGVYCSAPPDAAAAGPTTATVVVAGIDLNRANLRGTLPEAVSLLAHLTFLHLNSNRLAGAVP

SEQ ID NO: 38601 - DNA, 737 bp, Panicum virgatum
  misc_feature: Ceres CLONE 1994648
  misc_feature: Encodes the peptide sequence at SEQ ID NO. 38602
agccaacccgaggtcaatccagccacagcccacccagctcgtacccagatctcccggacccgttcagcgcctgctgtagcgtcggcgatggccagcacggcggccgaggcggcgaaggcggcggagcagccggccaacggcaacggcgagcagaagacgcgccactccgaggtcggccacaagagcctgctcaagagcgacgacctctaccagtacatcctggacacgagcgtgtacccgcgggagcccgagagcatgaaggagctccgcgagatcaccgccaagcacccgtggaacctgatgacgacgtcggcggacgaggggcagtttctcaacatgctcatcaagctcatcggcgccaagaagaccatggagatcggcgtctacaccggctactccctccttgccaccgccctcgcgctccccgaggacggcacgatcttggccatggacatcaaccgcgagaactacgagctcggcctgccctgcatcgagaaggccggcgtcgcccacaagatcgacttccgcgagggccccgcgctccccgtcctcgacgacctcatcgccgacgtacggaatgctgcccgatccccttgtcccctgaccttgcccgtccagaaatggcggcccggccggtctcctggtctctgaatcctcctcctccctccgtgcgtgcaggagaagaaccacggcaccttcgacttcgccttcgtggacgccgacaaggacaactacct

SEQ ID NO: 38602 - protein, 187 aa, Panicum virgatum
  misc_feature: Ceres CLONE 1994648
  misc_feature (45)..(179): Pfam Name: Methyltransf_3 Pfam Description: O-methyltransferase
  misc_feature: SWISSPROT Homolog: EC 2.1.1.104 Caffeoyl-CoA O-methyltransferase
  misc_feature: Useful for making plants with altered carbohydrate content
  misc_feature: Useful for making plants with altered cell wall content and/or composition
  misc_feature: Useful for making plants with altered lignin content
MASTAAEAAKAAEQPANGNGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADVRNAARSPCPLTLPVQKWRPGRSPGL

SEQ ID NO: 38603 - DNA, 564 bp, Panicum virgatum
  misc_feature: Ceres CLONE 1994653
  misc_feature: Encodes the peptide sequence at SEQ ID NO. 38604
ctgcctcctttcgcttgtctcttcctctctactgccttggtcttggtttcctggctcctactactggcctaggggtggagccattcctcaccacttctccctgccctttgtccgctactaccatcccattcggtccctcacgcgagggagtatgctgtctgtacacatagtctgttgccactcgctcgacttcctcatggccacgataaaccccccgccattgctctttctgcgcgaacccaacaacgctccttctccaatcttttactcacctcttatcacatcgaacctgattgtcttcttggatgagctattcctctatgccactttccagcattggcatcgcctgtccgaccgcgatattgaaatggaccttcatcacgctcaccttgatgtcacaccacatgattccaccatgacgagtagaccacgatatgcgatcatgaacaccggcctcggtcccattactatacaaatatactcatatgcttctgctgatgttgatgatacatttaccatcttgtgcaccagtaatcacttcaaaagaatgcccttccgccatat

SEQ ID NO: 38604 - protein, 122 aa, Panicum virgatum
  misc_feature: Ceres CLONE 1994653
  misc_feature: SWISSPROT Homolog: EC 5.2.1.8 Peptidylprolyl isomerase
MATINPPPLLFLREPNNAPSPIFYSPLITSNLIVFLDELFLYATFQHWHRLSDRDIEMDLHHAHLDVTPHDSTMTSRPRYAIMNTGLGPITIQIYSYASADVDDTFTILCTSNHFKRMPFRH

SEQ ID NO: 38605 - DNA, 735 bp, Panicum virgatum
  misc_feature: Ceres CLONE 1994662
  misc_feature: Encodes the peptide sequence at SEQ ID NO. 38606
aaagtttcggcggcgtaggcagcggcggcgtgctcgtgatctcaacaccaggcgctcgcttccggtcacccgtcgctccacgcagccatgtcgaggaggaagaccagggagcccaaggaggagaatgtcacccttggccccactgtccgtgagggagagtatgtctttggtgttgctcacgtctttgcatccttcaacgacaccttcattcatgttactgatttgtctgggagggaaactctagttcggatcactggtggcatgaaggtcaaggctgatcgtgatgaatcgtcaccttatgctgctatgcttgcagctcaagacgttgcagctcgttgcaaggagcttggtatcactgcgctgcacattaagcttcgtgccactggaggcaacaaaaccaagactcctgggcctggtgctcagtctgctcttagggctcttgctcgttctggcatggacgagatggagttcaccgaggccgagagcaacatgaacgacctcgtcgccgagtaccagcagtatcaggacgccaccgccgaggagtacgacgaggaggaagtcgacggcgaggaggagcacgcctgatgaccggacttcgatcctatccgtcgtgtgcacgagtttcttcttgagcttctctcctacgctatgccatcgagaggcgctctccatatatacatttatccctactacctgaagtattgtacgtatatatgcgtgtactgccgtgtctgc

SEQ ID NO: 38606 - protein, 165 aa, Panicum virgatum
  misc_feature: Ceres CLONE 1994662
  misc_feature (28)..(124): Pfam Name: Ribosomal_S11 Pfam Description: Ribosomal protein S11
  misc_feature: Useful for making plants with modulated biomass
MSRRKTREPKEENVTLGPTVREGEYVFGVAHVFASFNDTFIHVTDLSGRETLVRITGGMKVKADRDESSPYAAMLAAQDVAARCKELGITALHIKLRATGGNKTKTPGPGAQSALRALARSGMDEMEFTEAESNMNDLVAEYQQYQDATAEEYDEEEVDGEEEHA

SEQ ID NO: 38607 - DNA, 1359 bp, Panicum virgatum
  misc_feature: Ceres CLONE 1994668
  misc_feature: Encodes the peptide sequence at SEQ ID NO. 38608
atggctgcgcacgcgatgcgactgggtccttggttttaccggtttcctcgctccctttctatacgcgctttgcattccttgctccatttctactcgcctgcatcaacgtggatatatattgccttctgccctccggcgccgccaactccttcatcttcctggtgtgctccagttcttggccgatccccacccgcggatcccgcgatcttgcctgacttcgtccaggggcgacagtttccgcgacaagaggccgccttcccgtctgtcagcatgagcgggaagcgatccttcttcgcatccaagaagaaggccaccaatcctttcgattccgactccgacgacggcgacaagaagcagcagcggccggcgcgggcctcctccgtgccgcccccggcccaacagcgggtcgccctcttcggcgccggcgccggcggccaagaaaggggcgggctcttctcctcctcggaggcgccgaggaacagccactaccgaaacgacttccgcgacgctggcggcctggagagccagtcagttcaggagctggagggctacgcggcgtacaaggccgaggagaccacaagccgggttcagggatgcgtcagaatagccgaggagatgagggataccgcgtccaagaccctcgtcaccgtccaccaacaggggcagcagatccaccgcacgcacatgatggccgtcgacatcgaccaggacctctccaggagtgagaagctcttgggtgatcttgggggcctattttccaagaagtggaagccaaagaaaaacggcacaatcaagggtcctatgctatctagagatgactccttcataagaaggggcagtcatttggagcaaaggcagaaattagggctggtcgatcatcctcctcgatcggatgcgcgcaaatttcattctgaaccgacatcggcacttgagaaagttgagatggagaaagcaaatcaggatgatgctctgtctgatctaagcgacatactgaccgagctgaaagggatggccattgacatgggctctgagattgagaggcaaacaaagtcaatgggagatgcagaaaaggattatgacgagctgaacttcagggttaagggagcaaacactcgagctcgccatctgcttggcagataaaaaagctacgagtttttgtctctagatgttctatatgtcattgactaatcttgagggtgctctcaactcctcctttccactatatggagatcaattctgatggttttgtgcatcgaattttgatcagaatggttggctgtggacatttcagcgtgtattgtacatatgccattagacactattgtattctttatattttacccttttcctttatctgcc

SEQ ID NO: 38608 - protein, 289 aa, Panicum virgatum
  misc_feature: Ceres CLONE 1994668
  misc_feature (229)..(288): Pfam Name: SNARE Pfam Description: SNARE domain
MSGKRSFFASKKKATNPFDSDSDDGDKKQQRPARASSVPPPAQQRVALFGAGAGGQERGGLFSSSEAPRNSHYRNDFRDAGGLESQSVQELEGYAAYKAEETTSRVQGCVRIAEEMRDTASKTLVTVHQQGQQIHRTHMMAVDIDQDLSRSEKLLGDLGGLFSKKWKPKKNGTIKGPMLSRDDSFIRRGSHLEQRQKLGLVDHPPRSDARKFHSEPTSALEKVEMEKANQDDALSDLSDILTELKGMAIDMGSEIERQTKSMGDAEKDYDELNFRVKGANTRARHLLGR

SEQ ID NO: 38609 - DNA, 725 bp, Panicum virgatum
  misc_feature: Ceres CLONE 1994674
  misc_feature: Encodes the peptide sequence at SEQ ID NO. 38610
cgatgcgaccgccctcgctgctctccctcaccctcgactcggcgctcctccgcatcgcccacatcgccgacatctcccacctccccgaccacctcgtcatcgacctcttccgtagaaccctgagtgctggtaagctgaccgagaaagttctgaagttgtttctggcaaccggctgtgaggaaatcatcttggccgttcaattgctaaacattaagcaaccactcgtaccagtgcttcccacaaggtgttccgagaggttctaggcctgttggtgcttagatcattttgattaccttacctgagaagatgtcttcggtaattcaagacagtgaggttgacattgtgattgcagcactccagcccaatctgaccaccttctttgaagcatggcggccatttttctctcgtttccacgtcattgttgtcaaagatccagacatgacacagaatcttcaaatccccactggctttgatctcaaggtttacacaaagtcagatattgatggagtgcttggcgccacgtccatcaacttctctggtcactcatgccgttactttgggtatcttgtctcacggaagaagtatgtgatttcaatcgatgacaattgcctcccagcgaaggacactgttgggtccactgttgatgctgttgcacagcacatggccaatttgaagacacctgccacacctttcttttttcacacgctttatgatccataccggaa

SEQ ID NO: 38610 - protein, 139 aa, Panicum virgatum
  misc_feature: Ceres CLONE 1994674
  misc_feature (1)..(139): Pfam Name: RGP Pfam Description: Reversibly glycosylated polypeptide
MSSVIQDSEVDIVIAALQPNLTTFFEAWRPFFSRFHVIVVKDPDMTQNLQIPTGFDLKVYTKSDIDGVLGATSINFSGHSCRYFGYLVSRKKYVISIDDNCLPAKDTVGSTVDAVAQHMANLKTPATPFFFHTLYDPYR

SEQ ID NO: 38611 - DNA, 1411 bp, Panicum virgatum
  misc_feature: Ceres CLONE 1994679
  misc_feature: Encodes the peptide sequence at SEQ ID NO. 38612
aatccaatccaatccattcccttccacagattgaccgagagggccaagatcccgattggttggttggtaggtggggtgggggcgagggaaagcggcggcgagagcgggattgatgcgcgcatggcgctgcgggcgcggctgacaggacccgcggtacccggtctcgttcgcgtacctgatctcggcgtcgtcgggggacgcggcccgcgcggcgcggctgctggcggcgctctaccacctggccaacacctacctgctgcacctggaccgggaggcgcccgcgggggagcaccgccgcctggcggagctcgtgtcggcgcgggccgtgtacgcgcgcgcgggcaacgtctgggtcgtcggccgccccaacctcgtcacctaccggggccccaccatgctcaccaccacgctgcacgccgtcgcgctgctgctccgcctgcgccgccgctgggactggttcgtcaacctcagcgcgtccgactacccgctcgtcacccaggacgacatgatggaggccttcgccgggctgcccagggacctcaacttcatccagcacaccagccacctcggctggaagataaagaagcgggcgcggccggtgatcctggacacggcgctgtacgaggacgggcgggcggagctcatccggccggagaacatcaccaccaacctccggaggttgcccacggccttcaagctctacacagggtccgcgtggacgatgctgtcgcgtcccttcgccgagtacgtgacgatggggtgggacaacctcccccggaccctcctgctgtaccacgccaacatcgtctcctcgccggagttctacttccagacggtggcctgcaactcgctgcggttccgcaacgccaccgtcaaccacgacctgcacttcatccgctgggacaacccgcccaagcagcacccgctgcacctcaccgccagggactaccgccggatgctgctcagcggcgcccccttcgcgcgcaagttccgggagggcgacccggtgctggaccggatcgaccgcgacatcctgcgccggcgcgggcccggccagttcgcctacggcgggtggtgcgccggggacggggacggggacgggggcggagacggcggcgcggcggcgctgtgcggcagcaacccgcaggagccccggaggaagggggccgtcagggccggcgccggggcgcgccggctcaaggtgctgctgggcaaggcgctggccccggggaatctcaggagaaggcagtgtaggtgaaataaatttgttttgggctttttattcacagggtggactgattctgatcaaacatgacatgtatagcgaaagggacaacgacttgaattacaggcaattttggttcggaaggaccctaaaattttctgaggtgaaattttcaggaattctact

SEQ ID NO: 38612 - protein, 287 aa, Panicum virgatum
  misc_feature: Ceres CLONE 1994679
  misc_feature (1)..(153): Pfam Name: Branch Pfam Description: Core-2/I-Branching enzyme
  misc_feature: SWISSPROT Homolog: EC 2.4.2.26 Protein xylosyltransferase
  misc_feature: Useful for making plants with altered carbohydrate content
MLTTTLHAVALLLRLRRRWDWFVNLSASDYPLVTQDDMMEAFAGLPRDLNFIQHTSHLGWKIKKRARPVILDTALYEDGRAELIRPENITTNLRRLPTAFKLYTGSAWTMLSRPFAEYVTMGWDNLPRTLLLYHANIVSSPEFYFQTVACNSLRFRNATVNHDLHFIRWDNPPKQHPLHLTARDYRRMLLSGAPFARKFREGDPVLDRIDRDILRRRGPGQFAYGGWCAGDGDGDGGGDGGAAALCGSNPQEPRRKGAVRAGAGARRLKVLLGKALAPGNLRRRQCR

SEQ ID NO: 38613 - DNA, 681 bp, Panicum virgatum
  misc_feature: Ceres CLONE 1994682
  misc_feature: Encodes the peptide sequence at SEQ ID NO. 38614
aaacaaactcgcccccgccccccacctccgcacgccgcggccgccggtgccctcctgcctccttttccccgtgcgcaaattcgcccgcatcggcggccgccaccgcttcggccgcgcacggaggcggcgaggaaggccggccgcgccgcggcatctcctccatttgtcgttcctctcgcggggcggcggcgcctcttgtgggtaggcctggggggcgggcccatggcggcggcggcggatacgtcggaggcgtccgccgccgggatcgcgctcgcggaggccaacatccactgggagaggttggacaagacgaggtttcatgtgatcggggctatcctgtttacagcccagcaaggtgctctgcacccaacagctgttgtgaagactaggatgcaggttgctgaaggggggcttgcacacatgtctggatttgctgtttttaggaggatattgagaagcgatggcatccctggtgttttcagaggctttagcacctctgcagttggagctctacctgggcgagtacttgctctaacatcactggaggtctccaaagaaatgacatttaaatactcagaacgttttgatatgtcagaggcatcaagaattgctttagcaaatggtgttgcaggcctagtttcgagtatctgttcaagctcatattttgtgcctctagatgtg

SEQ ID NO: 38614 - protein, 152 aa, Panicum virgatum
  misc_feature: Ceres CLONE 1994682
  misc_feature (33)..(118): Pfam Name: Mito_carr Pfam Description: Mitochondrial carrier protein
MAAAADTSEASAAGIALAEANIHWERLDKTRFHVIGAILFTAQQGALHPTAVVKTRMQVAEGGLAHMSGFAVFRRILRSDGIPGVFRGFSTSAVGALPGRVLALTSLEVSKEMTFKYSERFDMSEASRIALANGVAGLVSSICSSSYFVPLD

SEQ ID NO: 38615 - DNA, 735 bp, Panicum virgatum
  misc_feature: Ceres CLONE 1994698
  misc_feature: Encodes the peptide sequence at SEQ ID NO. 38616
ctaccttcgcaaatctcacagccgtccaatacataaacctgtcatacaacaatctcacaggcacaattcctgacgtgctgtcgcagttaccttcactaacaactcttgatttgacgggtaacaaccttagtggatcaattcctcctggacttcgaaaaaagattcaagatggcgtcttaaaaataaaatatgacaacaacccaaacttatgcacccatggcgattcatgtacgacaaccaaagagaagagtaggctaggcatctacattgctgttcctgtagctgtgactttgctggtagtatcagtgatagtacttgttttcttgctaaagcgaaaaaggaaagatgacgcgcacagttcgctgcagctccagaaccggcggttcacctataaggagctggagatggccacgaaaaactttcgaaatgtgatcggccagggtggcttcgggaaagtctaccatggatccttggaggatgacactcaggtggcagtgaagatgccatccaagtcatcgcccaaacaggttatggagcagttcctcatggaggctcagatcttaacaaggattcatcataagaatctcatttccttgatcggatactgcaaagatgagaagcacgtggcacttgtctacgagtacatgtctaaaggaaacctcgaatatcacatcaaagaacaaaatttaacatggagacagagagtccaaatagcgctggaatcagcacaagggc

SEQ ID NO: 38616 - protein, 244 aa, Panicum virgatum
  misc_feature: Ceres CLONE 1994698
  misc_feature (139)..(244): Pfam Name: Pkinase_Tyr Pfam Description: Protein tyrosine kinase
  misc_feature: SWISSPROT Homolog: EC 2.7.11.1 Non-specific serine/threonine protein kinase
TFANLTAVQYINLSYNNLTGTIPDVLSQLPSLTTLDLTGNNLSGSIPPGLRKKIQDGVLKIKYDNNPNLCTHGDSCTTTKEKSRLGIYIAVPVAVTLLVVSVIVLVFLLKRKRKDDAHSSLQLQNRRFTYKELEMATKNFRNVIGQGGFGKVYHGSLEDDTQVAVKMPSKSSPKQVMEQFLMEAQILTRIHHKNLISLIGYCKDEKHVALVYEYMSKGNLEYHIKEQNLTWRQRVQIALESAQG

SEQ ID NO: 38617 - DNA, 696 bp, Panicum virgatum
  misc_feature: Ceres CLONE 1994704
  misc_feature: Encodes the peptide sequence at SEQ ID NO. 38618
ctgctgatcagaccaccaccggggtaccccattgtcgccgactccgacgagctccggtcccgcgcgccggcgaccatggagttcgtcgacccctgggacacccagtcccgcgctcgcgtcgtccattccggcgccaactccacctcctccccctcgtccaccgccgccggagcgtccccctccctcccccacgccgtatcttgcgccgccgcggccgtcgcgctcctggccgccgcgtactacctccccccggcctaccagatcctcgcatccctcctcgtgtgggtcgcttcctccctcctcctcgcccccttcgtgccatcctcggccactggcggcgacatctccgtcggccgaggccgcctcctccccgccgaagaagcgtcccaagaaccggtccctgaccccgcccccgcccccgctccccgccgcgctcgtcggcagaacccggccccgacgcccgcgaagtcctcagatccggccgcggctcccgtccaaccggctgcgtcgctgcagccgctgcagaaggctgcggctgcgggtggggccgtcgtggatggcggcgagagggaggaggacgccggcgagtggaccgatcatgagctggagctcctccggcggcagatggtgaagcacccggcgggggagcccaagcggtgggagaagatcgccgcggtgttcggcggccgccgcacg

SEQ ID NO: 38618 - protein, 206 aa, Panicum virgatum
  misc_feature: Ceres CLONE 1994704
  misc_feature: Useful for making plants with altered alkaloid content
MEFVDPWDTQSRARVVHSGANSTSSPSSTAAGASPSLPHAVSCAAAAVALLAAAYYLPPAYQILASLLVWVASSLLLAPFVPSSATGGDISVGRGRLLPAEEASQEPVPDPAPAPAPRRARRQNPAPTPAKSSDPAAAPVQPAASLQPLQKAAAAGGAVVDGGEREEDAGEWTDHELELLRRQMVKHPAGEPKRWEKIAAVFGGRR

SEQ ID NO: 38619 - DNA, 675 bp, Panicum virgatum
  misc_feature: Ceres CLONE 1994712
  misc_feature: Encodes the peptide sequence at SEQ ID NO. 38620
aagccaaagccgcaactgctgcaagctgaggtcgccaccacgccccccacaccccccgagagccacgcgccatgcccccgaccccgacccccgccgccgccgccgcgcccggcgccgccgcggcgccggaggaggcgtcgttccgcctcgtgggccaccgcggcttcgtccgcgtcaacccgcgctcggaccgcttccacgcgctcgcgttccaccacgtcgagctctggtgcgccgacgcggcgtcggccgcgggccgcttctccttcgggctcggcgcgccgctcgccgcgcggtctgacctctccacggggaactccgcgcacgcctcgctcctgctccgctcgggctccctcgcgttcctcttcaccgcgccctacgcgcgcggcgccgaccccgccaccgcgaccctgccctccttctccgcgcccgccgcgcggcgcttcgcggccgaccacggcctcgcggtgcgcgccgtggcgctccgcgtcgccgacgccgaggacgccttccacgccagcgtcgccgccggggcgcgcccggcgttcgagcccgtcgagctcggcctcgggttccgcctcgccgaggtcgagctctacggcgacgtcgtgctccgctacgtcagctacccggacgccgcgggcgcgcccttcctgccgggcttcgaggacgtga

SEQ ID NO: 38620 - protein, 201 aa, Panicum virgatum
  misc_feature: Ceres CLONE 1994712
  misc_feature: SWISSPROT Homolog: EC 1.13.11.27 4-hydroxyphenylpyruvate dioxygenase
  misc_feature: Useful for making plants with altered tocopherol content
MPPTPTPAAAAAPGAAAAPEEASFRLVGHRGFVRVNPRSDRFHALAFHHVELWCADAASAAGRFSFGLGAPLAARSDLSTGNSAHASLLLRSGSLAFLFTAPYARGADPATATLPSFSAPAARRFAADHGLAVRAVALRVADAEDAFHASVAAGARPAFEPVELGLGFRLAEVELYGDVVLRYVSYPDAAGAPFLPGFEDV

SEQ ID NO: 38621 - DNA, 720 bp, Panicum virgatum
  misc_feature: Ceres CLONE 1994719
  misc_feature: Encodes the peptide sequence at SEQ ID NO. 38622
atcgcctctcctcctccgcgccgccacttcctctctctctctcgcgagctccccacggtttcgcgcgagatctagctagggttcgggtttttctggggaccggcggcgatggcgaccgagcaagcggcggagaactacacggtggaggacctcgtggccttgaatccctacaaccccgacatcctcaacgacctcgagaagttcgtcaacgagcaggtctcgtctcaaacatataacttggatgcaaatctcagcctccttcgcttgtaccagtttgagccagaaaggatgagcatacagattgtagcccgcatattgattaaggctctcatggcaatgccagcccctgacttcagtctgtgcttgttcttaatccctgaacatgtgcaaatggaggagcaatttaagacattgatagttctttctcactacctggagactgctagattccgtcagttctgggatgaagcagcaaagaaccgccacatattggaagttgttccaggatttgagcaggctatccaaacctatgcgattcatctgctttccttgacataccagaaagttccgaggcctgttcttgcggaggctatcaacattgaaggcctcgcattggacaagtttctggagtaccatgccacgaactcaggttgggtgattgagaagggtggacagtctcaagtgattgttcttccgcgcaacgagttcaatcaccctgag

SEQ ID NO: 38622 - protein, 203 aa, Panicum virgatum
  misc_feature: Ceres CLONE 1994719
  misc_feature (19)..(164): Pfam Name: SAC3_GANP Pfam Description: SAC3/GANP/Nin1/mts3/eIF-3 p25 family
MATEQAAENYTVEDLVALNPYNPDILNDLEKFVNEQVSSQTYNLDANLSLLRLYQFEPERMSIQIVARILIKALMAMPAPDFSLCLFLIPEHVQMEEQFKTLIVLSHYLETARFRQFWDEAAKNRHILEVVPGFEQAIQTYAIHLLSLTYQKVPRPVLAEAINIEGLALDKFLEYHATNSGWVIEKGGQSQVIVLPRNEFNHP

SEQ ID NO: 38623 - DNA, 733 bp, Panicum virgatum
  misc_feature: Ceres CLONE 1994721
  misc_feature: Encodes the peptide sequence at SEQ ID NO. 38624
agttctcctccgatccagcttctgcaagactgcaagcgcgcgccgcccctcaccgccggcttctgcccctcctcctcctcctcccctgccgccgccccgcagttggacacgctcgcctcgccggagatcatgtaccgcgccgcggggagccacctccgctccctcaagcatcacggtgctaccaggcttgctagtacaagtgttgtgaagcagtcccaaggtggtcttttcggctggcttcttgggggaaaatcaagccaacttcctcccctagatgttccgctaacaggcattactattcccccacctctaccagactacgtagaaccatctaagacaaaaatcactactcttccaaatggcgtcaagattgcctcggaaacgtcaccgagcccagcagtctcagtgggtctgtatattgactgtggttccatttatgaaacacccgtttcatctggagtctcccatctattggagagaatggccttcaagagcacagtaaatcgaagtcacttacggctagttcgtgaggtagaagccattggaggaaatgtctccgcgtcagcttcccgtgagcaaatgagctatacctatgatgcattgaagaactatacaccagaaatggttgaagttctcattgatagtgtgaggaatccagcttttctcgaatgggaggtcaaagagcagctccagaagatcaaatctgaaatagctgaagtgtctgctaatcctc

SEQ ID NO: 38624 - protein, 201 aa, Panicum virgatum
  misc_feature: Ceres CLONE 1994721
  misc_feature (80)..(201): Pfam Name: Peptidase_M16 Pfam Description: Insulinase (Peptidase family M16)
  misc_feature: SWISSPROT Homolog: EC 3.4.24.64 Mitochondrial processing peptidase
MYRAAGSHLRSLKHHGATRLASTSVVKQSQGGLFGWLLGGKSSQLPPLDVPLTGITIPPPLPDYVEPSKTKITTLPNGVKIASETSPSPAVSVGLYIDCGSIYETPVSSGVSHLLERMAFKSTVNRSHLRLVREVEAIGGNVSASASREQMSYTYDALKNYTPEMVEVLIDSVRNPAFLEWEVKEQLQKIKSEIAEVSANP

SEQ ID NO: 38625 - DNA, 743 bp, Panicum virgatum
  misc_feature: Ceres CLONE 1994723
  misc_feature: Encodes the peptide sequence at SEQ ID NO. 38626
aagccgagcaacgcagagaaaggcgtcttcgtactcgcctctctccgcgactcgaagctttccccccaacccaccgccgccgccccacccttccgtcgacaccatgagggagtgcatctcgatccacatcggtcaggccggtatccaggtcggaaacgcgtgctgggagctctactgcctcgagcatggcattcaggctgatggccagatgcctggtgacaagaccattggaggaggtgatgatgctttcaacaccttcttcagtgagactggcgctgggaagcacgtcccccgtgctgtatttgttgaccttgagcccactgtgattgatgaagtgaggactggcacttaccgccagctcttccaccctgagcagctcatcagtggcaaggaggatgctgccaacaacttcgcccgtggtcactacaccattggcaaggagattgttgacctgtgccttgaccgcatcaggaagcttgccgacaactgtactggtctccagggcttccttgtcttcaacgctgttggtggaggaacaggctctggtcttggttccctcctccttgagcgcctgtctgttgactatggcaagaagtccaagctcgggttcactgtgtacccatctccccaggtctccacttcagtggttgagccatacaacagtgtcctgtccacccattccctcctggagcacactgatgttgctatcctgctcgacaatgagggcatctatgacatctgcc

SEQ ID NO: 38626 - protein, 213 aa, Panicum virgatum
  misc_feature: Ceres CLONE 1994723
  misc_feature (49)..(213): Pfam Name: Tubulin Pfam Description: Tubulin/FtsZ family, GTPase domain
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAILLDNEGIYDIC

SEQ ID NO: 38627 - DNA, 711 bp, Panicum virgatum
  misc_feature: Ceres CLONE 1994726
  misc_feature: Encodes the peptide sequence at SEQ ID NO. 38628
  misc_feature (629)..(629): n is a, c, t, g, unknown, or other
ttcggctgccaggagaagcagccgccgccgccgccgcttcgacagccaccgcagggtaccaagatgtttgcaacgcaatctcttatggcccaattgggtggatgatgaggggagaaatgcgacttgtggcccaaaggttccatccaccggcccaagtctgaatcgcctctacccacacaagcggacgcgtcctctgatctctgcttccgccgccgccgccaccgcctcctcttccggcaacccttccacttgacatggctgcggccccgccggcgttcaccggtaacctgaagaaagcacttgcaggtttaaggagaatcaatttagatgggctgcgttggcgtgtatttgatgcaaagggccaggtgcttggacggttggcatcccaaatagctgttgtgctacaagggaaggataaaccaacttatgcaccacatgtggaaaatggagacatgtgcattgtgctaaatgccaaggatatcagtgttacaggaagaaaaatgaccgataagatttactactggcacacagggtacattggccatctaaaggaaagaagactcaaggaccagatggagaaagacccaactgaggtgattcgcaaagctgtcctgcgcatgcttccccgncacaggctgcgtgatgacagggatcgcaagctgaggatattttctggaaatgagcatccattgcacgaccgccctcttgaac

SEQ ID NO: 38628 - protein, 152 aa, Panicum virgatum
  misc_feature: Ceres CLONE 1994726
  misc_feature (29)..(149): Pfam Name: Ribosomal_L13 Pfam Description: Ribosomal protein L13
MAAAPPAFTGNLKKALAGLRRINLDGLRWRVFDAKGQVLGRLASQIAVVLQGKDKPTYAPHVENGDMCIVLNAKDISVTGRKMTDKIYYWHTGYIGHLKERRLKDQMEKDPTEVIRKAVLRMLPRHRLRDDRDRKLRIFSGNEHPLHDRPLE

SEQ ID NO: 38629 - DNA, 694 bp, Panicum virgatum
  misc_feature: Ceres CLONE 1994739
  misc_feature: Encodes the peptide sequence at SEQ ID NO. 38630
gaaaagctttgtctaccgcgacaagaaacgtcaaataatcagctcgttcaccaatcaccactcacaactactccccagttcccatccacactcgccatggatccgagctcggaagtcatactggactgtccgttcttccgcatctacagcaaccggcgcatcgaccgcctgatcggcaccaccaccgtgccgcccagcttcgacggcagcaccggcgtcacgtcgaaggatgtcgtcatcgacggcgacacaggcctctacgttcgcctctacctcccggacacggcctcccggtccgacgccgaggacacggccttccggtccgacgccgacagcaagaagctccccgtgctggtctacttccacggcggcggcttcgttacccagtcggcggcgtctccggtgtaccagcgcttcctcaactccctggccgcgagggccggcctgctcgtcgtctccgtcaactaccgcctcgcgcccgagcaccctctgccggccggctacgaggactcgctccgcgcgttcaagtgggcggtctctgacggcggggatccctggctgtcgcagcacggcgacctcggccgcctcttcctggccggcgacagcgccggcgggaacatcgtccacaacgtcgcgatgatggccgcggccgaaggcgaggcgggctcggcggcgggggcgcggatcgagggcg

SEQ ID NO: 38630 - protein, 199 aa, Panicum virgatum
  misc_feature: Ceres CLONE 1994739
  misc_feature (86)..(197): Pfam Name: Abhydrolase_3 Pfam Description: alpha/beta hydrolase fold
  misc_feature: SWISSPROT Homolog: EC 3.1.1.79 Hormone-sensitive lipase
MDPSSEVILDCPFFRIYSNRRIDRLIGTTTVPPSFDGSTGVTSKDVVIDGDTGLYVRLYLPDTASRSDAEDTAFRSDADSKKLPVLVYFHGGGFVTQSAASPVYQRFLNSLAARAGLLVVSVNYRLAPEHPLPAGYEDSLRAFKWAVSDGGDPWLSQHGDLGRLFLAGDSAGGNIVHNVAMMAAAEGEAGSAAGARIEG

SEQ ID NO: 38631 - DNA, 681 bp, Panicum virgatum
  misc_feature: Ceres CLONE 1994758
  misc_feature: Encodes the peptide sequence at SEQ ID NO. 38632
accacacaaccaaccacactagcactgagctagctagctaccagccaagatggcggccaagcgtctggcgcttgccatcctcgtcctccttagcgtaggcatggtggccgctgctgctggcacccgcaagctgggctatggctccggaggaggaggaggcggtggcggtagcggtggaggcggagggggtggctatgggggatcaggctatgggtccgggtcagggtacggtgagggcggtggaagtgggggtgctgctggtgggtacggacatggcggtggcggcggaggcggtggcggtgagggcggcggtgctggcggctctgggtatgggtctggccaaggctctggctatgggtccggcagtggtggtgctggtgggtatggaagtggtggaggcgggggaggtggcggcggccaaggtggtggttccggctatggccatggaggtggcgagggttatggctccggctccggctatggaggtggtgctagtggtggcggcggcggcggtggacacggtggcggcggcggtggtggccaaggtgggtcgggtcatggctccggctccgggtacggatcatgtgaaggttatggcatgctcggacaagcaggaagtggcaagctgcgtgtctcagctggacaaagcaaacttgccgctaaagtggccaagaaattcaa

SEQ ID NO: 38632 - protein, 210 aa, Panicum virgatum
  misc_feature: Ceres CLONE 1994758
  misc_feature (1)..(98): Pfam Name: GRP Pfam Description: Glycine rich protein family
  misc_feature: Useful for making plants with altered lignin content
  misc_feature: Useful for making plants with altered alkaloid content
MAAKRLALAILVLLSVGMVAAAAGTRKLGYGSGGGGGGGGSGGGGGGGYGGSGYGSGSGYGEGGGSGGAAGGYGHGGGGGGGGGEGGGAGGSGYGSGQGSGYGSGSGGAGGYGSGGGGGGGGGQGGGSGYGHGGGEGYGSGSGYGGGASGGGGGGGHGGGGGGGQGGSGHGSGSGYGSCEGYGMLGQAGSGKLRVSAGQSKLAAKVAKKF

SEQ ID NO: 38633 - DNA, 1240 bp, Panicum virgatum
  misc_feature: Ceres CLONE 1994768
  misc_feature: Encodes the peptide sequence at SEQ ID NO. 38634
aatcatgtcgcggccgccgccgccgatgctctccgtcccggagaagaagacggccgccgccgagctcttccgcgaccggcacttcttcagcgccaccgccttctccgacgtccgcgacgcccgcgccgccgtcgccgtcccgaaccctcaggcccagccgccggcctcccgccgggccctgatcctccgctaccaccgcctcctcttctccgcgcgcgatgatccctgcgccttcgacgagaacctctccttcacctggcatgacgccttccggccccacctgaagcacgccgccgcgtccctccgcttcgagaaggccgccctcgtcttcaacatcggcgcggccgcctcggggatcgcggcggcccacagccgggtcacggaggaaggggtcagggcggcgtgcggggagttccagcgcgctgcgggggcgttccgcgcggtaggagagatgatggaagaggaggcggcgacgactgtggatatgagctcgcaggccactgcgatgctggagcggcttatgctcgcgcaggcgcaggagtgctgtttcgagcgcgctctcgcaggggggaagtcgccggcggtgtgctccaaggtggccaggcaggctgccttgtactatgaagaagcttatgcaatacttgtcgctcctccacttcagaaccacttcgaaagattatgggtatctcaggtccaattgaaggctgctctgttcaatgcagaagcttgctataggtacgctattgatctccatgagaagacagaaattggtgaggagatagctcgattgcaggtcggaattaatgcaattgctgatacaaagagaactgcaagaggagcccctggacctctgtatgattatgcttccagactagaacaagatatgaacaagagtttagagacagcaaaagaagagaattatcgggtctatcttttccgtatcccagctgccgcatcactggctcctctatcagcagcttcccttgttcgttctgcgtccctgagtgagattttagaggcaaaatcagaaaatgacactcaatctccataaatggatgctttgagattgtgaaattatagaaggtacgctcactaccgtttgcatttggatgtaaaggttgtcatcgctgcaaatttggaaggtcgataatgtttactatcattattattttattcattgttgtctaaatgggtgcagaattttgtattggtaactggtcaaaatcaccgttttgcttcg

SEQ ID NO: 38634 - protein, 348 aa, Panicum virgatum
  misc_feature: Ceres CLONE 1994768
  misc_feature (7)..(345): Pfam Name: BRO1 Pfam Description: BRO1-like domain
  misc_feature: SWISSPROT Homolog: EC 3.1.3.48 Protein-tyrosine-phosphatase
MSRPPPPMLSVPEKKTAAAELFRDRHFFSATAFSDVRDARAAVAVPNPQAQPPASRRALILRYHRLLFSARDDPCAFDENLSFTWHDAFRPHLKHAAASLRFEKAALVFNIGAAASGIAAAHSRVTEEGVRAACGEFQRAAGAFRAVGEMMEEEAATTVDMSSQATAMLERLMLAQAQECCFERALAGGKSPAVCSKVARQAALYYEEAYAILVAPPLQNHFERLWVSQVQLKAALFNAEACYRYAIDLHEKTEIGEEIARLQVGINAIADTKRTARGAPGPLYDYASRLEQDMNKSLETAKEENYRVYLFRIPAAASLAPLSAASLVRSASLSEILEAKSENDTQSP

SEQ ID NO: 38635 - DNA, 1482 bp, Panicum virgatum
  misc_feature: Ceres CLONE 1994772
  misc_feature: Encodes the peptide sequence at SEQ ID NO. 38636
ccatggctccatgcagagctacaattcactaaaacatgtattcattcctttaattctgatagcaaataagaacgtcaacctatcaagtaataaccttccatagagagagcagtatctgattgagagcttagccttacatttgatagctcaacttatcaactgctcactaacctgatattaccagaatctaatcgagctggtcccaaccaaaagccagtgagctttggctaatctttggcagatgcaaaagggctgatatataatagtgggctcagggtccttaactcattatcattcttgttcagtttaaattgagcgatagtgttgatgtaggtgcggggcaactgaaccgcacaagcactctcctctattttatcttctgtttttattagatttaccttgacacagataacagtcatattactagtttgtaatgctactcaagggttaagaataggcagtcccattaaactatttctgttaacatgaatttcaaaatgttctgcttcgcctactgctcattccttgcaaatgcagccgctgatgttgacttgcacatgagtaattattgaaaagaacagtagtacgacaatcttgaccttttctaataggcgtgaggttgcaccacaggttggcagtacttgttactgttttctgacgtgcaagcaatcttcacatggcatttgttttcctaccattgttgtaatgctggttggaagtacatagttaaggtcactctttttgtctttaactatctggtcacctgctctctatcagtcttgtgctctagcttttagctgtagaagtaattcttagcctttctttatttgatgtattttattggtctgtttgaaatttacaggtgtttcagtcgtccattttatgacgccttcaaatcagcaatgttgcaagatttcgccatttgtgaacacgctgtgtgccagatacccatctgttaatttcctcaaggtagatgtgaatgagagccctgctgttgcacgtgccgaaaatgtgaggaccattcccacattcaaaatctacaaaaatggtatgagagtgaaagagatgatctgccccagccaacagctgctggaatactcagtgaggcattatgggatttaggccatgaagccgatgatttgatgtttccttcctcctccagcttctctggagcaagtgcaggcttagctggagcagaaccagtgagtactgaagttcatcttgatgagcgcaagcatgaaaagcaaagagcgactttccccgacattttccatcccgcgccccttacatttccacccatttctccatttgttcattacccaatttattcatttaatctgtctcgtcggtacatcattgttgcaaaattccttagaacaaaaacatcatctcctgattcatgtgaagaacgactgtaaatttttacttccatgtttaccagacaaccaaggaaagaaaggtatagattgcatttttgtactc

SEQ ID NO: 38636 - protein, 79 aa, Panicum virgatum
  misc_feature: Ceres CLONE 1994772
  misc_feature (3)..(76): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MTPSNQQCCKISPFVNTLCARYPSVNFLKVDVNESPAVARAENVRTIPTFKIYKNGMRVKEMICPSQQLLEYSVRHYGI

SEQ ID NO: 38637 - DNA, 605 bp, Panicum virgatum
  misc_feature: Ceres CLONE 1994807
  misc_feature: Encodes the peptide sequence at SEQ ID NO. 38638
acaagcaaggaactttgctctccctcctctctctctctttctctcttaccgcacatgcgcgtcgggccgcgtcgccaccaccccagccgcccgccgacacccgcgatggccgccgccgccgcccacgcgccgccggggcgccggggcgtgctcctcgtcctgctcgccgccgcgctcgtcgcggcgatgccggccacctgcgccgccgccaggagcaggaagtcgtacagggccgtcttcagcttcggcgactcgctctccgacgccggcaacctcatcgtcaacggcacgcccaaggcgctcaccaccgcgcgcccgccctacgggatgaccttcttccgcaagcccaccgggcgctgctccaacggccgcctcgtcgtcgacttcctcgctgagcacttcgggctgccgctaccgccgccgtcgcaggcgcaggggaaggacttcaggaagggcgccaacttcgccatcaccggcgccacggcgctggagtactccttcttcaaggcgcacggcatcgaccagcgcatctggaacactggttccatcaatactcagatcgggtggctccaggacatgaaaccgtcactctgcaaatcggaaaa

SEQ ID NO: 38638 - protein, 166 aa, Panicum virgatum
  misc_feature: Ceres CLONE 1994807
  misc_feature: SWISSPROT Homolog: EC 3.2.1.51 Alpha-L-fucosidase
MAAAAAHAPPGRRGVLLVLLAAALVAAMPATCAAARSRKSYRAVFSFGDSLSDAGNLIVNGTPKALTTARPPYGMTFFRKPTGRCSNGRLVVDFLAEHFGLPLPPPSQAQGKDFRKGANFAITGATALEYSFFKAHGIDQRIWNTGSINTQIGWLQDMKPSLCKSE

SEQ ID NO: 38639 - DNA, 1667 bp, Panicum virgatum
  misc_feature: Ceres CLONE 1994811
  misc_feature: Encodes the peptide sequence at SEQ ID NO. 38640
agattctgaagtctgaaccccacacacctccttcctccggtcgaaacggatggtgagcggcgagcggcggcggcgagcgcgaggcaacgtttctcggtggcggcggcatcatctgatccggattttggtggaggagggaaccccccgtccagtccgctgctgcgtcgggcggcaggcggcgcgggcggcttcgtccgtttcggcgagcgcgggtcacgcggcgcggagagttgagcgggccatgccgcggcgtcgcgtggatcgaccggtaactggcgtggaggaggagccgggaggcgtgggccctgttgcctccggcacctgggcttggcagcttccgggcaggctccgttccagaaaagggagatgtttccagatttagctccactgatgtggcactcttttgccacaataattgtgctgctacaggaaattgtgtcattctaccctgcactttcaccccctacgttatctgcaagtgtatcgaacagagcctgcaatgttcttgcacttcttcagtctgttgcatcacaccctgagaccaggatccccttcttaaaagctcaaattaccgagtacttatacccatttttgaaaactaccagcaatgccagatctttcgagtacctgcgcctcaccactcttggtgtgtttggtgctcttgttaaggtagatgatactgaagttgtcaataccctgctaaatggtgacaccattcctctatgcttgcgaatcatggagacaggcactgaactttcaaaaacagtggccactttcattgtccaaaagatcattatggatgaagctgggttacagtacatctgtgccaccccagaacgtttttttgggatagccactgttttagcaagaatggtggctgaacagccctccaccagattgctgaagcacattgtccgctgctacctcaggctgacagatgatcccagggcccatattgcgctgcaaactcatcttcctgaggctctgagagacgggacattcgacaacggccttagggatgatgatgttgcaaggcgctacctccaacaactgctggataatctggcccggcctggcggaggagcacctcctgcagtcccaggtcctgcagcagctggggtaactcatccagtcccagctcccgcggcaggtggtgcgccacatcctgatccaggccctgtggccggtgcaagcactgaaggatcctcccaggcagagctgagtcatggtcatccaagcccagctccgttggcgggtgctgcaccacatcctggtccaggccctgtggcaggtggaagccctggaggatctttggcgagtagcgctcatccaggcccagctcccacggaggttgatgcaccacatcctgccccaggccctgtggcgagtggaagaccaggaggatcctctcaggcagggccgagacgcaggcgccgttgatgtgagccggatgcggtcgctgcaattcagagtttactgcaactacggagtatctttccgtgaattacagctactggagaaccctgcgcgtctctggaatagaacgctatgatgccgtttattgcagtttcaagaaaaactgaaccctttatgctgtaataataagcgctgcaaacatctgcagcacctgcaccagtactgctctatgaatttttggtattttggac

SEQ ID NO: 38640 - protein, 357 aa, Panicum virgatum
  misc_feature: Ceres CLONE 1994811
  misc_feature (1)..(236): Pfam Name: Rcd1 Pfam Description: Cell differentiation family, Rcd1-like
MFPDLAPLMWHSFATIIVLLQEIVSFYPALSPPTLSASVSNRACNVLALLQSVASHPETRIPFLKAQITEYLYPFLKTTSNARSFEYLRLTTLGVFGALVKVDDTEVVNTLLNGDTIPLCLRIMETGTELSKTVATFIVQKIIMDEAGLQYICATPERFFGIATVLARMVAEQPSTRLLKHIVRCYLRLTDDPRAHIALQTHLPEALRDGTFDNGLRDDDVARRYLQQLLDNLARPGGGAPPAVPGPAAAGVTHPVPAPAAGGAPHPDPGPVAGASTEGSSQAELSHGHPSPAPLAGAAPHPGPGPVAGGSPGGSLASSAHPGPAPTEVDAPHPAPGPVASGRPGGSSQAGPRRRRR

SEQ ID NO: 38641 - DNA, 657 bp, Panicum virgatum
  misc_feature: Ceres CLONE 1994813
  misc_feature: Encodes the peptide sequence at SEQ ID NO. 38642
gaccagctccgagcctccaaggacaaggagagaagccggcacaagcaagccgtgacaacacacggatcaaacgagagcttagaagaggcagccgaggggatcagcggagccgtgtgggcgtgtggagaagaggggatggacgtgaagcggtcgcggagcccccgggctccggctgacggcgaggacgacaagaagcgcgccgggtggcgcggcggcggcgtccgcccggagatggtgctggtcggcttcctcctcacgctgcccctcctcttcctcgtcttcggcggccgctggggcagcggctccttcccctcgtcctccccgtctacgcccgtcgtcgcccgcaacgtcgccgcccgcaacgtcgccgccgccggccgcggcgccacgccgccaagcaaaaaaccagaagttgtaactccgaagaacgtctctgcaccaaccacatcatctccgtccccggacaagcttctgggaggattgctctccgcagcattcgacgaatcctcgtgccagagccgctacagatcgaacctctaccggaagccatccctgttccggctctccccctacctcgcgcagaagctgcgcaagtacgaggcctaccacaagaaatgcgggccggggaccaagcgctaccggcgtgccgtcaagcag

SEQ ID NO: 38642 - protein, 173 aa, Panicum virgatum
  misc_feature: Ceres CLONE 1994813
  misc_feature: SWISSPROT Homolog: EC 2.4.1.69 Galactoside 2-alpha-L-fucosyltransferase
MDVKRSRSPRAPADGEDDKKRAGWRGGGVRPEMVLVGFLLTLPLLFLVFGGRWGSGSFPSSSPSTPVVARNVAARNVAAAGRGATPPSKKPEVVTPKNVSAPTTSSPSPDKLLGGLLSAAFDESSCQSRYRSNLYRKPSLFRLSPYLAQKLRKYEAYHKKCGPGTKRYRRAVK

SEQ ID NO: 38643 - DNA, 1486 bp, Panicum virgatum
  misc_feature: Ceres CLONE 1994861
  misc_feature: Encodes the peptide sequence at SEQ ID NO. 38644
cgacaacgcccagatcgattccgcgtcacttgccagtcaacagtgaccaggtcgtgcggccgtcgatctcaccgcacaccgccggtccagtcctcgccggcgtcggacgcggtgaagttgaagttaaaactggtaaatttggatccatttcatatcgactcggagaattttttggatcttatctggccaccaccatggaacatgacggcacgaacctgactgtcactgaggctgtgcgctccgtgcagctgctcaagattgacggctactgtgccaccgctgccatggagacatcggagttcatcaaatccagatggaatatctatggccacgagtgggaggtccgtttctatcctaattactggcacttcttcgaggacttggaggaaacgtactaccaattcgatgacgattaccacaccgagtgggtcgctctgaagctcatccttgtcagtgaaccccagagggacaagctgagggtgaatctgagctgccggcttgtatgccccagccagcatctcgatccctccgaagagaagattgtgtcccatgtatttgacagccactccaaatgctcgcctgaagttctcctcatgccgaaacacgtcctaccatcatcaggttatatcgtgaatgactcactgaccgtggaatgcacaatcaccgtgctaggccacttcgacaccgcggataaggagcagcccctgccagtgccgccaccgtcggacctacaccagcacctcggtgagctcttggagagccaagatggagcggacatcacgtttcatgtctctggggaatccttcgccgcccacaaggtcatacttgccgcaaggtccccggttttcaaggccaagttcttcggaggcatggaggaaacaagctccgaatctgtggtgatcgaagacatggaggctgctgtgttcaagtccatgcttcacttcgtctacactgacatggctccggagctcgacggtgacctggagcctcaggcagcggcgaccaaggctcagcacctcctggcagctgcagacaggtatgggctgaacaggctcaagctgatatgtgaatgcaagctctctggtggcatcgacattggcatagcggccaccacgttggctctcgccgagcagcaccactgctcgctgctcaaagccaagtgtcttgagttcgtcaccaagtcgcctgaaactcttgatgctgtcttggcaactgatggctacgcgcatctggtggcaagctgccccttggtgctgactgaactactgagggctgcgcgtggaaggaagatctgagctggatgatggttttcgttgactgtccttgcgtcctaatattactatctgcctagtactattgtcagttgctctaaaaaaaaaagtactactgtcagttgcttctcatattatgatttccctaagatgtgtgacctgtatgactgctatatcatgatgaactagtgcttgcagttgatttccctcctttt

SEQ ID NO: 38644 - protein, 366 aa, Panicum virgatum
  misc_feature: Ceres CLONE 1994861
  misc_feature (183)..(299): Pfam Name: BTB Pfam Description: BTB/POZ domain
MEHDGTNLTVTEAVRSVQLLKIDGYCATAAMETSEFIKSRWNIYGHEWEVRFYPNYWHFFEDLEETYYQFDDDYHTEWVALKLILVSEPQRDKLRVNLSCRLVCPSQHLDPSEEKIVSHVFDSHSKCSPEVLLMPKHVLPSSGYIVNDSLTVECTITVLGHFDTADKEQPLPVPPPSDLHQHLGELLESQDGADITFHVSGESFAAHKVILAARSPVFKAKFFGGMEETSSESVVIEDMEAAVFKSMLHFVYTDMAPELDGDLEPQAAATKAQHLLAAADRYGLNRLKLICECKLSGGIDIGIAATTLALAEQHHCSLLKAKCLEFVTKSPETLDAVLATDGYAHLVASCPLVLTELLRAARGRKI

SEQ ID NO: 38645 - DNA, 732 bp, Panicum virgatum
  misc_feature: Ceres CLONE 1994865
  misc_feature: Encodes the peptide sequence at SEQ ID NO. 38646
ttaagaaaggaactctacaaagacccttacagcgagattgattgggacaaggcccgcaatcaatgtgctaaggaagatctatactatccacacccatttgttcaagatgtcttatgggctacactccataaatttgttgaaccagttatgttgcattggcctgggagcaaattgagagaaaaagctttggtaactgtcatggagcatgttcactatgaagatgagaacactcggtacatttgcattggtcctgtaaacaaggtattaaatatgcttgcttgctggattgaagatccaaactcagaggcattcaagctccacattccgcgagtctatgattacttgtggcttgctgaagatggcatgaagatgcagggttataatggcagccagctttgggatacagctttcacagttcaagccattgtggctaccaaccttattgaagagtttggtcccacccttaaactagcacacgactacattaagaattcacaggttcgtgacgactgccctggaaatctggatgactggtaccgccacacatctaaaggtgcatggccattctctactgctgatcatggttggcctatatcagactgcactgcagagggactgaaggcctcattattgttatcaaagatatctcctgaaattgttggtgaatcgctggaagataatagattttatgatgctgtcagctgtctgatgtcttatatgaatgataatggt

SEQ ID NO: 38646 - protein, 243 aa, Panicum virgatum
  misc_feature: Ceres CLONE 1994865
  misc_feature: SWISSPROT Homolog: EC 5.4.99.8 Cycloartenol synthase
  misc_feature: The sequence is a functional homolog of SEQ ID NO 6 in US patent 7122717
  misc_feature: The sequence is a functional homolog of SEQ ID NO 4 in US patent 7135624
  misc_feature: The sequence is a functional homolog of SEQ ID NO 15 in US patent 7186884
LRKELYKDPYSEIDWDKARNQCAKEDLYYPHPFVQDVLWATLHKFVEPVMLHWPGSKLREKALVTVMEHVHYEDENTRYICIGPVNKVLNMLACWIEDPNSEAFKLHIPRVYDYLWLAEDGMKMQGYNGSQLWDTAFTVQAIVATNLIEEFGPTLKLAHDYIKNSQVRDDCPGNLDDWYRHTSKGAWPFSTADHGWPISDCTAEGLKASLLLSKISPEIVGESLEDNRFYDAVSCLMSYMNDN

SEQ ID NO: 38647 - DNA, 745 bp, Panicum virgatum
  misc_feature: Ceres CLONE 1994866
  misc_feature: Encodes the peptide sequence at SEQ ID NO. 38648
acgtgcacccgggccccggcacgcccagcgcctgtcaccaacccgcccacctcccagactcccagtccaacacctcgtgcgcccaggtctgaagtctgaaccctctccctcgccaccgccatggcgcgcaagaagatccgggagtacgactccaagcgcctcctcaaggagaacctcaagcgcctcgctggcatcgacctcaccatcctctccgcccagatcacacaatcaacagacttcgcagaacttgcgagtcagcagccatggctgtcaaccacaaagttggtcgtgaagcctgatatgctgtttgggaagcgtggcaagagtggcctggtggccctcaatcttgattttgatcaagtcaaggagtttgtcaaggagcgattgggagttgaggttgagatgggtggctgcaaggctccaattacaaccttcattgttgagccatttgtgccccacgatcaagagtattacttatcgattgtgtcagagaggctgggcagcacaatcagcttctcagagtgtggagggattgagatcgaggagaactgggacaaggttaagacggtttttcttccaactgagaagccaatgacaccagatgcatgtgctcccttgattgctacccttccactggaggcacgcggaaaaattggtgacttcatcgaaggagtgtttgttgtattccaggacctggacttctcatttatggagatgaacccatttaccatggtgaatggagagc

SEQ ID NO: 38648 - protein, 208 aa, Panicum virgatum
  misc_feature: Ceres CLONE 1994866
  misc_feature (5)..(204): Pfam Name: ATP-grasp_2 Pfam Description: ATP-grasp domain
  misc_feature: SWISSPROT Homolog: EC 2.3.3.8 ATP citrate synthase
  misc_feature: Useful for making plants with modulated root development
MARKKIREYDSKRLLKENLKRLAGIDLTILSAQITQSTDFAELASQQPWLSTTKLVVKPDMLFGKRGKSGLVALNLDFDQVKEFVKERLGVEVEMGGCKAPITTFIVEPFVPHDQEYYLSIVSERLGSTISFSECGGIEIEENWDKVKTVFLPTEKPMTPDACAPLIATLPLEARGKIGDFIEGVFVVFQDLDFSFMEMNPFTMVNGE

SEQ ID NO: 38649 - DNA, 608 bp, Panicum virgatum
  misc_feature: Ceres CLONE 1994870
  misc_feature: Encodes the peptide sequence at SEQ ID NO. 38650
gaggatggggagagcgccgtgctgcgagaaggtggggttgaagaaggggaggtggacgaaggaggaggacgagatcctggcgaggtacatcaaggagcacggcgaagggtcatggagatcgctgcccaagaatgctgggctactgcggtgcgggaagagctgcaggctgcggtggatcaactacctgagggcggacctcaagagggggaacatctcggaggaggaggaggagatgatcatcaagctccacgccacccttggcaacaggtggtccctgatcgccggccacctgcccggccggacggacaacgagatcaagaactactggaactcgcacctcagcaggcgggcggctgacttccgcgacggcgtcgtcgtcaacgtcgacctcagcaagctccctggcggcggcaagcggcgcggcggccgggtcagccgcggcgtcatgaccgccgccaaagagaagaatgtgaaggagaaggagaagggcaaggagaagagcaaggttgcagaagcggagcaccagcaggacgaggaggagcagctcaaggaggacgacgacatggccctgtcgacgccgagctcacactcccagccgtgcggcgctg

SEQ ID NO: 38650 - protein, 201 aa, Panicum virgatum
  misc_feature: Ceres CLONE 1994870
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: Useful for making plants with modulated nitrogen use efficiency
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 726 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 126 in the 10/412,699 US patent application
  misc_feature: Useful for making plants with altered cell wall content and/or composition
MGRAPCCEKVGLKKGRWTKEEDEILARYIKEHGEGSWRSLPKNAGLLRCGKSCRLRWINYLRADLKRGNISEEEEEMIIKLHATLGNRWSLIAGHLPGRTDNEIKNYWNSHLSRRAADFRDGVVVNVDLSKLPGGGKRRGGRVSRGVMTAAKEKNVKEKEKGKEKSKVAEAEHQQDEEEQLKEDDDMALSTPSSHSQPCGA

SEQ ID NO: 38651 - DNA, 722 bp, Panicum virgatum
  misc_feature: Ceres CLONE 1994898
  misc_feature: Encodes the peptide sequence at SEQ ID NO. 38652
aggcagaggccgccattactgagacgagcccgtcgcaacgcggaagcgccaccacctcatgcagctcccggcctaccctgccctgctctgctgtgagtagcgtgccatagctatcagtgacaccactgtctcgcaagctgccagctgccaccattcgcctgctgctgtacctgcagtgtgccaccaccagaccagacgctctgcccatggcggcggcctccgacaagctgctgcccgcgctcgccgcggccttcctctgctgcgcgctggcgcgggtcgcccaatgcggcggcggcgccccgcagaactacacctccatgttcagcttcggcgactcgctcacggacaccggcaacctgctcgtgtccagcccgctctccaaccacatcgtcggccgctacccctacggcatcacctacttccaccgccccaccggccgctgctccgacggccgcctcgtcgtcgacttcctagcgcaagcgttcggcctgccgctgctgccgccgtacctgcaggccaaggggaaggatctccgccggggcgtcaacttcgccgtcggcggcgccaccgccatggatccgcccttcttccaggagatcggcgcgtctgacaagctctggaccaacctctccctcagcgtccagctcggatggttcgagcagctcaagccgtcgctctgcaactcaccaaagaagtgcaaggagtacttcagcaagtccctg

SEQ ID NO: 38652 - protein, 171 aa, Panicum virgatum
  misc_feature: Ceres CLONE 1994898
  misc_feature: SWISSPROT Homolog: EC 3.2.1.51 Alpha-L-fucosidase
MAAASDKLLPALAAAFLCCALARVAQCGGGAPQNYTSMFSFGDSLTDTGNLLVSSPLSNHIVGRYPYGITYFHRPTGRCSDGRLVVDFLAQAFGLPLLPPYLQAKGKDLRRGVNFAVGGATAMDPPFFQEIGASDKLWTNLSLSVQLGWFEQLKPSLCNSPKKCKEYFSKS

SEQ ID NO: 38653 - DNA, 715 bp, Panicum virgatum
  misc_feature: Ceres CLONE 1994902
  misc_feature: Encodes the peptide sequence at SEQ ID NO. 38654
agttgtcgccctttcctcgcccactccagctgacccagtgccaaaaccacgagccctcggcccctcacgaagccagagcaggccgctgctccgccgccgcgccatggcttcgccgtcgccctcgtcgcccctccacccgcaccagcaccagcatcagcacccgcttcctcctaatgctcacccccaattccaagtcccaccgccttcgatgccgccgccgccgccagcggcgccgcccaaggcgctcgacctggaggtcaccgtcgtttccgggaagcacctgaagaacgtcaactggcgacgcggtgacctccgtgcctacgtcgtcgcctacctcgacccctcccgccgcgccgccaccggccccgacgacgccggcgggtgcaagccagtctggaacgagcgcctcgtcctcccgctcccgccccacctctccccgcacgatccctccatcctcctgtccctcgacgtcttccactccaagccctccgactcgcccaagccgctcgtcggatccgcccgctcgcctctccgcgacctcctcttccccacaaaccctaaccctagccatgattccgcggcctccactctcgtcagcctgccgctcctccgcccttcaggccgtccacagggaaagctccgcatccgcgttgccatccgcgagcgctcgcccccgcccccgcccccgcctcctgagccgcagtacccgccgccc

SEQ ID NO: 38654 - protein, 203 aa, Panicum virgatum
  misc_feature: Ceres CLONE 1994902
  misc_feature (50)..(140): Pfam Name: C2 Pfam Description: C2 domain
MASPSPSSPLHPHQHQHQHPLPPNAHPQFQVPPPSMPPPPPAAPPKALDLEVTVVSGKHLKNVNWRRGDLRAYVVAYLDPSRRAATGPDDAGGCKPVWNERLVLPLPPHLSPHDPSILLSLDVFHSKPSDSPKPLVGSARSPLRDLLFPTNPNPSHDSAASTLVSLPLLRPSGRPQGKLRIRVAIRERSPPPPPPPPEPQYPP

SEQ ID NO: 38655 - DNA, 697 bp, Panicum virgatum
  misc_feature: Ceres CLONE 1994903
  misc_feature: Encodes the peptide sequence at SEQ ID NO. 38656
gaagacggtggacgaggtatggcgcgacatccagagcgccagcggcgcccggcagccgaccatgggcgagatgacgctggaggacttcctctcccgcgccggcgtcaccgtcgacgccggaccgcattggctgcaccagtacccgccgccgcatcagtacgtggtgcctctcgggcccggcgccggcccggaggtggacgccgtgtaccgcgacggcgtcggggtcggagtcggtgtcttcctatcgcaggtggccggccggaagcgcggcgcggcggcggcggtgggcggggacggcgtggtggagaggacggtggagcggcggcagaagcgcatgatcaagaaccgcgaatccgcggcgaggtcccgggccaggaagcaggcatacaccaacgagctggagaacaaggtcgcccagctggaggaggagaaccagcgtctcaggaagctcaagggcgttgtggttggttttttaagcctgttctgtaacaagattccagattaagcctgatgaaacaagaatgaagtccaatgaaccatgtgcaattgcaatttggattggattattgcatggaatggtacaagggcctcctcatctgtctctgtctgcggagctaacgatgtgttgggttgcattggttgcagatgctgccaccgctggagccgccaccggaacctgagcaacggccggtgcacc

SEQ ID NO: 38656 - protein, 167 aa, Panicum virgatum
  misc_feature: Ceres CLONE 1994903
  misc_feature (102)..(165): Pfam Name: bZIP_1 Pfam Description: bZIP transcription factor
  misc_feature: The sequence is a functional homolog of SEQ ID NO 1540 in the 10/412,699 US patent application
  misc_feature: The sequence is a functional homolog of SEQ ID NO 1542 in the 10/412,699 US patent application
KTVDEVWRDIQSASGARQPTMGEMTLEDFLSRAGVTVDAGPHWLHQYPPPHQYVVPLGPGAGPEVDAVYRDGVGVGVGVFLSQVAGRKRGAAAAVGGDGVVERTVERRQKRMIKNRESAARSRARKQAYTNELENKVAQLEEENQRLRKLKGVVVGFLSLFCNKIPD

SEQ ID NO: 38657 - DNA, 713 bp, Panicum virgatum
  misc_feature: Ceres CLONE 1994906
  misc_feature: Encodes the peptide sequence at SEQ ID NO. 38658
tctactgtaactaagtatcacttgcaaagactgggaattacctcagaagttgtagctaccattgaactagctcttggtgcgttttctgggagaaatggccattccctagccagcaggaagctaccatgcatgttgttgattgagaatgattcatggagctcaaaaatggatgttcccttacgatctagtctcctggagatgaagcagaatggtcagacacctgtattacccaaaattgtcctcctcacggctgcagaatcggacaagctaaaaggaaactatgctgttgattctgtgatcaccaagcctctgaaagcaagcacacttgctgcttgtctattccaggcacttggtatcacacagacacagctgagccacgagaaacaggacagctcaggttctcttcgtgggttgcttcttggcaggaacatattggtggttgatgataacaaggtaaaccttagagtggctgctggcacattgaagaaattcggagcaaagttggagtgcgtggagagtggaaaagatgctctcgccctcctacaaatcccatataagtttgatctctgtctcacggacattcagatgcctgaaatggacgggtttgaggcgaccaggcacatacgggcaatggaagcgaaggcgaacggggaggcagacactggtgacgattcagaagtagaccgcgcgacaagggcagggaaatggcactt

SEQ ID NO: 38658 - protein, 237 aa, Panicum virgatum
  misc_feature: Ceres CLONE 1994906
  misc_feature (142)..(232): Pfam Name: Response_reg Pfam Description: Response regulator receiver domain
  misc_feature: SWISSPROT Homolog: EC 2.7.13.3 Histidine kinase
STVTKYHLQRLGITSEVVATIELALGAFSGRNGHSLASRKLPCMLLIENDSWSSKMDVPLRSSLLEMKQNGQTPVLPKIVLLTAAESDKLKGNYAVDSVITKPLKASTLAACLFQALGITQTQLSHEKQDSSGSLRGLLLGRNILVVDDNKVNLRVAAGTLKKFGAKLECVESGKDALALLQIPYKFDLCLTDIQMPEMDGFEATRHIRAMEAKANGEADTGDDSEVDRATRAGKWH

SEQ ID NO: 38659 - DNA, 707 bp, Panicum virgatum
  misc_feature: Ceres CLONE 1994909
  misc_feature: Encodes the peptide sequence at SEQ ID NO. 38660
gcaatcccgtccaactactgcaagcaaagatgagagccgccagcatgttcgaccactgtagcttcacgcatcagttcaagctcaactacgaagcaacgaagaacgtcgccatcgggcacatcgtcagctccggcgacatctccgctggggggcacctctggaggatcgattgctacccccgttgggttaaagaaaagaacaagggcgagtacctatctatattcctctctcataggagcaaatctaaagacgccaaggctatcttcgaggttttcgtgatggacagagacggtgctccgtcctcgtcctatagaagcaggttagtgcatgtcttcccaccaaatgcctcccgtggttggctgctgttcgtgcagcgaagcgtcctcaagtcgctctacctgatggaggatggctcgttcatcgtcatgtgcggggtcaaggttgtgcctgacaacgccttggacgacgccccgccctccgacatagggagacacctcggcgtcctcctggattccacggaaggctccgacgtgtcgttcgtcgtcgacggcgaggagttccccgcccaccgggcggtgctcgccgcccgctcgccggtcttcaaggcgcagctcctgggatccatgacggacgccaagatgagatccatcaccttgcatgacatcgcgcccgcaacgttcaagctcatgcttcggttcatgtacacc

SEQ ID NO: 38660 - protein, 225 aa, Panicum virgatum
  misc_feature: Ceres CLONE 1994909
  misc_feature (156)..(225): Pfam Name: BTB Pfam Description: BTB/POZ domain
MRAASMFDHCSFTHQFKLNYEATKNVAIGHIVSSGDISAGGHLWRIDCYPRWVKEKNKGEYLSIFLSHRSKSKDAKAIFEVFVMDRDGAPSSSYRSRLVHVFPPNASRGWLLFVQRSVLKSLYLMEDGSFIVMCGVKVVPDNALDDAPPSDIGRHLGVLLDSTEGSDVSFVVDGEEFPAHRAVLAARSPVFKAQLLGSMTDAKMRSITLHDIAPATFKLMLRFMY

SEQ ID NO: 38661 - DNA, 705 bp, Panicum virgatum
  misc_feature: Ceres CLONE 1994912
  misc_feature: Encodes the peptide sequence at SEQ ID NO. 38662
ggccaaaccaccataaccctctgcatcgccggccggccgttgttgccataccaagctaggactaggaggccctttcttcccatataaaccacccaccacaatccctcgccaaatcaaatccgccgcatctcaagtcaggtgcgaatcgaatcgaccaagaacagcagcagcagcaggcatggggtccgccagccgcgccgtctcgtgcctctgctgcccctgcaggtgcctcgcctgcgggctcctgagctgcctctgcagcatcctcatctccctcctcgtcaccctcggcgtcctcgccctcgtcctctacctcatcttccgcccccacatgatcgccgccaccgtcgactccgcctccctcgccaccttcaccctctccccgacctcctcgctcgcctacaacctcaccgtcgccgtcaccgtgcgcaaccccaacgagcgcgtcggcctctactacgacaacgtcgaggccctcgccttctacaaggcccagcgcttcggctacgaccccatcgacgccttctaccagggcacccaggattccacccagctcaagcccgagttccacggccagcagctgctccagggggacgtcaccgccgcgcagttcaggcaggaccagaccgacggcaacttcgccatcaacgtcggcctcaacgccaagctcagggtcaaggtctgggcctttcaggtccggggggc

SEQ ID NO: 38662 - protein, 175 aa, Panicum virgatum
  misc_feature: Ceres CLONE 1994912
  misc_feature (45)..(175): Pfam Name: Hin1 Pfam Description: Harpin-induced protein 1 (Hin1)
MGSASRAVSCLCCPCRCLACGLLSCLCSILISLLVTLGVLALVLYLIFRPHMIAATVDSASLATFTLSPTSSLAYNLTVAVTVRNPNERVGLYYDNVEALAFYKAQRFGYDPIDAFYQGTQDSTQLKPEFHGQQLLQGDVTAAQFRQDQTDGNFAINVGLNAKLRVKVWAFQVRG

SEQ ID NO: 38663 - DNA, 720 bp, Panicum virgatum
  misc_feature: Ceres CLONE 1994920
  misc_feature: Encodes the peptide sequence at SEQ ID NO. 38664
ccaactcgcagtctcgatctccttcctcctcccactcttccttcctccccggggctctgctgccggcgaggtcgggcgctagctagcaagatggtggcgtcccgcaggttcaagcccatcgaggagtgctgctcggaggggcggtcggagcagacggtggcggccgacctggacggcacgctgctcatctcccggagcgccttcccctactacctcctcgtggcgctcgaggccggcagcgtcctccgcgcggtgctgctgctcctctccgtgcccttcgtctacgccacctacgtcttcttctccgagtcgctggccatcagcacgctcgtctacatctccgtcgcggggctcaaggtgcgcagcatcgagatggtggcgcgctccgtgctgcccaggttctacgccggcgacgtccacccggagagctggcgggtgttcagttccttcggcaagcgctacatcatcacggccagcccccgggtcatggtcgagcccttcgccagggcgttcctcggcgccgacaaggtcgtcgggacggagctggaggtcggcaagaacggcaaggccacgggcttcatggtcaagcccggcgtactcgttggggaccacaagaagcaggccgtcgtcagggagctcggcgacgcggtgcccgacgtcggcatgggggacagggagaccgacttcgacttcatgtccatctgcaaggaggcctacctg

SEQ ID NO: 38664 - protein, 209 aa, Panicum virgatum
  misc_feature: Ceres CLONE 1994920
  misc_feature: SWISSPROT Homolog: EC 2.3.1.15 Glycerol-3-phosphate O-acyltransferase
MVASRRFKPIEECCSEGRSEQTVAADLDGTLLISRSAFPYYLLVALEAGSVLRAVLLLLSVPFVYATYVFFSESLAISTLVYISVAGLKVRSIEMVARSVLPRFYAGDVHPESWRVFSSFGKRYIITASPRVMVEPFARAFLGADKVVGTELEVGKNGKATGFMVKPGVLVGDHKKQAVVRELGDAVPDVGMGDRETDFDFMSICKEAY

SEQ ID NO: 38665 - DNA, 1355 bp, Panicum virgatum
  misc_feature: Ceres CLONE 1994926
  misc_feature: Encodes the peptide sequence at SEQ ID NO. 38666
atataaaagaacaattgaagcctaaagtcccgccgccgagggaaaaggtacctctagaactagggaaaaagcttctcgcaagcctagacaacccaccaaaaccgaaaagcttaccctcgaactatgatcgtactctaacaaaggcacacaaggtgagaaatctgaagaaaaaatgtggcaagactattcctcagcttggcacacaacaaaaagaactcgagcccctccgggtgctagggttgccacttctagacccgacggacgtacaactccaggcggaccaacaggccgcaatatttctttctgaaactggattaacgctagaggaggcaacggggcatgtggaggcaaaaatccctgtcgctcgcattattactccattccagcatggaaaaccgtttgtcactgaggaagaagagaaaagtctaggcacgcagatgttcaatttgcatagatggtacctgcgaatggcgaaagacgaagggaaaatgtttggagtcaagtatcgtgaccatgatttcttctgcggggaggacgacttctgggtgtacttccaaaatttatatcacgtttaccatcgacaagccctcgacgcctctatcatcaccatttgggttttacaggagatccaaagaagccgaaaacatggatggcaccatcagatcggtttcatgtctcctttgctagtcaaccagaaattgatcaacgaaagttacaaggaaacgtgcgaaaacatgtacgattcgttgactaggcaaagttacaaatcatatatattcataccatacaactttggttatcattggattttactcatactttccgtagagaccggcaatcttatagtctttgactcaatgagaaatccaaagtccgcaatccaacatatcatagaccccttgaacagggtttggaaaaaatttatgaaaaataacaaaggacgtggtcaatggaggcccaaactgaacgttaacatggattatccatgtgcgagacaacaacaaggaactgattggtgcgggtactacgtatgcgactacttgcacatcatgactccatgcgggaaggctactgatgaagaaatgagaatgtctcaaatgggggatgaatgttactctactgatcggatcaacgccgtgtgcgagcagctcgccggattcattttgaacgagatcttggatcctagaggcgagttctaccacgacggtcacatcgatagaggactttcatcgacatcctgaggggactagtagttggacggctaacatgacttgtatatttgtaaatatttttaaacattatgccttgatgtttgtaaatttataaatatattagttcatctaattagcttaatc

SEQ ID NO: 38666 - protein, 412 aa, Panicum virgatum
  misc_feature: Ceres CLONE 1994926
  misc_feature (194)..(378): Pfam Name: Peptidase_C48 Pfam Description: Ulp1 protease family, C-terminal catalytic domain
IKEQLKPKVPPPREKVPLELGKKLLASLDNPPKPKSLPSNYDRTLTKAHKVRNLKKKCGKTIPQLGTQQKELEPLRVLGLPLLDPTDVQLQADQQAAIFLSETGLTLEEATGHVEAKIPVARIITPFQHGKPFVTEEEEKSLGTQMFNLHRWYLRMAKDEGKMFGVKYRDHDFFCGEDDFWVYFQNLYHVYHRQALDASIITIWVLQEIQRSRKHGWHHQIGFMSPLLVNQKLINESYKETCENMYDSLTRQSYKSYIFIPYNFGYHWILLILSVETGNLIVFDSMRNPKSAIQHIIDPLNRVWKKFMKNNKGRGQWRPKLNVNMDYPCARQQQGTDWCGYYVCDYLHIMTPCGKATDEEMRMSQMGDECYSTDRINAVCEQLAGFILNEILDPRGEFYHDGHIDRGLSSTS

SEQ ID NO: 38667 - DNA, 1043 bp, Panicum virgatum
  misc_feature: Ceres CLONE 1994946
  misc_feature: Encodes the peptide sequence at SEQ ID NO. 38668
acctcccctaaatttgtttgattcgagctgtaacacacgagggttagagctaaccttgccaaacgacacaaagcgaaggcgtcgtgcggcctcgacatcccgcgccgcgttccacctccatcgacggcggcctagttccgaaaagctcccgagctccacatcctcaagaccactaccctcgagcagtcccgggtctcagggtcgccggcggcggtagcgagttcttgcttgcttccggtggtgggaggacgcgtgggcgatggcggtggaccgcgggctcctgctcctcttcctcctctcggccgccgccctggccggggtcgcctctgccgccggtcctttcttgtccgacggcgtgttcctggcgaccgccggatccacggggaggagcttgttgcaggccaagaaggattgccctgtgagctttgagttccaaaactacacaatcatcacaagcaagtgcaaagggccaacatttcctgccagccaatgctgcgccgctctcaaggaattcgcctgcccattctatatgtacctcaatgatgacagcaacagctgcgcatcgaccatgttcacctacatcaacctctatggcaagtacccaccagggctgttctccagcgagtgcaaggaaggcaagttggggctttcttgcgcagatgtcccccaaagagatatttccgctgcaaacggtggggaacgcgctcaattgcttgcgtggattgtcttgagtgtggtagtagcgtcattgttccactgaatgataactccattcatttgcccgaaagatagggtgtttcaactgatgaggctttgagtttgatcattgcaccttatggtgctccttgtgggttagctgccagattcttccttttgtctgtaaaatctcttctaatataatttatgatgtagtgtgtattttctggaattcggcttgttgatgccggtgtttagttcatactcagctcaactcagcagtatcattgtattgtcactgttacattacattatgatgcatatgtatcaattatcattcatattag

SEQ ID NO: 38668 - protein, 166 aa, Panicum virgatum
  misc_feature: Ceres CLONE 1994946
  misc_feature: Useful for making plants with altered carbohydrate content
  misc_feature: Useful for making plants with altered cell wall content and/or composition
MAVDRGLLLLFLLSAAALAGVASAAGPFLSDGVFLATAGSTGRSLLQAKKDCPVSFEFQNYTIITSKCKGPTFPASQCCAALKEFACPFYMYLNDDSNSCASTMFTYINLYGKYPPGLFSSECKEGKLGLSCADVPQRDISAANGGERAQLLAWIVLSVVVASLFH

SEQ ID NO: 38669 - DNA, 1336 bp, Panicum virgatum
  misc_feature: Ceres CLONE 1994952
  misc_feature: Encodes the peptide sequence at SEQ ID NO. 38670
cccggcccattttgccaactaaatgatcatatatatgatatcctccgatcggatccctccgtgttcatcgatcagcagcaatgccacagcaaggaggaggaaggttggcggtggagaacgtggtcatcgtcggcgggctcctgcttgtgcaatgcgtcctcgccggctacgtcgtgttcgtggaccagctgatgagcctgggcgcccacccgctggccgtcatcgccgtcgccggcgccgccttcactgctttcttcctccccttggccgtcgcgctcgagaggaagcgatggccttccaaggtttcctggactttggtggcgcagcttgtgctcatcgctcttggagggacaactgtgttccaagaactgatgctgctggggataaagaagacgacgccggcagtggcttcagccatgcccaacctcagccctggcctcatcttcgtcatcgccgcttgcttcaggctggagaagttcgacaagggttgcaagtacacgcaggccaagatgtttgggacgctggtgtgcctggtaggagcaattgccatgagcctcctgcagcagacgtctccctcctctccggcggcagcgggcggcggctggatcctgggctgctcctacctggtcggcgcggtcgtcgtcctgtctctcgtcaccgtgctacaggcggcgacgctgggaggcggcttccccgcgccgctgaccatgtgctgcgtcacgtccgccatgggggccgcattcaccgccgccctgcaggtggtcgtcgagggcaagctggacatggggtcgcccaagatcgacgcaacgctcgtcgcagggatcgccatactgggcggcgtgctgagcggcgcgtgcatcgcgttccagacgtggtgcctgggcaagaagggcccgctgttcgtgtccgtcttcggccccgtgcagaccgtctgctccgccatcctctccgccgcgatcctccgccagacgctcagccgaggaagcctcgcagggatcctgctcatgttcactggcctctaccttgtgctctgggcaaagaggaacgagtacgagactctcccaccccatccgcagcagcagcatgcgcatgctggtgatcttgagaaggctcctctgctatcctgatgagttcctgactgctgctgcatgctggggaaattagtaaaccttactagtttcttgtagcagtacttgcctggttgtttattactagtagtagtatttactattttagagtaaaaagggcagctgcaacagatatatgacgacatactaagactgactccaacaacgtaaaggaaaacgcgacaggcattcgcgagtttgcattgctc

SEQ ID NO: 38670 - protein, 348 aa, Panicum virgatum
  misc_feature: Ceres CLONE 1994952
  misc_feature (178)..(318): Pfam Name: TPT Pfam Description: Triose-phosphate Transporter family
MPQQGGGRLAVENVVIVGGLLLVQCVLAGYVVFVDQLMSLGAHPLAVIAVAGAAFTAFFLPLAVALERKRWPSKVSWTLVAQLVLIALGGTTVFQELMLLGIKKTTPAVASAMPNLSPGLIFVIAACFRLEKFDKGCKYTQAKMFGTLVCLVGAIAMSLLQQTSPSSPAAAGGGWILGCSYLVGAVVVLSLVTVLQAATLGGGFPAPLTMCCVTSAMGAAFTAALQVVVEGKLDMGSPKIDATLVAGIAILGGVLSGACIAFQTWCLGKKGPLFVSVFGPVQTVCSAILSAAILRQTLSRGSLAGILLMFTGLYLVLWAKRNEYETLPPHPQQQHAHAGDLEKAPLLS

SEQ ID NO: 38671 - DNA, 704 bp, Panicum virgatum
  misc_feature: Ceres CLONE 1994960
  misc_feature: Encodes the peptide sequence at SEQ ID NO. 38672
gagggttggagactaggggtagcgacgagagcgatggggaagaaagggaaggaggcggcgcgggagcggcgcgagcagcgcagccgcgaggtcaccctcctccgcgccctcccctacgagccccaccagaggtggtgggatcgcctggagccgcgggccgtggcggtggtcacgggcgccaaccgcgggatagggttcgaggccgcccgccagctcgcgctccacggcctccacgtcgtgctcgcctcccgcgacgccgccaggggccaggacgcggccgagaggattcggggggaggctcccgacggcgcgggcgtgagcgtggagtggcggcagctcgacgtggcggacgcctcgtctgtggaggccttcgcaacctgggcgctggaaacccacggcggcatccatgtccttgttaacaatgcaggtgtaaacttcaacaaaggaccagacaattctgtcgagtttgctgagcaagtcatcgagacaaattattatggcacgaaacgcatgattgatgccatgataccattaatgaaaccctctccttatggggctcggattgttaatgtcagctcaaggcttggaagagtcaatggcagacgaaatagaattggtgaaatcagcctaacagatcagctattgaatgaagactgtttatcagaacagtttatttgatgagatgatcaaaaaatttctggagc

SEQ ID NO: 38672 - protein, 214 aa, Panicum virgatum
  misc_feature: Ceres CLONE 1994960
  misc_feature (42)..(195): Pfam Name: adh_short Pfam Description: short chain dehydrogenase
  misc_feature: SWISSPROT Homolog: EC 1.1.1.184 Carbonyl reductase (NADPH)
MGKKGKEAARERREQRSREVTLLRALPYEPHQRWWDRLEPRAVAVVTGANRGIGFEAARQLALHGLHVVLASRDAARGQDAAERIRGEAPDGAGVSVEWRQLDVADASSVEAFATWALETHGGIHVLVNNAGVNFNKGPDNSVEFAEQVIETNYYGTKRMIDAMIPLMKPSPYGARIVNVSSRLGRVNGRRNRIGEISLTDQLLNEDCLSEQFI

SEQ ID NO: 38673 - DNA, 486 bp, Panicum virgatum
  misc_feature: Ceres CLONE 1994994
  misc_feature: Encodes the peptide sequence at SEQ ID NO. 38674
aaaactaaaaacccaatcccctcacctcctctcggtcggctaccttcccctccatcccctcccgccgaaccgtacgtacaaggtagcatctagctaggcgcaggcgatgggcgccgtgtccgcctctctgtccgccttcccggccgctgcccaggcggccgccgcttcgctggccccggactccgcatgcaggtactcacggcgcagcgccgccccggcggagctcgggcccgttccggggtcgaccacggagaccgctgacggcgggccggcgccggtgaagacggagaacatctccaacaaccaggacgagggtgtggtgaccaacaagtacaagccccaggagcccttcgtggggaggggcctgctcgacaccaggatcacaagagacaaggcgccgggggacacgtggcacatggtcttcaacacagaatgcgagatcccttagagacaaggccagtccatcgacgtctatcgacgacggcg

SEQ ID NO: 38674 - protein, 113 aa, Panicum virgatum
  misc_feature: Ceres CLONE 1994994
  misc_feature: SWISSPROT Homolog: EC 1.18.1.2 Ferredoxin--NADP(+) reductase
MGAVSASLSAFPAAAQAAAASLAPDSACRYSRRSAAPAELGPVPGSTTETADGGPAPVKTENISNNQDEGVVTNKYKPQEPFVGRGLLDTRITRDKAPGDTWHMVFNTECEIP

SEQ ID NO: 38675 - DNA, 632 bp, Panicum virgatum
  misc_feature: Ceres CLONE 1995000
  misc_feature: Encodes the peptide sequence at SEQ ID NO. 38676
aggcagactgcagaggatctcattccctcctcggggcggcctcggcgccgcaacccgcgcggcgcgttcacagttcacaccggcgaaccctagcccgcccctatccgggggggatgcagacggaggcgcgcgtcggcgtcgtcatcgacggcggcggcggccgcgccgccgtcgccctgcgccaggagcagcgccacatcggcacggtggcgcacctcgccgccggaggcttcacaggcgccgtcagcaagacgtgcaccgccccgctcgcgcggctcaccatcctcttccaggtggcaggtatgcatgcagatgttgcagttctaaggaagtatagcatatggcatgaggcttcacgaattgttcgagaagaagggtttcgagccttttggaaaggaaatctagtgacaattgtacatcgcttaccttattctgccatcagcttctattcatatgactgctacaaaattcttctccaaatggtcccaggcttggatagagaatcaaacaatgttggtgttgtacgtttgcttggtggtgggttggcgggaataacagccgcatctgcaacttacccgttggatgttgtccgtactcgtttggcgacacagaaaacaactaggtattacaag

SEQ ID NO: 38676 - protein, 172 aa, Panicum virgatum
  misc_feature: Ceres CLONE 1995000
  misc_feature (30)..(125): Pfam Name: Mito_carr Pfam Description: Mitochondrial carrier protein
MQTEARVGVVIDGGGGRAAVALRQEQRHIGTVAHLAAGGFTGAVSKTCTAPLARLTILFQVAGMHADVAVLRKYSIWHEASRIVREEGFRAFWKGNLVTIVHRLPYSAISFYSYDCYKILLQMVPGLDRESNNVGVVRLLGGGLAGITAASATYPLDVVRTRLATQKTTRYY

SEQ ID NO: 38677 - DNA, 707 bp, Panicum virgatum
  misc_feature: Ceres CLONE 1995002
  misc_feature: Encodes the peptide sequence at SEQ ID NO. 38678
agtaccagctgccttcctactcgcttcccttgccgtccttctcgcctacttcgccgcggcccccctcatccggcgtcgtcttccgccgtccgccgccgggacacgcaaagatcttgtttcttcgatagaatatgtcgtgctttggatgctgtggtgatgaagatgcacaaggagttccagactccaggaatccgtacccaggacaccatccagctaggactgatgcataccgccctgctgatcaacctcccaagggtcctcagcctgtcaaaatgcaacccattgcagtccctgccattcctgtggatgagattagggaggtgactaagggttttggtgatgaagctctgattggtgagggctcctttggaagagtatattttggtgttctaagaaatggtaggagtgcggcggtcaaaaagctggattccaataagcagcccgaccaagaattcttggcgcaggtgtctatggtgtcaaggttgaagcacgaaaatgttgttgagttgcttggttattgcgctgatgggaccctacgtgtccttgcttacgagtttgctactatgggctctcttcatgatatgcttcatggaagaaaaggtgttaaaggagctcagcctggtccagttttatcatgggcacaacgtgtgaagatagctgtcggggcagcaaaggggcttgagtatcttcatgagaaagcacagcct

SEQ ID NO: 38678 - protein, 191 aa, Panicum virgatum
  misc_feature: Ceres CLONE 1995002
  misc_feature (61)..(191): Pfam Name: Pkinase_Tyr Pfam Description: Protein tyrosine kinase
  misc_feature: SWISSPROT Homolog: EC 2.7.11.1 Non-specific serine/threonine protein kinase
MSCFGCCGDEDAQGVPDSRNPYPGHHPARTDAYRPADQPPKGPQPVKMQPIAVPAIPVDEIREVTKGFGDEALIGEGSFGRVYFGVLRNGRSAAVKKLDSNKQPDQEFLAQVSMVSRLKHENVVELLGYCADGTLRVLAYEFATMGSLHDMLHGRKGVKGAQPGPVLSWAQRVKIAVGAAKGLEYLHEKAQ

SEQ ID NO: 38679 - DNA, 670 bp, Panicum virgatum
  misc_feature: Ceres CLONE 1995007
  misc_feature: Encodes the peptide sequence at SEQ ID NO. 38680
gccgagacacaggcaggcgctgcgcacgtggtggcttatcccctcccgtccgtcacatcccgcaccagcaccgcggcggcagccatggccgcggcggcgttcctctgcgccagggcggcggcggcggcgctgcgccctccctcgcgcggcctgccccgctgcctcctcgcctcccgcgtcgcggcggcctcggcctccggggaaggcggtgggggagtggagttccaggggaaggtggggttcctggggctcgggatcatgggcgcgcccatggcgtccaacctcatcagggcgggctgcgacgttacggtgtggaacaggaccaagagcaagtgcgatccccttctcagcctcggtgccaagtacgagccttcaccggctcaagttgcttcgtcttgcgacgtgacctttgcgatgcttgctgatccagaaagcgcggctgaggttgcatgcggggccggcggagctgcagaagggttggccccagggaaagggtatgttgatgtgtcgacggttgatggtgctacatccaagctgatcgccgaacatatcacaagtaccggggcatctttccttgaggctccagtttcaggctcgaaaaagccggcagaagatgggctgctcatctttcttactgcaggtgatgaatccttgtacaagagagtggcgc

SEQ ID NO: 38680 - protein, 195 aa, Panicum virgatum
  misc_feature: Ceres CLONE 1995007
  misc_feature (48)..(195): Pfam Name: NAD_binding_2 Pfam Description: NAD binding domain of 6-phosphogluconate dehydrogenase
  misc_feature: SWISSPROT Homolog: EC 1.1.1.60 2-hydroxy-3-oxopropionate reductase
MAAAAFLCARAAAAALRPPSRGLPRCLLASRVAAASASGEGGGGVEFQGKVGFLGLGIMGAPMASNLIRAGCDVTVWNRTKSKCDPLLSLGAKYEPSPAQVASSCDVTFAMLADPESAAEVACGAGGAAEGLAPGKGYVDVSTVDGATSKLIAEHITSTGASFLEAPVSGSKKPAEDGLLIFLTAGDESLYKRVA

SEQ ID NO: 38681 - DNA, 725 bp, Panicum virgatum
  misc_feature: Ceres CLONE 1995021
  misc_feature: Encodes the peptide sequence at SEQ ID NO. 38682
agcgtcactgacaagtgcagcagcaactcagtcagtccatcgcatcagcatcaggccactgacaagtgcgatggcctcctcgtggctcatcttggccctgctccccgcgctctgcctgggaacgctgccgagctcccacgcggcccgcgccttcttcgtcttcggcgactccctcgtcgacaacggcaacaacaactacctggtgacggcggcgcgggccgactcaccgccctacggcatcgacacgccggaccaccgcgccacggggcgcttcagcaacggcaagaacgtgccggacatcatcagtgagcacctcggcgccgagccggtgctgccgtacctgagcccggagctggacggcgacaagatgctcgtcggcgccaacttcgcgtcggccggcgtcgggatcctgaacgacacgggaatccaattcgccaacgtcatccacatctcgaagcagctgctctacttccagcagtaccagaagcgtctgagctcgctgatcggcgcggagcagacggcccggctggtgcacggctcgctggtgctcatcaccctcggcggcaacgacttcgtcaacaactactacctggtgccctactcggcgcgctcccgcgagttctccctccccgactacatcaactacatcctctccgagtacaggcagatcctcacggtatgtagtcctgtacaccattgcgtgcttgaccacgagctgatcgact

SEQ ID NO: 38682 - protein, 218 aa, Panicum virgatum
  misc_feature: Ceres CLONE 1995021
  misc_feature (28)..(211): Pfam Name: Lipase_GDSL Pfam Description: GDSL-like Lipase/Acylhydrolase
  misc_feature: SWISSPROT Homolog: EC 3.2.1.51 Alpha-L-fucosidase
MASSWLILALLPALCLGTLPSSHAARAFFVFGDSLVDNGNNNYLVTAARADSPPYGIDTPDHRATGRFSNGKNVPDIISEHLGAEPVLPYLSPELDGDKMLVGANFASAGVGILNDTGIQFANVIHISKQLLYFQQYQKRLSSLIGAEQTARLVHGSLVLITLGGNDFVNNYYLVPYSARSREFSLPDYINYILSEYRQILTVCSPVHHCVLDHELID

SEQ ID NO: 38683 - DNA, 688 bp, Panicum virgatum
  misc_feature: Ceres CLONE 1995041
  misc_feature: Encodes the peptide sequence at SEQ ID NO. 38684
aacccatttccttcctgcccgcaacccagcccaggcccggcggtccctcgatcctctcggctccggatcggcaagagcccagccgccgccgcccgtagccgcctcgctgccggattcacacgacacctcgtcggcgtctctttctctctctctcgaggcccatggcgcagcgcgacaagaaggtggaggagccgacggagctgcacgcgccggagctcacgctctgcgccaacagctgcggcttcccgggcaactcggccaccaagaacctctgccagaactgcttcctggccgcctccgcctccgcctccgcctccgtctcgccgccgtcgccctcctcctcctcgccggcggtgttcgacaagccgcggacggcggcggcggcggccgcccctcccgcgctctggccgccgttctccccggccgccaaccggcccccggcgggccccgcggagtccccctccaaggcgccccggacgtcgtcgtcgatcaaccggtgccacagctgccggaagcgggtcgggctgacggggttccggtgccgctgcggcgagctcttctgcggcgcgcaccggtactcggaccgccacgactgcggctacgactacaagggcgtcgcccgggacgccatcgcccgggagaaccccgtcgtgcgcgccgccaagatcgtcaggttctgagagagctg

SEQ ID NO: 38684 - protein, 172 aa, Panicum virgatum
  misc_feature: Ceres CLONE 1995041
  misc_feature (113)..(153): Pfam Name: zf-AN1 Pfam Description: AN1-like Zinc finger
MAQRDKKVEEPTELHAPELTLCANSCGFPGNSATKNLCQNCFLAASASASASVSPPSPSSSSPAVFDKPRTAAAAAAPPALWPPFSPAANRPPAGPAESPSKAPRTSSSINRCHSCRKRVGLTGFRCRCGELFCGAHRYSDRHDCGYDYKGVARDAIARENPVVRAAKIVRF

SEQ ID NO: 38685 - DNA, 713 bp, Panicum virgatum
  misc_feature: Ceres CLONE 1995047
  misc_feature: Encodes the peptide sequence at SEQ ID NO. 38686
acacacaccaccaccagtccacacacacacacccgcccgccctcttgctctctcgcaggcccttcttccctggcagcgacgactgggcgtttgggcgagcggcgccgtcctacgcgaggttttcgtcggctcggcgccggcgacgaatatccaccagggacgcacttccgttccattccgtcgccttcccttcccgctgtgcgaaatcgatctcctcaaagccttgttatggaatgggaggcagatatcgtggttggttcttgttctaagccatgtgggcccttggaggaatacttcattccagattacattctgaagcctgatgccgaactagtgattgtcgatcatgctcctctctgtcctgtactagtgttcatcaactcaaggtccggcggccaacttggaagcagtttcatcaaaacataccgtgagctcctcaatgaagcacaggtttttgacctctcagaagaggctccagataaggtgttgcaccgtttatatgtcaatcttgaaagactcaagatgggaggagacattcttgctgttcaaatttggaggaggctgaggctaattgttgcaggtggtgatggtacagctagctggctgcttggggtggtcagtgaccttgagcttgctcacccacctccagtcgcgactgtgcctctgggaacaggaaataacctttcccttttcattttggatggggaaagaag

SEQ ID NO: 38686 - protein, 161 aa, Panicum virgatum
  misc_feature: Ceres CLONE 1995047
  misc_feature (45)..(161): Pfam Name: DAGK_cat Pfam Description: Diacylglycerol kinase catalytic domain (presumed)
  misc_feature: SWISSPROT Homolog: EC 2.7.1.107 Diacylglycerol kinase
MEWEADIVVGSCSKPCGPLEEYFIPDYILKPDAELVIVDHAPLCPVLVFINSRSGGQLGSSFIKTYRELLNEAQVFDLSEEAPDKVLHRLYVNLERLKMGGDILAVQIWRRLRLIVAGGDGTASWLLGVVSDLELAHPPPVATVPLGTGNNLSLFILDGER

SEQ ID NO: 38687 - DNA, 742 bp, Panicum virgatum
  misc_feature: Ceres CLONE 1995060
  misc_feature: Encodes the peptide sequence at SEQ ID NO. 38688
actttcctcctcccttggtgttcctttcccggcggcgaccaccggaccagcggcagcgccattcgttacgtattcgcccggccctttgccggcgaggagcatccaccagagaattcgttgaaatggcaagcacggcatgctttgtgatcgtgagtaagaatgacatcccaatctatgaggctgaagttggatctgctccaaaaaaagaagatttagcttatcagcatcagttcattttgcatgctgcattggatgttgttcaggaccttgcatggactaccaatgcaatgtttctgaggtcggttgatagattcaatgaccttgttgtgtctgtttatgtaactgctggtcatatccttccagtaccatgatattgatctgttttacttttatagaaaccttatactatcaattaaagatttttgaaataataaagttgcaaccaatgtaagttgcatagcaattattctatttgaacagttgctcttatcccttccaaattagtgaactgtggcagaacatggaatatttgctgtcatatttttttcataatcagcatgtgatcaccatgacttctgtttctattttccctctgatgttctatttgtcctagtctcttttttttggcttccttgacgaacaatgtggtacatactagatttatgttgcttcatgactcacggagtgatgatggaataaaaagtttcttttcaggaggttcatgacctctacatcaagagtt

SEQ ID NO: 38688 - protein, 82 aa, Panicum virgatum
  misc_feature: Ceres CLONE 1995060
  misc_feature (9)..(81): Pfam Name: Sedlin_N Pfam Description: Sedlin, N-terminal conserved region
  misc_feature: Useful for biocontainment applications
MASTACFVIVSKNDIPIYEAEVGSAPKKEDLAYQHQFILHAALDVVQDLAWTTNAMFLRSVDRFNDLVVSVYVTAGHILPVP

SEQ ID NO: 38689 - DNA, 741 bp, Panicum virgatum
  misc_feature: Ceres CLONE 1995070
  misc_feature: Encodes the peptide sequence at SEQ ID NO. 38690
atctgctggctccccatccaacccatcgcaaatcttcatcctcaagcaccaagcaagaagaaccagctgaaatcacgcgtccaagaacacaccaagcaagaagaaccagctgaaatcacgcgtccaagaacgccccccgcctccattagaaattttagcattggattggagccaccaccaccaatggcttgttccaccgcatctctagcggcgacgctgctggcgttcgcgctgctgttcgaggcatgcctcgccgggaggcggctcaccgcgcttgtgcaggagccggccatcaccatgaagtaccacaagggcgcgctcctgtcgggccgcatcgccgtcaacttcatctggtacggcaacttctccgcgccgcagcgcgcggtcatcaccgacttcgtctcgtcgctgtccgcggccccggcggcggggcagccggagccgtcggtcgccacctggttccggacggcgcgcaagtactacgccaactccaaggcgcggttcccggcgctgcacgtcggctcccacgtcctcgacgcgtcctactcgctcggcaagcgcctctcggacggcgacctcctcaagctcgccgccaagggggccccgagccgcgccatcaacgtggtgctcaccgccgccgacgtcgccgtggacgggttctgcatgtcccggtgcggcacgcacggcgcgtccccgcggtcccgctccggccgggtcgcgtacgtgtggggtggggcatcc

SEQ ID NO: 38690 - protein, 185 aa, Panicum virgatum
  misc_feature: Ceres CLONE 1995070
  misc_feature (39)..(185): Pfam Name: Phi_1 Pfam Description: Phosphate-induced protein 1 conserved region
MACSTASLAATLLAFALLFEACLAGRRLTALVQEPAITMKYHKGALLSGRIAVNFIWYGNFSAPQRAVITDFVSSLSAAPAAGQPEPSVATWFRTARKYYANSKARFPALHVGSHVLDASYSLGKRLSDGDLLKLAAKGAPSRAINVVLTAADVAVDGFCMSRCGTHGASPRSRSGRVAYVWGGA

SEQ ID NO: 38691 - DNA, 691 bp, Panicum virgatum
  misc_feature: Ceres CLONE 1995086
  misc_feature: Encodes the peptide sequence at SEQ ID NO. 38692
actaagcaacccccaaagctagctctcccctccccttgcgatcggagatcccgcgatgcaggccccagcgcccccttcctccgtcgacctgccgctggcggccgcgctgccctcgggctccgcccaccgccgcatcgccatcgccgtcgacctctccgacgaatccgcctacgccgtgcgctgggccgtcgccaactaccttcgccccggggacgccgtcgtcctgctccacgtgcgccccacctccgtgctctacggcgccgactggggcgccgtcgacgtctccctccccaaccctagagacggcgacgagggcgacgacgacgacgaggccgccgcgcgcaggatggaggatgactacgacgccttcacggcctccaaggccgacgacctcgccaggccgctcaaggacgcgggcatcccctataagatccacatcgtcaaggaccacgacatgaaggagcgcctctgcctcgaggtcgagaggctcgggctcagcgcggtcatcatggggagcaagggcttcggcgcctcgcggaggaccagcaaggggaggctcggtagcgtcagcgactactgtgtccaccactgtgtctgccccgtcgtggtggtgcgcttccctgacgaaggctcctcggaggatggggaggctggtggcctgtcgtcagcggtgggtgcggaggatgtgctg

SEQ ID NO: 38692 - protein, 211 aa, Panicum virgatum
  misc_feature: Ceres CLONE 1995086
  misc_feature (23)..(187): Pfam Name: Usp Pfam Description: Universal stress protein family
MQAPAPPSSVDLPLAAALPSGSAHRRIAIAVDLSDESAYAVRWAVANYLRPGDAVVLLHVRPTSVLYGADWGAVDVSLPNPRDGDEGDDDDEAAARRMEDDYDAFTASKADDLARPLKDAGIPYKIHIVKDHDMKERLCLEVERLGLSAVIMGSKGFGASRRTSKGRLGSVSDYCVHHCVCPVVVVRFPDEGSSEDGEAGGLSSAVGAEDV

SEQ ID NO: 38693 - DNA, 602 bp, Panicum virgatum
  misc_feature: Ceres CLONE 1995089
  misc_feature: Encodes the peptide sequence at SEQ ID NO. 38694
actccgctccgctccgtccccattcccctcccctccggcgagaggcgaaccgaatccatggggagctcctccaacaccaacacgagcggcggtggcggcgacaaggacgacaagaaggaggacaagggcaagggcaaggactcggcggagccatccttcaaggagggcgacagggtcctcgcctaccacggccccctcctctacgaggccaaggttcaaagaatcgaaaatctggacaatgaatggcgctacttcgttcattacctgggctggaataagaactgggatgaatgggtcgcgaatgatcgcttattgagtttgacagacaaaaatgtccgcaaacaacaatagcttgaaaagaaccaggctgttgacaaatcaatcaagtccggacggtcgacacagcataaacaaaaaggctccaatgaagcaaaagctgataaagacgactcgaagagccttgtcaaggggaagaaacgcaagagtcagcctgggactgaggagaaggaaagaagatcatcaaaaagtctcctagagtcacagtttcctttgacacctgaagaagcaacttgtggatgattgggagtatgtcacacagatgg

SEQ ID NO: 38694 - protein, 97 aa, Panicum virgatum
  misc_feature: Ceres CLONE 1995089
  misc_feature: SWISSPROT Homolog: EC 2.3.1.48 Histone acetyltransferase
MGSSSNTNTSGGGGDKDDKKEDKGKGKDSAEPSFKEGDRVLAYHGPLLYEAKVQRIENLDNEWRYFVHYLGWNKNWDEWVANDRLLSLTDKNVRKQQ

SEQ ID NO: 38695 - DNA, 687 bp, Panicum virgatum
  misc_feature: Ceres CLONE 1995099
  misc_feature: Encodes the peptide sequence at SEQ ID NO. 38696
agaaagcgagccacctaaacgggacaggccagatggtcctccgcggctgccaccgcttcgctcacctgcgcctcttctccttcctctccatggcggcgccccagcaacccggcaaaaccctcctccgccccaacccctcgccttcccccgcaggctcggtgcccaaaaggtccaggatgatggccacggacgcggcggcggcgattggtcccccagcctccaagggatgccccgagatgaaggccgagttcgccaagcacgccgaatacctcaatgccctgaacgataagagagaaaggcttgtcaaagcaagtcgtgatattacaatgaacagcaaaaaggtcatctttcaggtccacagaatcagtaaagttaacaaggaagaggttctgtccaaggcagaaaatgatcttgctgcagttgttaaccaatacattggaaaattagtaaaagaattacagggaactgacttctggaagctcagaagagcctatacctttggtgtacaagaatatgttgaagctgcaacgctgtgtaggttctgtaagactggcactctattaagtcttgctgaaatcaatgcttctttactagcactaagcgataaatctgttgagcccttacagataaatgtacttgattatctcttaggggttgctgatttgtcaggagaactaatgaggcttg

SEQ ID NO: 38696 - protein, 218 aa, Panicum virgatum
  misc_feature: Ceres CLONE 1995099
  misc_feature (84)..(218): Pfam Name: Translin Pfam Description: Translin family
MVLRGCHRFAHLRLFSFLSMAAPQQPGKTLLRPNPSPSPAGSVPKRSRMMATDAAAAIGPPASKGCPEMKAEFAKHAEYLNALNDKRERLVKASRDITMNSKKVIFQVHRISKVNKEEVLSKAENDLAAVVNQYIGKLVKELQGTDFWKLRRAYTFGVQEYVEAATLCRFCKTGTLLSLAEINASLLALSDKSVEPLQINVLDYLLGVADLSGELMRL

SEQ ID NO: 38697 - DNA, 697 bp, Panicum virgatum
  misc_feature: Ceres CLONE 1995100
  misc_feature: Encodes the peptide sequence at SEQ ID NO. 38698
aaaaattgtgttgcattgccgtcggttatatgaacactaccctactctagtctcttgccttgtgttgcaaaattagtaccaagaaagaagatgcggggtttgaggagctcaagcagcctactagtggcggcagcagcactgctgctcttctgctgctgcttcaccattggggacgccaatggcggccttaggctgggttactactcggcgagctgcccgcgcgcggaggacgtcgtcagggagcaggtggcgcagctgtacgacaagcacggcaacacggcggtgtcgtggctgcgcgccctgttccacgactgcatggtcgggtcctgcgacgcgtcgctgctgctggacacgagcgccgccgcgggcgtctccgagaagtccgccccgcggagcttcggcatgcgcacgggccggctggacagccgggtgagccgctacgacgaggtggggcgcgacctccccaaccacaacgacagcgtgtcggcggtgctgtcccggttcgcggccgtgggcgtggacgccgagggcgcggtggcgctgctgggcgcgcactccgtcggccgcgtgcactgcttcaacctggtggggcggctgtacccgtcggtggacgccggcatggacccggcctacggcgcctacctccgggggcggtgcccgacggcggacgccagggaggacacgcgcgacgtcgcgt

SEQ ID NO: 38698 - protein, 202 aa, Panicum virgatum
  misc_feature: Ceres CLONE 1995100
  misc_feature (49)..(202): Pfam Name: peroxidase Pfam Description: Peroxidase
  misc_feature: SWISSPROT Homolog: EC 1.11.1.7 Peroxidase
MRGLRSSSSLLVAAAALLLFCCCFTIGDANGGLRLGYYSASCPRAEDVVREQVAQLYDKHGNTAVSWLRALFHDCMVGSCDASLLLDTSAAAGVSEKSAPRSFGMRTGRLDSRVSRYDEVGRDLPNHNDSVSAVLSRFAAVGVDAEGAVALLGAHSVGRVHCFNLVGRLYPSVDAGMDPAYGAYLRGRCPTADAREDTRDVA

SEQ ID NO: 38699 - DNA, 1626 bp, Panicum virgatum
  misc_feature: Ceres CLONE 1995113
  misc_feature: Encodes the peptide sequence at SEQ ID NO. 38700
accagttcagatctactccactgccacctcctctccctccctccctccgagccgcctcccatggcgtctcccacaggaaaccctaaccctaatcccaatccaccattcgagctggggaagctcttcaggccaccgaaccccatgcccaccgccaccgccgcccccatcttccccggcgccgccggaggcccggcaggcccgccgccgccgtctggcccctactcctaccctccggtgaccccgcccttccaccgcggaccctacctgcactacccgcaggacccccacgccatgccccgccccgtcgtctccttccccatgccaaacccaaacctcaaccccaacccgagcgctaaccccaacgccgctgccccgggccccaaccccggcgtgcgcctcatgcagctgcttggaaactccgggtcgacccaactcgagactgccgtctccatgcccccgccgacgtcggagttcgcgcagccgctcccggcgatgccgtccgcgccaccggcgaggatgctgagcagcaccagcagcaaggtgcccagggggcggttgcttggcggtggggaacgagcggtgcacgatattgactcgaggttgcctggggaggcgcatccaccacagctggaggtgacaccgatcaccaaatacacgtcggatccggggctcgtgctgggcaggcagatcgcggtgaaccgaacgtacatcgtgtatgggctcaagctcgggaacatccgcgtgctgaacatcaacaccgccctccgctcactcctccgaggccacacacagagggtgacggacatggctttctttgctgaggatgtccatcgattggcaagcgtgagcgtagatgggcggatatatgtgtggaggattgatgaggggcctgatgaggaaaataaaccacaaattactggaaagattgaaattgccatccaaattgtaggcgatgttgaagcttaccatccaaggatatgttggcactcacataagcaagagattctgtttgttggaattggaaactgtgtgttgagaatagacacaactaaagtgggaagaggaagagactttgccgtggaagaacctgttaaatgtcatctcgagaaacttattgatggtgttcgcttagttggtaagcatgatggcgatgtgacggatttgtccatttctcaatggatgagtacccgcttggcctcaggatcaaaggatggcacggtaaagatctgggatgatcgcaaaccagttcctttgtcaattctgaagccacatgatggccaagctgtttactcagttgctttccttacagcacctgagcggccaaatcatataaatctaattacagcggtacgtagtcatatgttgtttgtgagtggatgaacggccaggccaccaaagttcaagtcctcgttgaggcaaatttgggagtcctttatcgtttttcatataaaagctaaatagtaggatggtctagttttttttttttttgtagatttgttcatctttattctgctcgcttattcttttaagcttgtgatcttttgtgtcttgtaaacttctttttttttctggcacgctatgttgagccaacattattcacccaatccatatagacatctggcaacc

SEQ ID NO: 38700 - protein, 439 aa, Panicum virgatum
  misc_feature: Ceres CLONE 1995113
  misc_feature (352)..(391): Pfam Name: WD40 Pfam Description: WD domain, G-beta repeat
  misc_feature (233)..(272): Pfam Name: WD40 Pfam Description: WD domain, G-beta repeat
MASPTGNPNPNPNPPFELGKLFRPPNPMPTATAAPIFPGAAGGPAGPPPPSGPYSYPPVTPPFHRGPYLHYPQDPHAMPRPVVSFPMPNPNLNPNPSANPNAAAPGPNPGVRLMQLLGNSGSTQLETAVSMPPPTSEFAQPLPAMPSAPPARMLSSTSSKVPRGRLLGGGERAVHDIDSRLPGEAHPPQLEVTPITKYTSDPGLVLGRQIAVNRTYIVYGLKLGNIRVLNINTALRSLLRGHTQRVTDMAFFAEDVHRLASVSVDGRIYVWRIDEGPDEENKPQITGKIEIAIQIVGDVEAYHPRICWHSHKQEILFVGIGNCVLRIDTTKVGRGRDFAVEEPVKCHLEKLIDGVRLVGKHDGDVTDLSISQWMSTRLASGSKDGTVKIWDDRKPVPLSILKPHDGQAVYSVAFLTAPERPNHINLITAVRSHMLFVSG

SEQ ID NO: 38701 - DNA, 689 bp, Panicum virgatum
  misc_feature: Ceres CLONE 1995115
  misc_feature: Encodes the peptide sequence at SEQ ID NO. 38702
agggggccgggagagggagagaggaggccaggagggggcgcagcagcggcagtggccggcatgacgtcgggggcggcggtggccgccacgggcgggctgggacgcacgccgacgtggaaggagcgggagaacaacaagcggcgcgagcgccggcgccgggccatcgccgccaagatcttcacggggctccgcgcgctcggcaactacaagctccccaagcactgcgacaacaacgaggtgctcaaggcgctctgccgcgaggcaggctgggtcgtcgaggacgacggcaccacctaccggaagggatgcaagccgccgccggggatgatgagcccgtgctcgtcgtcgcagctgctcagcgcaacgtcctcgagctacccgagcccggtcccgtcctaccacgccagcccggcgtcgtcgagcttcccgagccccacgcgcctggaccccagcagcggcagcaacacccacaacccgggcgccgccgccgcggcctcctcgctcctaccgttcctccggggcctccccaacctcccgccgctccgcgtctccagcagcgcccccgtcacgccgccgctctcctcgcccacggcggcgtcgcgcccgcccaccaaggtccgcaagcccgactgggacgccgtcgccgtcgacccattccggcaccccttcttcgcggtctcggcccccgc

SEQ ID NO: 38702 - protein, 209 aa, Panicum virgatum
  misc_feature: Ceres CLONE 1995115
  misc_feature: Useful for making plants with modulated nitrogen use efficiency
MTSGAAVAATGGLGRTPTWKERENNKRRERRRRAIAAKIFTGLRALGNYKLPKHCDNNEVLKALCREAGWVVEDDGTTYRKGCKPPPGMMSPCSSSQLLSATSSSYPSPVPSYHASPASSSFPSPTRLDPSSGSNTHNPGAAAAASSLLPFLRGLPNLPPLRVSSSAPVTPPLSSPTAASRPPTKVRKPDWDAVAVDPFRHPFFAVSAP

SEQ ID NO: 38703 - DNA, 1529 bp, Panicum virgatum
  misc_feature: Ceres CLONE 1995129
  misc_feature: Encodes the peptide sequence at SEQ ID NO. 38704
ccccacggaactctgctcctcttcgcagagcactagacgacgagaaggggaagggcaggcaggctggcggcggcgcgccggaagaggaacagacggcggcggcaccggaagcggactccggccgcgcaccgcactccacctgggaaggcgccgccgatgtcgtccggcgtcccggcgccggaggggcgacctgaagccgccgccgtcgacagcgtcctgcccagcgaactgctgatcgagatcctgctgcttctcccgcccggggatgtctgccgcgtccgcgccgtctgcccctcctggcggtccctcacctacgacccgctcttcgtcgcggcctacgccgccggccacccgggcccgctccttgccgtgcacaacggcggcggctgcttagatctcgtggacctgtccagggatgtcgtcaaacagcttcgcaccaccatggagggctattacgatcccagggtgctctgcacgcgcttcgagtatatcttaatccagggtcaagaccacattatcagtgtgctcgaccctgtctctgggtctgtctccaccttacctgttggcattgcggagggtcttgaatgtcctggcccggggtacccttcctggcttgcatttgggcaggtagcttccacaggagagtacaagctcgttcgcattgtgcgagatgatagacatggcgatgatcttcaattgtgcgaggttttcacatttggagaagagattggacactgggggaggaatggtaatccaccaggtggaattggacagtggagggaggtagatagtccgccagcacatctcagtccaagtcgcaccaatggggtggttgttaaaggaagtgcctacttcttctttgatcgatggctgtttctactttacatcgacggctacaacatcgagcctggctgtataccttccttcaacctggagacggagcagtggagtgtggctgtccaagagccgataagccaaattattgagaaatccaatggcttgcttgattacagagacattgttcaccagataatgttaggtgaacataaagatttcttggttacagttcacgacaataagaagacctccaccatagacttgtggtttttgatggacgttgaaaattctttatggtccagacagcacatcatacaaattggcaatattccaggtagtatgctaggtgttcagcctgtattggtgttagatgagggacggataatcctattggtccggacacagtcaaaagattggttgtggatttacagtccaggaatcaacagtacaatgccacacttctataagtgatgacaagttcttcatatgctggagttggaatatatacaggaagtctgttgtgttgatagtgtggctacaaaggtgacatactatttcaagtcatggaacttattgggggcatttatgtagttacttgatccataaatgttcatctattgcttttttcaataatgggaataggcgatgcagtaatacatgttctgctgaacggacaaattattccctttttc

SEQ ID NO: 38704 - protein, 383 aa, Panicum virgatum
  misc_feature: Ceres CLONE 1995129
  misc_feature (16)..(63): Pfam Name: F-box Pfam Description: F-box domain
MSSGVPAPEGRPEAAAVDSVLPSELLIEILLLLPPGDVCRVRAVCPSWRSLTYDPLFVAAYAAGHPGPLLAVHNGGGCLDLVDLSRDVVKQLRTTMEGYYDPRVLCTRFEYILIQGQDHIISVLDPVSGSVSTLPVGIAEGLECPGPGYPSWLAFGQVASTGEYKLVRIVRDDRHGDDLQLCEVFTFGEEIGHWGRNGNPPGGIGQWREVDSPPAHLSPSRTNGVVVKGSAYFFFDRWLFLLYIDGYNIEPGCIPSFNLETEQWSVAVQEPISQIIEKSNGLLDYRDIVHQIMLGEHKDFLVTVHDNKKTSTIDLWFLMDVENSLWSRQHIIQIGNIPGSMLGVQPVLVLDEGRIILLVRTQSKDWLWIYSPGINSTMPHFYK

SEQ ID NO: 38705 - DNA, 1544 bp, Panicum virgatum
  misc_feature: Ceres CLONE 1995135
  misc_feature: Encodes the peptide sequence at SEQ ID NO. 38706
ctgattggggcattttcccttttccaacgagtcaccggcgcttcgccgcggcaggagcctagagcgcgagaccgagcagaaatgtcgacgatgctggcggcgcggctggattccactgccatcccctcaccccagttgccctcgccaagcatccgcctccgcttctcgccgcccgcaggctcccgctcccgctccctcgccccgcgggcggcggcctcggcgaccgccgtcgccactaaaccggcggcggcggctgcggctcccttgtccgcggatcgcaccgtcgtgcgcattgggctccccagcaagggccgcatggcggagcaaaccctaagcctcctcaagagttgtcaattgtcggtgaggcagctcaacccacggcagtacactgccgacatcccgctgattccaaatctggaggtttggtttcaaaggcctaaagacattgttcgtaaactgcagtcaggggatcttgaccttggtattgtgggttttgacacagtcagtgaatacgggcaggtcaatgatgacttagtagttgttcatgatgctctggatttcggacagtgtcgtttatcccttgcggtacctaagggaggcatttttgaaaacatacactccgtggaggatatggcaaagatgcctgaatggactgaagaacaaccactacgtgttgttacaggatttggatatctaggtgctaagtttttgaaagagaatggttttaagcatgttcgtcttttatctgctgatggagcactcgagtcatttcctcctatgggtatggctgatgctatcgtggatctcgtgagtagcggaacgaccttgcgtgagaataacctgaaggaaattgaaggtggagtagttttggaaagccaggctactcttgttgcaagtaggagatctctgcacaaacgtaatggtgtgttggagattactcatgagctgcttgaaagattagaagctcatctcagagcgagcacggagcttatggtcacagcaaacatgagaggcaatagtgcagaagatgtcgcggagagagttcttagcttgacatcaatatgcggattgcagggcccaactataagtcctgtctattgccgacgcgatggcaaggttgctgtggaatactatgctatgaatgcggttgttccacaaaagttgctttacaaggctattcaacaactgagatctattggtggcagtggagtcttggtgacaaagcttacttacatatttgatgaagaaacactcaggtggcgcgatcttctcacagaactggggttgtaacttggtgcgaaagaaactgagcctcatttgcaatgcctgccatggtctcatcattccaggaaatttttgtaccatcgtgtatacatagttacatactctagctaggcatcagttgcgtgagagtatctgttgtaccagttgattagatatcagattccgttgctgggtgtgtgttctgtgtgccaatcacgcatgccgcagttctgaataattgggcatgttgaaatgaataaagcccaaaacgtttgcctccg

SEQ ID NO: 38706 - protein, 402 aa, Panicum virgatum
  misc_feature: Ceres CLONE 1995135
  misc_feature (117)..(297): Pfam Name: HisG Pfam Description: ATP phosphoribosyltransferase
  misc_feature (298)..(385): Pfam Name: HisG_C Pfam Description: HisG, C-terminal domain
  misc_feature: SWISSPROT Homolog: EC 2.4.2.17 ATP phosphoribosyltransferase
MSTMLAARLDSTAIPSPQLPSPSIRLRFSPPAGSRSRSLAPRAAASATAVATKPAAAAAAPLSADRTVVRIGLPSKGRMAEQTLSLLKSCQLSVRQLNPRQYTADIPLIPNLEVWFQRPKDIVRKLQSGDLDLGIVGFDTVSEYGQVNDDLVVVHDALDFGQCRLSLAVPKGGIFENIHSVEDMAKMPEWTEEQPLRVVTGFGYLGAKFLKENGFKHVRLLSADGALESFPPMGMADAIVDLVSSGTTLRENNLKEIEGGVVLESQATLVASRRSLHKRNGVLEITHELLERLEAHLRASTELMVTANMRGNSAEDVAERVLSLTSICGLQGPTISPVYCRRDGKVAVEYYAMNAVVPQKLLYKAIQQLRSIGGSGVLVTKLTYIFDEETLRWRDLLTELGL

SEQ ID NO: 38707 - DNA, 717 bp, Panicum virgatum
  misc_feature: Ceres CLONE 1995142
  misc_feature: Encodes the peptide sequence at SEQ ID NO. 38708
accctccccaccgccacccttctctccttcccgtcctccgcatctccctttagcattctctgccccctccacccatctcctcgccgccgctgacgaccgccgccgcgaaccctcgccaatctccgtcctccgggttgtgggggcacgcatggcgctccggaggctgctgcatgggagcgtcctgccgcgggtgtccggccgggcctttgccccggccgtggcgcccttctccacggaggctggggagaccgtccgcgccacgctcttcccgggtgacggcatcgggcctgagatcgccgagtccgtcaagcaggtattcaatgttgcaggtgtaccaatagaatgggaagaacattatgttggcacggaagttgatcccagaacagagagtttcttgacatgggaaagcctggagtctgtgcgtagaaacaaagttggcttaaaaggacctatggctactcctattggaaagggccatcgatcattgaatcttacattaaggaaagagcttggtctttacgccaatgtcagaccttgcaacagcctcccaggctacaagaccagatatgatgatgttaaccttgtgacaattcgtgaaaatactgaaggagaatatagtggtcttgagcatcaggttgtgagaggtgtcgttgaaagtttgaaatcatcacccgccaagcaagtttgagagtggcagagtatgctttccattatgcc

SEQ ID NO: 38708 - protein, 179 aa, Panicum virgatum
  misc_feature: Ceres CLONE 1995142
  misc_feature (36)..(179): Pfam Name: Iso_dh Pfam Description: Isocitrate/isopropylmalate dehydrogenase
  misc_feature: SWISSPROT Homolog: EC 1.1.1.85 3-isopropylmalate dehydrogenase
MALRRLLHGSVLPRVSGRAFAPAVAPFSTEAGETVRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKSSPAKQV

SEQ ID NO: 38709 - DNA, 722 bp, Panicum virgatum
  misc_feature: Ceres CLONE 1995143
  misc_feature: Encodes the peptide sequence at SEQ ID NO. 38710
agccgagttccgcagagaaaggcgtcttcgcactcgcctctctccgcgcttcaaagcttctcctcccatttcccacggccgccgccgccgccgccgccgccgcccacccttccgacgacaccatgagggagtgcatctcgatccacatcggccaggccggtatccaggtcggaaatgcgtgctgggagctgtactgcctcgagcatggcattcagcctgatggtcaaatgcccagtgacaagacagttggaggaggtgatgatgcattcaacaccttcttcagtgagactggcgctgggaagcatgtcccccgtgctgtgtttgttgatcttgagcccactgtcattgatgaggtgaggactggcacttaccgccagcttttccaccctgagcagctcatcagtggcaaggaggatgctgccaacaactttgcccgtggtcactacaccattggcaaggagattgttgacctatgccttgaccgcatcaggaagcttgccgacaactgcactggtctccagggcttcctcgtgttcaacgctgttggtggaggaacgggctctggccttggttccctcctccttgagcgcctgtctgttgactatggcaagaagtccaagctcgggttcactgtgtacccatctccccaggtctccacctcagttgttgagccatacaacagtgtcctgtccacacactccctcctcgagcacactgatgtt

SEQ ID NO: 38710 - protein, 199 aa, Panicum virgatum
  misc_feature: Ceres CLONE 1995143
  misc_feature (49)..(199): Pfam Name: Tubulin Pfam Description: Tubulin/FtsZ family, GTPase domain
  misc_feature: Useful for making plants with altered cell wall content and/or composition
MRECISIHIGQAGIQVGNACWELYCLEHGIQPDGQMPSDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTD

SEQ ID NO: 38711 - DNA, 1145 bp, Panicum virgatum
  misc_feature: Ceres CLONE 1995154
  misc_feature: Encodes the peptide sequence at SEQ ID NO. 38712
aaggagtccacctgacgccgcccgcgtctcgcttcgccttccgccatcgatcgatcccttcccccttccctcccctcgctttattcctaccggcgttcggcccccgccccgcaccaacccacccgcccccgccattcccggctgcttcgcttcgcttcgccagcggctcgatccaggcctcggttaggagacgaggcgaaggttagcggcatggcctcgtcgccggcgagcagctacgactgctccttcaaggtcctgctcatcggggactcggccgtcggcaagagcagcctcctcgtcagcttcgtctccgcggcccacatggacgacgacatcgcgcccaccataggggtggatttcaaaatcaaatttctcactgtgggtggcaagaaactgaaactcacaatctgggacaccgctggccaggaaaggtttaggacaattaccagttcttactacaggggtgctcatgggatcattctagtttatgacgtcacgaagagggagagtttcacaaatttggctgatgtctggaccaaggaaatagagttgcactcaacaaataaagagtgcgtcaaaatgcttgttggaaataaagtggacaaggatgaggacagagtggtgacaagagaagaaggtcttgcctttgcacaagaatatgggtgtctgtttctcgagagtagtgccaaaacaagagagaatgtggagaaatgttttgaagagcttgcattaaagattctcgaggttccaagcctcttggaggaaggttcttcagttgttaagaggaacactctgaaacagaagcaggacaatgcaaaccaaagtggaggatgctgtcagtagatccaccagctatgcaagctgctcatggtatcttaggttttagctgcccctgaattgggatgtagatgagttgtatctaaatgctcgatggcacgcaaccaatgcgagtaaagggagaattaaccacttgaggttttggtgtgaattggtctgtacaaaaggaaagccttttttttttagggttcctgacgtggcaatttggtttgctggttgtaatgagatccattcagctgatcacttccttaattgtatgtctggaagtgtatgctggtatataattcagggcttgtagttagctacgg

SEQ ID NO: 38712 - protein, 210 aa, Panicum virgatum
  misc_feature: Ceres CLONE 1995154
  misc_feature (14)..(178): Pfam Name: Ras Pfam Description: Ras family
  misc_feature (14)..(131): Pfam Name: Miro Pfam Description: Miro-like protein
  misc_feature: SWISSPROT Homolog: EC 2.7.11.1 Non-specific serine/threonine protein kinase
  misc_feature: Useful for making plants with altered lignin content
MASSPASSYDCSFKVLLIGDSAVGKSSLLVSFVSAAHMDDDIAPTIGVDFKIKFLTVGGKKLKLTIWDTAGQERFRTITSSYYRGAHGIILVYDVTKRESFTNLADVWTKEIELHSTNKECVKMLVGNKVDKDEDRVVTREEGLAFAQEYGCLFLESSAKTRENVEKCFEELALKILEVPSLLEEGSSVVKRNTLKQKQDNANQSGGCCQ

SEQ ID NO: 38713 - DNA, 699 bp, Panicum virgatum
  misc_feature: Ceres CLONE 1995179
  misc_feature: Encodes the peptide sequence at SEQ ID NO. 38714
gacgccctcgtaccaagactcgccgctcgccgctcgccgccagcatctcgcgtcccgacaatctgccgcagaagaatcggccccagtccccgtctcttctcctcctcctccccctccttccccattctaccagccgcggccatggccaccgacagcgccgcccccgccgggtccaagagtaagctgctcgtcttcgattccgtggaagatctcgcggtgtctctggcgaagtacaccgctgagctgtctcagaagttcgccaccgagaggggcgccttcaccgtcgtgctctccggcggatccctcatcgactcgctcagcaagctgacggagccgccgtacctggaatcggtggactggagcaagtggcacgtcttctgggtggatgagagagtcgtgcccaaggatcatgaggatagcaactacaagctcgccttcgatgggtttctctccaaggtgccgattcctcctgggcaagtttatgctataaatgatgccttgtcagctgagggagcagcggatgactacgaagcttgcttgaagcagcttgttaagaatggtgtgattgccatgtcaacagcaactgggtttcccaggtttgatctccagcttcttggaatgggacctgatggccacattgcctctctcttccctggtcaccctcttgttaatgagaaagagaggtgggtcacctacatc

SEQ ID NO: 38714 - protein, 232 aa, Panicum virgatum
  misc_feature: Ceres CLONE 1995179
  misc_feature: SWISSPROT Homolog: EC 3.1.1.31 6-phosphogluconolactonase
  misc_feature: Useful for biocontainment applications
  misc_feature: Useful for making plants with modulated flowering time
DALVPRLAARRSPPASRVPTICRRRIGPSPRLFSSSSPSFPILPAAAMATDSAAPAGSKSKLLVFDSVEDLAVSLAKYTAELSQKFATERGAFTVVLSGGSLIDSLSKLTEPPYLESVDWSKWHVFWVDERVVPKDHEDSNYKLAFDGFLSKVPIPPGQVYAINDALSAEGAADDYEACLKQLVKNGVIAMSTATGFPRFDLQLLGMGPDGHIASLFPGHPLVNEKERWVTY

SEQ ID NO: 38715 - DNA, 1163 bp, Panicum virgatum
  misc_feature: Ceres CLONE 1995183
  misc_feature: Encodes the peptide sequence at SEQ ID NO. 38716
ctctccctgtctctcgtcctctctctctgacggcgtggggccgagatgcagtggttctcctccggctccgggccctcctcctcggcggcggcgtcctcctcccagccgtcgctgctcgcggattggaactcctacgccgccgcccgctccgccgaggacgcgggcgatggcttcgggatcgacatcgaggccgccgtccgctccgccaacgaccgcgtcgccggcaccttcggcgtggtctcaaaaggtgttaaagggttgcctggcagcttcaagtccacaacaagcagtgttacatctggcggatctctcatgtatttcggactgtttcttgctagtggcgtattcctagttttcattgcattcacaatatttctgccagtcatggtgataatgcctcaaaagtttgcaatctgtttcacggcgggatgtgccttcataatcggatcattctttgcactgaaagggcctaagaatcagctctatcatatgatttccaaagagagattacctttcaccgtgggatttgtcggcagcatggttgccaccatttatgtgtcaatggtgcttcatagctacatactttctgttttcttctccgtgcttcagcataaataggaccatccctgctcttcctgctgtctgctagggacaactctgaagagaaacctgaatctatgaataagccatgtccttgctctagcatattatgccatctcatacttccctggtggatctgctggaatgaagtttctatcatctgctcttgtgtcctcggtgctgagatgctttgggcgatgagttttcacctgactgcttcccagtgctgattgaagaactgatatggaacgatctagtgctctgtgtatcatcttcattgttatggcatgggccgcttcattactcccagaagtttgatgctacattgaagcaccgggtgcccagttatacagtaacttgattttgaggaatgatgttgggcccaacgcttgtaaggtagaaaaatgaagaactcaggttgcctgcatagagtttggttgcatcaatttagattttttcgaaatagaacgaatttagactgagatcacattgtacaaagtatctcaaaactgggccacgatgtttttctttagaaaaaaaaaactgggcctcaatttgtgctc

SEQ ID NO: 38716 - protein, 190 aa, Panicum virgatum
  misc_feature: Ceres CLONE 1995183
  misc_feature (83)..(188): Pfam Name: SFT2 Pfam Description: SFT2-like protein
MQWFSSGSGPSSSAAASSSQPSLLADWNSYAAARSAEDAGDGFGIDIEAAVRSANDRVAGTFGVVSKGVKGLPGSFKSTTSSVTSGGSLMYFGLFLASGVFLVFIAFTIFLPVMVIMPQKFAICFTAGCAFIIGSFFALKGPKNQLYHMISKERLPFTVGFVGSMVATIYVSMVLHSYILSVFFSVLQHK

SEQ ID NO: 38717 - DNA, 1281 bp, Panicum virgatum
  misc_feature: Ceres CLONE 1995194
  misc_feature: Encodes the peptide sequence at SEQ ID NO. 38718
accggcgcaatccgtgcagtcgtgcaatccatccaccccccacccgcacgcacgcccaccggaaatctcctttcttttcccgcgactgggcggcggagatgaagttcggcaagagcctcagcgggcagatcgtggagacgctgccggagtggcgcgacaagttcctgtcctacaaggacctcaagaagcgcctcaagctcatcggcgccgggaacggggccgagcggcagcccaagcgggcccgccgcgacgacgccggggaggccgacgcgtccccggcggcggcgatgacgcccgaggaggcggatttcatgcggctcctgggggccgagctcgacaagttcaactctttcttcgtcgagaaggaggaggagtacatcatccgccagaaggagctgcaggacctcgtggccagggtggccgggcaggagtccaaggaggagctcatgcgggcgcgcaaggagatcgtcgacttccacggcgagatggtgctgctcgagaactacagcgccctcaactacaccggactggttaagatcctcaaaaaatatgacaagagaactggagccctgatccggctgcccttcatccagaaagtcctgcagcagcctttcttcaccactgaccttctatacaaacttgtgaagcagtgcgaagccatgctggagcagttcctaccgactagtgaaccatctgtatcaagggaagatggaaaaggagatagcaatgatgaagaaaaaccagcaaatcccacttcttccttgttaaacggcgatggtattccagaattagatgagattgagtacatggagagcatgtacatgaaaagcacagttgcggcgcttaggtctctgaaggagatccggagcaagagttcgactgtcagcatgttctcgttgccaccacttcagggcaacaatgtgcccgaagagccagagaggtggaacaaaatacctgtgatagagcaggctgccaaatgacatgacgagtgtgcaacatcagatgcttcaactcgcaacaattttagtcttgacatttgctggagatggaactgggatgtgggatctcaatctccctgtcgtatattcagtaatctgtatgaattcaggattcctaacagatgtaaaatggtggaaatgttgatcaatataccttgttaaatcatagaatcccagcataaccgtcagacagaagtgaggtggtttattcactattgtgaattgatcctgtatttttgctgatctacaagtattaactgagttttatcatttgggattgctg

SEQ ID NO: 38718 - protein, 293 aa, Panicum virgatum
  misc_feature: Ceres CLONE 1995194
  misc_feature (1)..(168): Pfam Name: SPX Pfam Description: SPX domain
  misc_feature: SWISSPROT Homolog: EC 3.1.4.46 Glycerophosphodiester phosphodiesterase
MKFGKSLSGQIVETLPEWRDKFLSYKDLKKRLKLIGAGNGAERQPKRARRDDAGEADASPAAAMTPEEADFMRLLGAELDKFNSFFVEKEEEYIIRQKELQDLVARVAGQESKEELMRARKEIVDFHGEMVLLENYSALNYTGLVKILKKYDKRTGALIRLPFIQKVLQQPFFTTDLLYKLVKQCEAMLEQFLPTSEPSVSREDGKGDSNDEEKPANPTSSLLNGDGIPELDEIEYMESMYMKSTVAALRSLKEIRSKSSTVSMFSLPPLQGNNVPEEPERWNKIPVIEQAAK

SEQ ID NO: 38719 - DNA, 692 bp, Panicum virgatum
  misc_feature: Ceres CLONE 1995202
  misc_feature: Encodes the peptide sequence at SEQ ID NO. 38720
atgagcgccaccgccttgcgccccggcgcggccatccttcgcgcgctctccgctgcctccgtcgcccacctccacgcgcacgccctgaagctcggcgtactaccctcctgcctccacctctgctcggccctgctcaagtcctatgcagcctccggcagcgtcgccgccgcccgccagctgttcgacgaaatctcgcgccgggacgtcccgctatggaacgccctgttgtccgcctacgcgcgctctggacaccccgtccacgccctgtctgctgcgtccgccatggcgcgcgacgcgggggcccggccaaacggggtctccgtcacgagcctcctgtccgcgtgcgcgcagctgcggagctcggtgcacgggagggagatccacgggtacgcggtgaggagcgtcgtcgatcttgacctacctgtgctcaatgcgttggtgaacatgtacagcaagtgcggtttgctggcgaacgcgaggacagtgttcgcaggcattgcggttggcatgaggagtgctgtttcatggacatccatgatcaatgcttgcgccgagaatgagcgcccaactgaggcactggaaatgttcgtggagatgaggattgctggtgtcaaggtcgatgaggtcaccctgcttgctgtcatctcggcctgcacaaagctggattgcacgtcgagtttgggggactgggt

SEQ ID NO: 38720 - protein, 136 aa, Panicum virgatum
  misc_feature: Ceres CLONE 1995202
  misc_feature (80)..(114): Pfam Name: PPR Pfam Description: PPR repeat
MARDAGARPNGVSVTSLLSACAQLRSSVHGREIHGYAVRSVVDLDLPVLNALVNMYSKCGLLANARTVFAGIAVGMRSAVSWTSMINACAENERPTEALEMFVEMRIAGVKVDEVTLLAVISACTKLDCTSSLGDW

SEQ ID NO: 38721 - DNA, 1527 bp, Panicum virgatum
  misc_feature: Ceres CLONE 1995205
  misc_feature: Encodes the peptide sequence at SEQ ID NO. 38722
aatgttgacgggaaccacgaaaggttcgggtccacctcagggtcgatgggtcacgaacccaattgacctatttcattgagggtcgatccactctcgatccggtacttgatttgagggtcggagcgagtccacgaaaggattgaaccggaccccttgcagggcgacatgcttggatcgatgggtgctcccgttcagctggtgacttcaacggcgcggtggagcgccaaacagctgcagtctgcggtagctgctcgttatggtttgctgcagttgatctccgtgcgcgatctcggcggcgatgctcggcagcctccttgcggaaccatcgtcgccttcgacggcaagcgcgggcaaattctctacaaccggagccgggatcaggacccatctgatcaccctggctgtgattctcagggtgcgcttttgctaaccggtccgtatcgagccatctcggtggaggggagtgtcgccattgaactcgacctctactacgataacggccaacaagacccagaactccagtcggaggacgaggaggaggaaagcatatattgggacagcaagaatccagaatacggcgagcgcatcaccaagagaatcaccactggctgcggccccgtggatgtcacgtacatcgtctggagcagcgcagcggaaggcagcatccaggtgaggtttatccagcgagacggagcggcggatcctgacgactgcatccacgggaggataaccgccgcgtacggcgggtttcccaacgatgcgatcgtgcttttcgacagcaatggcacctgcccaacactgcgacatgaagacctggccgttccgttggcaagatcagtcgtagccgcgccgttcacgcagtccctcacaattacggtggacctatgcgatcactccggcagggagatcgtcagcggctccctcctgttccaccccgacgagctcgacagcaggcagcggcgtctagttggccggaatagtgacgtcgaagtgacgatcacctggtcagactgatatttgccttcacgcaagtggctgcacgatgaaggattcacaccatacgtacatatatggacaggagtgatggtggcatgggtttctgtgtgtacggtgtacccatagtacatacaatgtataaatttactactctctctctctctccatcctaggatataactatatttaggattttccctcattcaaatatttttatttgataaaacgaactctccaaaaatattttattttaaatagaaaatacttcatagtaaaactatgaacatcaaattgagattgtccgtctttataatgttttttgttatttttagtcaaagttgtaaaaaaaagattttacttagagtaagcctaagtgtttttagagggagtaaacctaaatgttagctatattctaggacagagagagtaatgaactacaaaacagtctgtaatcttttacttcaacagttctgtacatagccaccatcacttgtacatgtattatgtaataaataagtccacttttatgac

SEQ ID NO: 38722 - protein, 282 aa, Panicum virgatum
  misc_feature: Ceres CLONE 1995205
  misc_feature: SWISSPROT Homolog: EC 3.2.2.22 rRNA N-glycosylase
MLGSMGAPVQLVTSTARWSAKQLQSAVAARYGLLQLISVRDLGGDARQPPCGTIVAFDGKRGQILYNRSRDQDPSDHPGCDSQGALLLTGPYRAISVEGSVAIELDLYYDNGQQDPELQSEDEEEESIYWDSKNPEYGERITKRITTGCGPVDVTYIVWSSAAEGSIQVRFIQRDGAADPDDCIHGRITAAYGGFPNDAIVLFDSNGTCPTLRHEDLAVPLARSVVAAPFTQSLTITVDLCDHSGREIVSGSLLFHPDELDSRQRRLVGRNSDVEVTITWSD

SEQ ID NO: 38723 - DNA, 685 bp, Panicum virgatum
  misc_feature: Ceres CLONE 1995211
  misc_feature: Encodes the peptide sequence at SEQ ID NO. 38724
aattccccaccccagctcacaaccctaatcacatttcgccgcctccacccccgtcaacctcttccccttctctcgccaaccctagcccacccccggcgagatctgcccagctcgagcagccatggcggatacgctcgacatgaccctcgacgacatcatcaagaacaacaagaagagcaacccctcctccggcgggggccgccgcagcggcggcggatccgcctctggcggcagcggcggcggcggtggcggtggggtcgggccgaccaggcgccccttcaagagggctggaaacaggcaggctccctaccagccgccgaaggcccccgacgcggcgtggcagcacgacatgtaccccgcggtcgccgccaccggtggaggcagcggcgggagggtctcggctatcgagacgggcaccaaactctacatctccaacctggactttggcgtctcgaacgacgacatcaaggagctattctctgagttaggtgatctgaagcgatcttccataaattatgatcgaagtgggaggtctaagggaacagctgaagttgtatttgcacggcgtgctgatgctgtagctgcggtgaagaaatataacaacgtgcaacttgatggtaagcccatgaagatagagatagttgggaccaatactccaacagcagcttctgctcttccactcact

SEQ ID NO: 38724 - protein, 187 aa, Panicum virgatum
  misc_feature: Ceres CLONE 1995211
  misc_feature (101)..(171): Pfam Name: RRM_1 Pfam Description: RNA recognition motif. (a.k.a. RRM, RBD, or RNP domain)
  misc_feature: Useful for making plants with modulated biomass
MADTLDMTLDDIIKNNKKSNPSSGGGRRSGGGSASGGSGGGGGGGVGPTRRPFKRAGNRQAPYQPPKAPDAAWQHDMYPAVAATGGGSGGRVSAIETGTKLYISNLDFGVSNDDIKELFSELGDLKRSSINYDRSGRSKGTAEVVFARRADAVAAVKKYNNVQLDGKPMKIEIVGTNTPTAASALPL

SEQ ID NO: 38725 - DNA, 691 bp, Panicum virgatum
  misc_feature: Ceres CLONE 1995217
  misc_feature: Encodes the peptide sequence at SEQ ID NO. 38726
ctgctgaatgacacgaacggcggggagcagaacgcgcttccgaacgctggatcgctgaggggcttcggcgtcgtcgacagcatcaaggcgcagctggaggctttgtgcccgcagaccgtctcctgcgccgacatcctcaccgtcgccgcccgcgattccgtcgtagcgctcggcgggccttcatggaccgttccactgggaagaagggactctaccaattcaagcgcgaccatggcaaatagcgacctcccacctcctcaatttaacctctcacaacttatccctgcgttccagaacaagaacctcgacacaacagacctggttgctctctcaggtactatacacaattaatgttgtgtatgttcttcgatctgtaacaatgttagttcaataacaatggcggcaggcgctcacactatcggccaggctcgctgcacgaccttccgggaccatatcaccgagcccaacatcaacgctaccttcgccgcgtcgctgagggccaactgccccgccaccggcggcgacaagccgacaacaacctggcgccgctggacgccgcgacgcccaacaccttcgacaacgcctacttcagcaacctggtgtcccagaggggggctcctgcactcggaccaggagctcttcaacaacggcagcaccgacagcattgtccgcaacttcgcctccacgcagc

SEQ ID NO: 38726 - protein, 116 aa, Panicum virgatum
  misc_feature: Ceres CLONE 1995217
  misc_feature (1)..(116): Pfam Name: peroxidase Pfam Description: Peroxidase
  misc_feature: SWISSPROT Homolog: EC 1.11.1.7 Peroxidase
  misc_feature: Useful for making plants with altered cell wall content and/or composition
  misc_feature: Useful for making plants with altered carbohydrate content
  misc_feature: Useful for making plants with modulated nitrogen use efficiency
LLNDTNGGEQNALPNAGSLRGFGVVDSIKAQLEALCPQTVSCADILTVAARDSVVALGGPSWTVPLGRRDSTNSSATMANSDLPPPQFNLSQLIPAFQNKNLDTTDLVALSGTIHN

SEQ ID NO: 38727 - DNA, 718 bp, Panicum virgatum
  misc_feature: Ceres CLONE 1995218
  misc_feature: Encodes the peptide sequence at SEQ ID NO. 38728
accgtttgcaaacatggacgtctcacagtttgccgcactggtgctcggtgctctcgtctccctgctcttcctcgccactaggaggaagctctcctccgatggccggcgtcgtctgcctccgtcgccgccggggcttcctctcctcggccacctgcccctccttggccccctgcctcaccgtaagctccaggccatggccgccaagcacggcccagtgatgctcctgcgcctgggccgcgtgcccaccgtggtggcctcctcggcggccgcggcgcaggaggtcatgaagacccacgacctggccttcgcgagccgccctagggcgcgcatggccgagcgcctcgtctacggccgcgacatggccttcgccccctacggcgagggctggcgccaggcgcgccgcgtttgcgtgctccacctcctcagccagcgccgcgtccacgccttccgccacgcgcgggagcaggaggccgccgcgatggtcgcccgcgtccgccgcgcctcgccgggcggcgtcaacgtcaccgccctcgtcatctcctacaccaacggcatcatctcccgcgccgcgttcggcgaccaagggggattcgggtttggcgacggtgagaagctcaccgggctgttcgccgacttcgaggagctcctcgggacggtcaccatgggggacttcgtgccatggctggcgtgggtcgacgcgctcatgggactggacgcc

SEQ ID NO: 38728 - protein, 234 aa, Panicum virgatum
  misc_feature: Ceres CLONE 1995218
  misc_feature: SWISSPROT Homolog: EC 1.14.13.21 Flavonoid 3'-monooxygenase
MDVSQFAALVLGALVSLLFLATRRKLSSDGRRRLPPSPPGLPLLGHLPLLGPLPHRKLQAMAAKHGPVMLLRLGRVPTVVASSAAAAQEVMKTHDLAFASRPRARMAERLVYGRDMAFAPYGEGWRQARRVCVLHLLSQRRVHAFRHAREQEAAAMVARVRRASPGGVNVTALVISYTNGIISRAAFGDQGGFGFGDGEKLTGLFADFEELLGTVTMGDFVPWLAWVDALMGLD

SEQ ID NO: 38729 - DNA, 715 bp, Panicum virgatum
  misc_feature: Ceres CLONE 1995253
  misc_feature: Encodes the peptide sequence at SEQ ID NO. 38730
ctccgccttcacagccgccgcctctcctcccctggcgccgccgtgacaagcctagctagcgaagcgcgagagccatggcgacccccggacggatcgaactagacaagctcagcgtggagcaggtcaaggggctcaaggagcagacggatctggaggtcaacctcctccacgacagcctcaacaagatccgcacagccatcacccgcctcgacagcgcctccgccgcgctgcaggacctatccctccgcccccacgggaagaagatgcttgtgccgctcacggcgtccctctacgtgcccggctcgctcgacgacgccgagaaggtcctcgtcgacgtcggcactggttacttcatcgagaaaaccatggctcaagggaaagaatactgtgaaaggaaaattaatttgttgaagtcaaatttagatgaactggctgaggtggctacgaaaaagaaagccatagcagatcagatgactctgctgctacataccaagctgaggcaaggatcgcctggcccaagttcatgaaggctctggatgtgttttgcctgtcatgtgtgcaagactacgggtcacagataatttgctgaaccaacctgccccatgaaacatcatcgagttattttgatgttggttctgaacaagcgttgagtaattttgaagctactgttgaacttgctgtgtagattgtttttttgttctctcacacaatgaag

SEQ ID NO: 38730 - protein, 150 aa, Panicum virgatum
  misc_feature: Ceres CLONE 1995253
  misc_feature (24)..(143): Pfam Name: Prefoldin Pfam Description: Prefoldin subunit
  misc_feature: Useful for making plants with modulated heat sensitivity
MATPGRIELDKLSVEQVKGLKEQTDLEVNLLHDSLNKIRTAITRLDSASAALQDLSLRPHGKKMLVPLTASLYVPGSLDDAEKVLVDVGTGYFIEKTMAQGKEYCERKINLLKSNLDELAEVATKKKAIADQMTLLLHTKLRQGSPGPSS

SEQ ID NO: 38731 - DNA, 671 bp, Panicum virgatum
  misc_feature: Ceres CLONE 1995259
  misc_feature: Encodes the peptide sequence at SEQ ID NO. 38732
actgctccgttcctcctcaccaaccaaaccgaccaaaccctctccaatggccgcgcccgtgtcgcagccgccggtggccgccagggcgtccacgcggctcctcccccgcagccgcgggctgggcgcgctcccggaatccgcgcccgcctccctccgcttctccgtcggccgccgccgccgcgccgctcgcctagaggttaaggcatcaggaaatgtctttgggaaccacttccaggttgcaacctatggcgagtctcatggagggggtgttggttgtgttatcagtggttgcccacccagaattcctctcactgaggcggacatgcaagtagagctcgacagaagacgtccaggtcagagtagaataaccactccgagaaaggagactgatacatgcaaaattctatcagggacacatgaagggatgaccactggcacaccaattcatgtctttgtcccaaacacagatcaaagaggcggagattacagtgaaatggctaaggcatacagaccttcccatgcagatgcaacctatgacttcaagtatggtgttagagctgtgcagggaggtggaagatcatcagccagagaaaccattggcagggtggctgctggagctcttgcaaagaaaattctgaagctcaaattctggagtagagatcttggcattt

SEQ ID NO: 38732 - protein, 208 aa, Panicum virgatum
  misc_feature: Ceres CLONE 1995259
  misc_feature (62)..(208): Pfam Name: Chorismate_synt Pfam Description: Chorismate synthase
  misc_feature: SWISSPROT Homolog: EC 4.2.3.5 Chorismate synthase
MAAPVSQPPVAARASTRLLPRSRGLGALPESAPASLRFSVGRRRRAARLEVKASGNVFGNHFQVATYGESHGGGVGCVISGCPPRIPLTEADMQVELDRRRPGQSRITTPRKETDTCKILSGTHEGMTTGTPIHVFVPNTDQRGGDYSEMAKAYRPSHADATYDFKYGVRAVQGGGRSSARETIGRVAAGALAKKILKLKFWSRDLGI

SEQ ID NO: 38733 - DNA, 713 bp, Panicum virgatum
  misc_feature: Ceres CLONE 1995264
  misc_feature: Encodes the peptide sequence at SEQ ID NO. 38734
aacctcccataaagctccgacgccattggtggtgaatctggaggctgtcaacgcctcaaactcgcgtccgccgcacgagtcaaacttgtgcagatcaagttggactttttcagtcagtgtcctggtagtggtaggggattgttttcgcaagtttcagtgcttgtcgctgctataagagtgagacggccatggaccatgttcttgcatgtgcgtcctctctgctcacttgccacgaggtgctccaaggccctctcctgagctctttgtcctccatcagagccggcctcacgatgtacctgatcgaggacaagggcggtgccatcgccgtgatgctggcgtcgctcctgttcctgggcacctggccggccgtgctcacactcctggagcgccggggccggctgccgcagcacacctacctggactactcgctcaccaacctccttgccgccgtgctcatcgcgctcaccttcggccagctcggggacagcaaggacggcatgcccaacttcttcacccagctcagccaggacaactggccttcggtgctgttcgccatggcaggaggtgtggtgctcagcgttgggaacctgtcgacccagtatgcttgggcatatgtgggtctctcggtgactgaggttatcagctccggcatggtggtggtgataggttggtgaaaccactccgctctgtcaggcacaacactgaactacttc

SEQ ID NO: 38734 - protein, 161 aa, Panicum virgatum
  misc_feature: Ceres CLONE 1995264
  misc_feature (48)..(161): Pfam Name: FAE_3-kCoA_syn1 Pfam Description: Fatty acid elongase 3-ketoacyl-CoA synthase 1
MDHVLACASSLLTCHEVLQGPLLSSLSSIRAGLTMYLIEDKGGAIAVMLASLLFLGTWPAVLTLLERRGRLPQHTYLDYSLTNLLAAVLIALTFGQLGDSKDGMPNFFTQLSQDNWPSVLFAMAGGVVLSVGNLSTQYAWAYVGLSVTEVISSGMVVVIGW

SEQ ID NO: 38735 - DNA, 1043 bp, Panicum virgatum
  misc_feature: Ceres CLONE 1995271
  misc_feature: Encodes the peptide sequence at SEQ ID NO. 38736
acttcctcccctcccctcccctcccaccccccggcggcggcctccccctcctccatcccaggcgcacgcaggtcagcgaggtaagcacgcccccctctctcgagctcccccgcgcgcggtggatctgaagccggtggctccccgcgcagatgtcggcggcggaggcgaaggcggcgccggtgccggagtcggtgctgcggaagagcaagcgcgaggagaagtgggcggcggacaagaaggagaaggcgctcgccgacaggaagaaggcgctcgagagccgcaagatcatcttcgcccgcgccaagcagtacgcgcaggagtacgacgcccaggagaaggagcttgtgcagctcaagcgtgaggcccggttgaagggcgggttctatgtcagccctgaggccaagcttctgtttgttgtccgcatccgtggtatcaacgccatgcaccccaagacccgcaagatcttgcagcttctgcgtctgaggcagatcttcaatggtgttttcctcaaggttaacaaggctaccattaacatgctgcgcagggtcgagccatatgttgcatatggatacccgaacctgaagagtgttagggaattgatctacaagagaggttatgggaagctgaacaagcagaggattcctctgagcaacaacagtgtcattgaggagggccttgggaagcacaacatcatctgcattgaggatcttgtccatgagatcatgactgttggcccacacttcaaggaggccaacaacttcctctggccattcaagctgaaggcaccgcttggtggcctgaagaagaagaggaaccactatgttgagggtggtgatgccgggaaccgtgagaactacatcaacgagctcatcaaaaggatgaactaggttcttgtatcctgtgagaatgattccaatgtctgagaagttatactctagggagttgatgctggatcgcgatggatgtgcaattttggcattccaaacagaatgtagacttgttctttcagttaagacttccaataggattttgctgttccaatc

SEQ ID NO: 38736 - protein, 245 aa, Panicum virgatum
  misc_feature: Ceres CLONE 1995271
  misc_feature (14)..(84): Pfam Name: Ribosomal_L30_N Pfam Description: Ribosomal L30 N-terminal domain
  misc_feature (86)..(137): Pfam Name: Ribosomal_L30 Pfam Description: Ribosomal protein L30p/L7e
MSAAEAKAAPVPESVLRKSKREEKWAADKKEKALADRKKALESRKIIFARAKQYAQEYDAQEKELVQLKREARLKGGFYVSPEAKLLFVVRIRGINAMHPKTRKILQLLRLRQIFNGVFLKVNKATINMLRRVEPYVAYGYPNLKSVRELIYKRGYGKLNKQRIPLSNNSVIEEGLGKHNIICIEDLVHEIMTVGPHFKEANNFLWPFKLKAPLGGLKKKRNHYVEGGDAGNRENYINELIKRMN

SEQ ID NO: 38737 - DNA, 723 bp, Panicum virgatum
  misc_feature: Ceres CLONE 1995279
  misc_feature: Encodes the peptide sequence at SEQ ID NO. 38738
agaccgccaggcagcctctcccctcccgagccgccgtcacctgcgcctccgcctcatccccgcgccgccgaagctttgtcgccccctcgtgctagtagcgacctggctttgttttgttgatagtctcatatccgattacgctggcggttagtcttcacctgcagccatgggtaaggagaagtcccacatcaacatcgtggtcattggccacgtcgactctggcaagtcgaccaccaccggccacctgatctacaagcttggaggtatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagtttgagaccaccaagtactactgcaccgtcattgatgcccctggacaccgtgacttcatcaagaacatgatcacgggtacctcccaggctgactgtgctgtccttatcattgactccaccactggtggttttgaggctggtatctccaaggatggccagacccgtgagcatgctctccttgctttcactcttggagtcaagcagatgatctgctgctgcaacaagatggatgccaccacccccaagtactccaaggcccgttatgatgagattgttaagggaagtctcctcctacctgaagaaggttgggctacaccctg

SEQ ID NO: 38738 - protein, 185 aa, Panicum virgatum
  misc_feature: Ceres CLONE 1995279
  misc_feature (5)..(185): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKGSLLLPEEGWATP

SEQ ID NO: 38739 - DNA, 1093 bp, Panicum virgatum
  misc_feature: Ceres CLONE 1995300
  misc_feature: Encodes the peptide sequence at SEQ ID NO. 38740
ccgtttgtttctcatccctgaagatggtctaggggacgggaccctccgtcggcgatgaacccatggatcggaacctcgcctcgggttcctccctagctccctcccttcggcagtactccgccgccgctcatggcctgcgtgaagaaaggagctcaatcggttggcaggagttaatggaacctgtgattttgtcaaggcagacttcatgaagatgccgttcgatgacaacacttttgatgctgtttatgccattgaggcgacatgtcacgcacctgatccagttggctgctataaggagatatatcgtgtattgaagcctggtcagtgctttgctgtatatgagtggtgcattactgatcactatgatccaaacaatgcaacccataaaaggattaaggatgaaattgagcttggcaatggcctgccggatattagaaggactcaccaatgtcttcaggcagtaaaagatgctgggtttgaggttgtttgggataaggatcttgccgaagattcccccttgccttggtacttgcccttggatccaagccgattttccttaagtagcttccgtttgacgtctgtgggacgtatggtcactcgtacaatggtcaaggcgttagaatacattggtcttgctccacaaggaagtgagagggtctccaatttcctagagaaggctgcagaaggtcttgtagagggtggcaagaaggaaatcttcacgccgatgtacttctttctggttcggaagcctcttacagaatgagcccatcagagcacatttaagagagaaaacaaggagtcattgcgaggaagctgaatgaagatgcagaatgagaaatctgcaatcaagatactggagttcttctccctaggaagagaagtagtggaatgtgctaactgttgagcatatatttgttggattgttttgttttgtttgcgtgagcttccttggtatagtgtttgtgctgttcttggactgacaatttgaatccctttccttgtcctaagctcagtagtataaaataagttggtttatacaactcctttgattgatgtactaaatgtcgaaataattttgggtggtggttcggag

SEQ ID NO: 38740 - protein, 185 aa, Panicum virgatum
  misc_feature: Ceres CLONE 1995300
  misc_feature (53)..(182): Pfam Name: Sterol_MT_C Pfam Description: Sterol methyltransferase C-terminal
  misc_feature: SWISSPROT Homolog: EC 2.1.1.41 Sterol 24-C-methyltransferase
MKMPFDDNTFDAVYAIEATCHAPDPVGCYKEIYRVLKPGQCFAVYEWCITDHYDPNNATHKRIKDEIELGNGLPDIRRTHQCLQAVKDAGFEVVWDKDLAEDSPLPWYLPLDPSRFSLSSFRLTSVGRMVTRTMVKALEYIGLAPQGSERVSNFLEKAAEGLVEGGKKEIFTPMYFFLVRKPLTE

SEQ ID NO: 38741 - DNA, 735 bp, Panicum virgatum
  misc_feature: Ceres CLONE 1995304
  misc_feature: Encodes the peptide sequence at SEQ ID NO. 38742
gaccagccgagagccgacgaaggcgacaggcgaggccgcaacccacaaagccgacgccgccgacgcctcttctcgtcctcctctctctccttccctctgctgaagcggagcggggctgctgcggagcgggctgctgatccgtccggggtcgtggtacaggaaactcttgggcttatactttgcagcatcgcctttttttgtcagttgtcacatggagagccctgagcctctacaggatgtcatgtgtgagtttcgtgccggtaagatgtctcttgagggaacacgagtggttcctgacacacgcaaggggcttgtccgtgttggtaggggtgaagaaggcttagtccactttcagtggcttgatcgtggacagaacatagttgaagatgaccaaattgtctttcctgatgaggccatcttcgagaaggtaacagaatcgtctggaagggtttacatcttgaagttcaagcatgacaacagaaaattcttcttctggatgcaggaaccaaatgctgatggggattctcagatttgcatccaagttaatgcctacttaaatcggccattagatgctgaggcggatcttgcagtgcctatcgaagcagaaatgtctgaagatacagctgatgatgatatctcttcgagagctgggaatttagttgatcagagcatgaattctgatttggctggtgaagtgacttctgctgctggacctgtacgcttggaggacctgga

SEQ ID NO: 38742 - protein, 174 aa, Panicum virgatum
  misc_feature: Ceres CLONE 1995304
  misc_feature (9)..(173): Pfam Name: ARM_1 Pfam Description: Adhesion regulating molecule conserved region
MESPEPLQDVMCEFRAGKMSLEGTRVVPDTRKGLVRVGRGEEGLVHFQWLDRGQNIVEDDQIVFPDEAIFEKVTESSGRVYILKFKHDNRKFFFWMQEPNADGDSQICIQVNAYLNRPLDAEADLAVPIEAEMSEDTADDDISSRAGNLVDQSMNSDLAGEVTSAAGPVRLEDL

SEQ ID NO: 38743 - DNA, 695 bp, Panicum virgatum
  misc_feature: Ceres CLONE 1995305
  misc_feature: Encodes the peptide sequence at SEQ ID NO. 38744
gatcacactgaagcagctagctactaagcacactctctcaccagctcacgctcgatcagcaatggctgcctccaccatggctgcgatctcctccccggcgatggccggcaccccactcaaggtctccgccttcggcgaggcccgcatcaccatgcgcaagaccgcggccaagcccaaggtggcggcgtccggcagcccgtggtacggccccgaccgcgtcaagtacctcggccccttctccggcgagcccccgagctacctgaccggtgagttccccggcgactacggctgggacaccgccggcctgtccgccgaccccgagaccttcgccaagaaccgcgagctcgaggtcatccactgccgctgggccatgctcggcgcgctcggctgcgtcttccccgagctgctcgcccgcaacggcgtcaagttcggcgaggccgtctggttcaaggcgggttcccagatcttcagcgagggcggcctcgactacctcggcaaccccagcctgatccacgcgcagagcatcctcgccatctgggcctgccaggtcgtgctcatgggcgccgtcgaggggtaccgcgttgccggtggtccgctcggtgaggtcgtcgacccgctctacccaggcggcagcttcgaccccctcggcctggccgacgaccccgaggccttcgctgagctcaaggtcaggagat

SEQ ID NO: 38744 - protein, 211 aa, Panicum virgatum
  misc_feature: Ceres CLONE 1995305
  misc_feature (62)..(210): Pfam Name: Chloroa_b-bind Pfam Description: Chlorophyll A-B binding protein
MAASTMAAISSPAMAGTPLKVSAFGEARITMRKTAAKPKVAASGSPWYGPDRVKYLGPFSGEPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVEGYRVAGGPLGEVVDPLYPGGSFDPLGLADDPEAFAELKVRR

SEQ ID NO: 38745 - DNA, 698 bp, Panicum virgatum
  misc_feature: Ceres CLONE 1995306
  misc_feature: Encodes the peptide sequence at SEQ ID NO. 38746
atttcctccctcgagcgctctctcgaaccttccaaagcgccctaaccctagcgagctcggaaccctagcagcgcgcggatctcggctcagcccccctccccaatacgcgccatggacgaggacttcgagatgcccccggccggcgccgacgagatgatgggcgacgacgagatgggcgacttcggcggcgacgggagcccggtcatgaaggtgggcgaggagaaggagctcgggaagcaggggctcaagaagaagctgctcaaggagggcgatggctgggagacgcccgaggtcggcgacgaggtcgaagtgcattacacgggtacactccttgatggaacaaagtttgattcaagccgtgatcgtggagatcccttcaagttcaagctgggacaaggtcaagtaataaagggctgggaccaaggcatcaagaccatgaagaaaggcgaaaatgctatttttaccattcctccagaactggcttatggagagtctggttcgcctccaaagattccacccaatgcaacattgcagtttgatgttgagctgctttcatggaccagtgtcaaagatatttgcaaagatggtggcatattcaagaagatacttaaggagggagagaaatgggagaacccaaaggatcctgatgaagtacttgtgaaatatgaagcccatctagaagatggcactgttgtatc

SEQ ID NO: 38746 - protein, 195 aa, Panicum virgatum
  misc_feature: Ceres CLONE 1995306
  misc_feature (53)..(147): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MDEDFEMPPAGADEMMGDDEMGDFGGDGSPVMKVGEEKELGKQGLKKKLLKEGDGWETPEVGDEVEVHYTGTLLDGTKFDSSRDRGDPFKFKLGQGQVIKGWDQGIKTMKKGENAIFTIPPELAYGESGSPPKIPPNATLQFDVELLSWTSVKDICKDGGIFKKILKEGEKWENPKDPDEVLVKYEAHLEDGTVV

SEQ ID NO: 38747 - DNA, 734 bp, Panicum virgatum
  misc_feature: Ceres CLONE 1995308
  misc_feature: Encodes the peptide sequence at SEQ ID NO. 38748
aaccactcccggctccttccccctcgccgacggcagcgccgacgtttcccctctcgccgttcaacgaccgcctcgacgcggcgtacatcgcgctgcaggcgtggaagcacgccatcatcgaggaccccaagaacctgaccgccaactggtgcggccccttcgtgtgcaactacaccggcgtcttctgcacggcggcgcccgacgacccgcacatcctcaccgtcgccggcgtcgacctcaaccacggccgcatcgccgggttcctccccgaccacatcggcctcctcgccgacgtcgcgctcctccacctcaactccaaccgcttccacggcacgctgccggggtccatgcagcacatgcgcctcctcttcgagctcgacgtcagcaacaacctcctctccggcgcgttcccgtcgttcctcacctcgctgccgtcgctcaagtacctcgacctgcgcttcaacaagttcgacgggcagctcccagacgccgtgttcggccggcagctcagcctcgacgcgctcttcgccaacaacaaccgcttcaacgtgaccctgtcgtcgcggaccctgaccaactccaccgcgtccgtcatcgtgctcgccaacaccgagctgaagggctgcctgccgccgagcatcggcgacatggccgacacgctggtggagctcgtcctcatcaacaccagcatcagctcctgcatcccgccggagatcggcaagctcaagaagctc

SEQ ID NO: 38748 - protein, 243 aa, Panicum virgatum
  misc_feature: Ceres CLONE 1995308
  misc_feature: SWISSPROT Homolog: EC 2.7.11.1 Non-specific serine/threonine protein kinase
PLPAPSPSPTAAPTFPLSPFNDRLDAAYIALQAWKHAIIEDPKNLTANWCGPFVCNYTGVFCTAAPDDPHILTVAGVDLNHGRIAGFLPDHIGLLADVALLHLNSNRFHGTLPGSMQHMRLLFELDVSNNLLSGAFPSFLTSLPSLKYLDLRFNKFDGQLPDAVFGRQLSLDALFANNNRFNVTLSSRTLTNSTASVIVLANTELKGCLPPSIGDMADTLVELVLINTSISSCIPPEIGKLKK

SEQ ID NO: 38749 - DNA, 710 bp, Panicum virgatum
  misc_feature: Ceres CLONE 1995326
  misc_feature: Encodes the peptide sequence at SEQ ID NO. 38750
aaggaacagaggagaggcgaacagggagccgccgcccgccgccgttgatccctgcccttccgatccggaacccaagcctccccgtctaccggagctctccaggatggcggtgagctcgcggatgccctcccagcccgcggcgcggggcctcctgcgccgcaccccgccgcgcatcctccccgtcgagcgcgcgccgggccgcctcgccctggccgtccgcgccgtctccgggagccccgggccgggcggatcgccagtgcccaggcggtccccggcgccggcggacgccgcggccgtggcgccggcctccgcgccgtcgtcggcctcctcggccatcgatttcctcaccctgtgccatcgcctcaagaccactaaaaggaaaggatggataaatcatagcatcaagggccctgaatctattgctgatcacatgtaccgtatggccttaatggcactgattgctggtgaccttccctctgtggatcgagaaaggtgcatcaaaattgctattgtgcatgacattgctgaagctattgttggtgacattaccccatcggatggtatacctaaggctgaaaaaagccggcgtgaacaagcagctcttgatgaaatgtgtgaagttcttggtggtggtccaatagctgatgagattaaggggctgtgggaagaatatgagaaacattcttctattgaagccaatcttgtaaaag

SEQ ID NO: 38750 - protein, 202 aa, Panicum virgatum
  misc_feature: Ceres CLONE 1995326
  misc_feature (106)..(186): Pfam Name: HD Pfam Description: HD domain
MAVSSRMPSQPAARGLLRRTPPRILPVERAPGRLALAVRAVSGSPGPGGSPVPRRSPAPADAAAVAPASAPSSASSAIDFLTLCHRLKTTKRKGWINHSIKGPESIADHMYRMALMALIAGDLPSVDRERCIKIAIVHDIAEAIVGDITPSDGIPKAEKSRREQAALDEMCEVLGGGPIADEIKGLWEEYEKHSSIEANLVK

SEQ ID NO: 38751 - DNA, 728 bp, Panicum virgatum
  misc_feature: Ceres CLONE 1995327
  misc_feature: Encodes the peptide sequence at SEQ ID NO. 38752
acccaccatcaccgagctctgcctctctctcggcacgcgcgcgagctctccttactcgtcgaggtgccttgatggcgaccgaagtggctgacgctccggtgccgctgccggaggcgggccccgacgccgccgcggaggcccctgccgcggacgccgtcgcggccgccggcgacgcgaagccggccaaggccaagaaggccgccgcgccgcggaagcgcgcgaacccgacccacccgccgtacgccgagatgatctcggaggcgatcacgtcgctcaaggagaggacggggtcgagccagtacgcgatcgccaagttcctggaggacaagcacaaggacaagctgccgtccaacttccgcaagatgctgctcgtgcagctgaagaagctcgccgccgccggcaagctcaccaaggtcaagaactcctacaaggtgccgtcggggcgcgccccggccgccgacaagcccaaggccaaggccaaggccaaggccaagaagcctgctgccgccaagccgaagccgaagcccgctgcgaagaagcccaaggccgccgccaagcccaaggccaaggcgcccgccaagaccaagcccgctgcgaagccgaaggccgccgccaagcccgcggccaagccgaaggctgtagctacgaagccgaagccagccgccaagccggctgcgaagccgaagccagccgccaagccggccgcccagcctaaggccaaaccggcg

SEQ ID NO: 38752 - protein, 218 aa, Panicum virgatum
  misc_feature: Ceres CLONE 1995327
  misc_feature (53)..(123): Pfam Name: Linker_histone Pfam Description: linker histone H1 and H5 family
  misc_feature: Useful for making plants with modulated nitrogen use efficiency
  misc_feature: Useful for making plants with modulated oxidative stress sensitivity
MATEVADAPVPLPEAGPDAAAEAPAADAVAAAGDAKPAKAKKAAAPRKRANPTHPPYAEMISEAITSLKERTGSSQYAIAKFLEDKHKDKLPSNFRKMLLVQLKKLAAAGKLTKVKNSYKVPSGRAPAADKPKAKAKAKAKKPAAAKPKPKPAAKKPKAAAKPKAKAPAKTKPAAKPKAAAKPAAKPKAVATKPKPAAKPAAKPKPAAKPAAQPKAKP

SEQ ID NO: 38753 - DNA, 675 bp, Panicum virgatum
  misc_feature: Ceres CLONE 1995338
  misc_feature: Encodes the peptide sequence at SEQ ID NO. 38754
tgacaggagatatttttctcacgccctccccgccgcgaataaaaacttttctagcctccctttgaatccatccatccattgctcgtctccctcccaaattcgatgcctttgtagcgctgccgcttcgcccgttcgtcgcgccgcgccgcgccgtgcagtccgctcgccgctgcgcttcccatggacaccggggccggggccggatccggcaatgcctccggcggcggcggcggcggcgcgtccgtgtgctgctactacgccctgctcggcatccgcaagaacgcctccgccaccgacatccgcaccgcctaccggaggctcgcgatgaagtggcacccggaccggtgggcgagcgaccccggcgccgccggcgaggccaagcggcggttccagcggatccaggaggcctattccgtcttgtcggacaaggggaagaaggccatgtacgacgccgggcttttcgatcccctggatgacgacgaccaggtgaagaaccagagcctcggtctcctttctttccccccctcccttcctgctgcctgcttattgtcttcttttgccatttttgtgtgagaatattatgtacaaagttaattaattattatattatatatctgtgataaaataaattgcgtgctctgttttttgacggccaggatttctccgacttcatgc

SEQ ID NO: 38754 - protein, 130 aa, Panicum virgatum
  misc_feature: Ceres CLONE 1995338
  misc_feature (24)..(90): Pfam Name: DnaJ Pfam Description: DnaJ domain
MDTGAGAGSGNASGGGGGGASVCCYYALLGIRKNASATDIRTAYRRLAMKWHPDRWASDPGAAGEAKRRFQRIQEAYSVLSDKGKKAMYDAGLFDPLDDDDQVKNQSLGLLSFPPSLPAACLLSSFAIFV

SEQ ID NO: 38755 - DNA, 697 bp, Panicum virgatum
  misc_feature: Ceres CLONE 1995353
  misc_feature: Encodes the peptide sequence at SEQ ID NO. 38756
acatcttctcctcctacctcttgcccgtggagccccgaagaaagagcagcagctagcgcaagaggtagaatttaccttacccggcagcaatggcggcggagagcttcctgttcacctccgagtccgtgaacgagggccaccccgacaagctctgcgaccaggtctccgatgccgtcctcgacgcctgcctcgcgcaggaccccgacagcaaggtggcctgcgagacctgcaccaagaccaacatggtgatggtgttcggcgagatcaccaccaaggccaacgtggactacgagaagatcgtgcgcgacacctgccgcaacatcggcttcacctccgatgacgtcggcctggacgccgaccgctgcaaggtgctcgtcaacatcgagcagcagtcgcccgacatcgcgcagggcgtgcacggccacttcaccaagcgccccgaggagatcggtgccggcgaccagggccacatgttcggctacgccaccgacgagacccccgagctcatgccgctcagccacgtgctcgccaccaagctcggcgcgcgcctcaccgaggtccgcaagaacggcacctgcgcctggctcaggcccgacggcaagacccaggtcaccgtcgagtacctcaacgagggcggcgccatggttcccgtccgcgtccacaccgtgctcatctccacccagcacgacgagaccgt

SEQ ID NO: 38756 - protein, 202 aa, Panicum virgatum
  misc_feature: Ceres CLONE 1995353
  misc_feature (4)..(103): Pfam Name: S-AdoMet_synt_N Pfam Description: S-adenosylmethionine synthetase, N-terminal domain
  misc_feature (118)..(202): Pfam Name: S-AdoMet_synt_M Pfam Description: S-adenosylmethionine synthetase, central domain
  misc_feature: SWISSPROT Homolog: EC 2.5.1.6 Methionine adenosyltransferase
MAAESFLFTSESVNEGHPDKLCDQVSDAVLDACLAQDPDSKVACETCTKTNMVMVFGEITTKANVDYEKIVRDTCRNIGFTSDDVGLDADRCKVLVNIEQQSPDIAQGVHGHFTKRPEEIGAGDQGHMFGYATDETPELMPLSHVLATKLGARLTEVRKNGTCAWLRPDGKTQVTVEYLNEGGAMVPVRVHTVLISTQHDET

SEQ ID NO: 38757 - DNA, 1460 bp, Panicum virgatum
  misc_feature: Ceres CLONE 1995359
  misc_feature: Encodes the peptide sequence at SEQ ID NO. 38758
actattcgcgcctttccccaaacctccgagcgccgacggaccagggaccgcctccactccccttcctcccggcgcgccgccactccgccgctgtcgcttctcccgccaggccgccatgggcagctccgtcggtgacagcgcgaagctacagccatcaagggcagggagtcgcctctgcgtgcggtgcggcgagaggaaggccgcgctgaagcggcccaaaaccctagagcagatctgtagggaatgcttctacatcgtctttgaggacgaaattcatcaaactattgtcgacaattctttgtttaaagctggtgagcgtgtggcaatcggtgcttctggtggaaaagattcaacagtgctcgcatacgtgttatcggagttaaactgtcgtcacaactatggcctcgatttgtttcttttatctgttgatgaaggaatcacaggatatagagacgactcactagaaacagttaaaaggaatgaaatacagtatggtctgccactgaagattgtttcctataaagacctctatggctggacaatggatgatattgttaaagcaattggtctgaaaaataattgtacattctgtggagtttttcgacgtcaggcactagatcgaggtgctgctctcctgaaggctgataagattgtaactgggcataatgcagatgacattgcagaaactgtcttgctgaatattctgcgtggtgatattgcaaggttaagtagatgtacctttataactactggagaagacgggccaatcccaagatgcaagcctttcaaatacacctatgagaaggagattgtcatgtacgcatacttcaaaaagctggactacttctccacagaatgcatctattcaccaaatgcataccgtggttttgctcgtgaatttattaaagatttagaaaggatgaggcctagagctatactggacatcataaaatctggagaaaatttcagaatctccacaacaacaaagatgccagagcaagggacgtgtgaacgctgtggctacatttctagtcagagattatgcaaagcatgtgtcttgctggatggattgaatcgaggtttgccgaaactaggcattggaaggactaaagctggtgacggcaaggaacgcatcaaacattcagagaggaatacatcgagcttacaaggaaaacatgggaacttcgacttttagatctcaattgcagtttgcaaaaaagaaagaaatactgcaataaaattttcctgtaatctgtaattttatatcattgttgtagtacttggtactggtcagttgatcattttggttgttgtggctgttcatgaatcatgactataaatacagccatgaaccacaagaacgcgtcttcttgagtcttgacatgcttacgaagatgtataagccttggtcccgaaacaggtacatgtcacatatcagctctaataaattacagttttcg

SEQ ID NO: 38758 - protein, 359 aa, Panicum virgatum
  misc_feature: Ceres CLONE 1995359
  misc_feature (68)..(258): Pfam Name: ATP_bind_3 Pfam Description: PP-loop family
MGSSVGDSAKLQPSRAGSRLCVRCGERKAALKRPKTLEQICRECFYIVFEDEIHQTIVDNSLFKAGERVAIGASGGKDSTVLAYVLSELNCRHNYGLDLFLLSVDEGITGYRDDSLETVKRNEIQYGLPLKIVSYKDLYGWTMDDIVKAIGLKNNCTFCGVFRRQALDRGAALLKADKIVTGHNADDIAETVLLNILRGDIARLSRCTFITTGEDGPIPRCKPFKYTYEKEIVMYAYFKKLDYFSTECIYSPNAYRGFAREFIKDLERMRPRAILDIIKSGENFRISTTTKMPEQGTCERCGYISSQRLCKACVLLDGLNRGLPKLGIGRTKAGDGKERIKHSERNTSSLQGKHGNFDF

SEQ ID NO: 38759 - DNA, 735 bp, Panicum virgatum
  misc_feature: Ceres CLONE 1995375
  misc_feature: Encodes the peptide sequence at SEQ ID NO. 38760
gaatcgccgcacatgaagaggcgagtctggctgctgatcagctggtgaatgaaaggaaaggggatgctcctccatcactccctccagtagtccagcagcagcagcagctgctgcactctcctccaccgacggtctcagccaactaacgctcgctttctttctttctttctttcgcccttgcttgccttgtttaattagaggttgctattaggagtactagttatagttaacgctgcctgcctgcttcctctgctcactgccaccgcctccacccggccattgctggactggagtagaggctgctgcagcctgatagatcaagcaagatgccgcacgccaagacggactcggaggtgaccagcctggcgccctcctcgccgccgcgctccccgccgcgcacgcgccccgtctactacgtgcagagcccctcccgggactcccacgacggcgagaagacggccacctccgtccactccacgccggcgctcagccccatggcgtcgccgcgccactcccactcctccgtcggaagggactcctcctccagccgcttctcgggccaccccaagcgatccaagggggacaaggcggcggcggcccgcaagggcgcgccgcagggcaagggatggcaggagatcggggtcatcgaggaggaggggctcctggacgacgaggagcgcaccaggatcgtgcccaagaagtgctactacttcctcgtcttcgtgctcggcttcg

SEQ ID NO: 38760 - protein, 136 aa, Panicum virgatum
  misc_feature: Ceres CLONE 1995375
  misc_feature: Useful for making plants with altered cell wall content and/or composition
MPHAKTDSEVTSLAPSSPPRSPPRTRPVYYVQSPSRDSHDGEKTATSVHSTPALSPMASPRHSHSSVGRDSSSSRFSGHPKRSKGDKAAAARKGAPQGKGWQEIGVIEEEGLLDDEERTRIVPKKCYYFLVFVLGF

SEQ ID NO: 38761 - DNA, 712 bp, Panicum virgatum
  misc_feature: Ceres CLONE 1995377
  misc_feature: Encodes the peptide sequence at SEQ ID NO. 38762
agccgcgacctcgccacccaattcaattcgattcgacgccgccgtgcctcctcgctcgcccggcgatcctccaggcggcacgcaccccggccaaattaaatcctcctcctctctagctagcacattaattagtatccacaatggcccagctcaaggccgcgcgcgtcgccgacgtgcccaccctggacgtggtggcccccggcctggtggtggccgccggcggggcggacgcggccgccgcggcgcgcgcgctgggcgggcggttctcggtggtcgggcaccgcgggaaggggatgaacgcgctggcgtcgccggaccggcgcctgcaggaggtccgcgagaacaccgtccgctccttcaacgccgccgcgcgcttccccgtcgactacgtcgagttcgacgtccaggtcaccaaggatgggtgcccaatcatcttccatgacaacttcatctacaccgaagaagatggtaaaatttcacagaagcgtgtcactgatcttcagctggaagacttcgtccagtatggaccgcaaaatgagcaggggaagatcgggaagcccctggttcgcaaaatgaaggatggcagaatgcttaactggaatgtgcagtcagaggatgctctttgcacgcttcaagaagcattcgagaaggtcaacccgagattgggcttcaacgttgagctgaaattcgatgacgatcttgaatacaagga

SEQ ID NO: 38762 - protein, 190 aa, Panicum virgatum
  misc_feature: Ceres CLONE 1995377
  misc_feature: SWISSPROT Homolog: EC 3.1.4.46 Glycerophosphodiester phosphodiesterase
MAQLKAARVADVPTLDVVAPGLVVAAGGADAAAAARALGGRFSVVGHRGKGMNALASPDRRLQEVRENTVRSFNAAARFPVDYVEFDVQVTKDGCPIIFHDNFIYTEEDGKISQKRVTDLQLEDFVQYGPQNEQGKIGKPLVRKMKDGRMLNWNVQSEDALCTLQEAFEKVNPRLGFNVELKFDDDLEYK

SEQ ID NO: 38763 - DNA, 739 bp, Panicum virgatum
  misc_feature: Ceres CLONE 1995397
  misc_feature: Encodes the peptide sequence at SEQ ID NO. 38764
ggatcatcctgttggcttcgccttgtgaggggggcaccaggaggaagtgaccggcggccatgtcggcgggcgacaagatgaggaagacggcgtgcgtgaccggagggaacgggtacatcgcctccgcgctcgtcaagatgctgctggagaagggcttcgccgtcaagacgacggtcagaaaccccgatgacatggccaagaactcccacttcaaggacttgcagcagctcggcccgctggaggtcctccgcgccgacttggacgtggaaggcagcttcgacgacgccgtcgccggctgcgactacgccttcctcgtcgccgctccggtgaacctcacgtcgactgatccggagaaagagatgatcgagccagcggtccgcgggaccctgaacgtgatgaggtcgtgcgtgaaggccgggacggtgaagcgcgtgatcctgacctcgtcggcggcctcgatcatcaggaggcacctccaaggcgaggggcatgtgctcgacgaggagtcctggtccgacgtcgactccctcaccgccaacaagatcggcctctgggcgtacccggtctccaaggtgctcctggagaaggcggcgagcaggttcgcggaggagcacggcatcagcctcgtcaccgtctgccccgtcgtcaccgtcggcgcggcgccggcaccggtcgtgacgaccagcgtccccaattgcctctccctcctatccggcgacgaggcacagttccgcgtgct

SEQ ID NO: 38764 - protein, 226 aa, Panicum virgatum
  misc_feature: Ceres CLONE 1995397
  misc_feature (11)..(222): Pfam Name: Epimerase Pfam Description: NAD dependent epimerase/dehydratase family
  misc_feature: SWISSPROT Homolog: EC 1.3.1.77 Anthocyanidin reductase
MSAGDKMRKTACVTGGNGYIASALVKMLLEKGFAVKTTVRNPDDMAKNSHFKDLQQLGPLEVLRADLDVEGSFDDAVAGCDYAFLVAAPVNLTSTDPEKEMIEPAVRGTLNVMRSCVKAGTVKRVILTSSAASIIRRHLQGEGHVLDEESWSDVDSLTANKIGLWAYPVSKVLLEKAASRFAEEHGISLVTVCPVVTVGAAPAPVVTTSVPNCLSLLSGDEAQFRV

SEQ ID NO: 38765 - DNA, 666 bp, Panicum virgatum
  misc_feature: Ceres CLONE 1995406
  misc_feature: Encodes the peptide sequence at SEQ ID NO. 38766
actgtttctcttttctccttctatggatctccccatgcaagcagctctggatctccccaggcgagtggcggagagtcacagctggctggtggcggggaggcacgccgtccggcgacggtgacctccatccatatctccctctctctctctcaagccatggaggcgccgacgggggcccggcggtctttagcggcgatggcgggttgcccggcctccccggccctctgacctccccggagcgctgccccctgatctccgcggtggctgagctgcccatgccgcggaggatcccacggcgtgcggcggggaggccccacagtgatgatagtgaaatcaaccaaaccgtggacgcgcggccccagcgatcagtggccgtgtggacggccgccctgccaacagcggcggatgaaggaagcagcacatccatctcttcctacagcagactgcatcttctcctgaaagttcaggtgagcggcgagctaacccgtcctctttccggcgatccagccctgctagtgaggagtgaggggaggaaggtgagcggcgatgtcggcgggcagcagcaagaaggtggcctgcgtcaccggaggcagcgggtacatcggctccgcgctcgtcaagatgctgttggagaaagggtatgccgtgaagacgacggtcaggaac

SEQ ID NO: 38766 - protein, 39 aa, Panicum virgatum
  misc_feature: Ceres CLONE 1995406
  misc_feature: SWISSPROT Homolog: EC 1.1.1.219 Dihydrokaempferol 4-reductase
  misc_feature: Useful for making plants with altered carbohydrate content
  misc_feature: Useful for making plants with altered cell wall content and/or composition
  misc_feature: Useful for making plants with altered lignin content
MSAGSSKKVACVTGGSGYIGSALVKMLLEKGYAVKTTVR

SEQ ID NO: 38767 - DNA, 1962 bp, Panicum virgatum
  misc_feature: Ceres CLONE 1995409
  misc_feature: Encodes the peptide sequence at SEQ ID NO. 38768
ctcctcctcctccttcccctcgcctttttgatctttccccctcccctcgcattcccatccccctcgcgctcctccctctccccggagccacccaccggccccggcctgctcggtccagcggcgaggggggacaccgccgtcccgccccgctcccaccgcccggtcctcccccccgatcggccgccccggatcgccggcgcccgcggccccccaccctggtcccgatcgattggcggcggagggcgtgctccgggacacccaaaggcaaaccaatcgccaggcaggcttctggggtgctgtgctgggggagcagggaggaggtggagtgattgtggaagctaggattccagtcgttgagtgatggcgcaaggcgccaacttccctggcttcattggcgccgcgggtggccatgatggtggcgtgaactttggtgggggcttctgcgacatggccttctaccagaagctaggggagggctccaacatgtccatggacagcctcaacagcatgcagaccagcatgcacggcggctccatcgccatgtctgtggacaacagcagtgtcgggtctaacagcgactcgcgtacggggatgctcggccatcccggtctcaagggccctgttgttgtcggcagctattcggttgggaacagcatcttccgtccagggagagtgtcgcatgccttgagtgaggatgcgctggcacaggctctgatggacaataggttcccgacagagacactccagaattatgaggagtggacaattgatctgggaaaacttcacttggggatgccctttgcccaaggcgcctttggtaagctgtataggggaacatacaatggcatggatgttgccataaagcttctggagcggccagaggctgacccggaaaaagctcaactgcttgagcagcaattcgtgcaggaggttatgatgcttgcaaccttaaggcaccccaacattgtcaaattcattggtgcttgcaggaaaccattggtttggtgtattgtcacagaatatgcaaagggtgggtcgctcaagaatttcttgagcaggagacaaaacaggtctgttccactgaagttagcagtgaagcaggcattagatgttgcacgtggcatggcctatgtccacgaacttgggttcattcacagagatctcaagtcagataacctcctaatttccggtgataagtccattaagattgctgactttggagtggctaggattgaagtgaagactgaggggatgacacctgaaacaggaacatatcgttggatggctcctgagatgatccagcacagaccatacgaccagaaagttgatgtctacagctttggcattgtactgtgggagcttgtaactggcaatgttccttttgcaaacatgactgcggtgcaagctgcatttgctgtggtgaacaagggcgtccgtccgaccataccccatgactgcctccctgccctaggggagatcatgaccaggtgctgggactcaaaccctgaagtccgccccccattcactgagattgtcaggatgctggatcaggtggagatggaggtcctgcgcactgttcgtagggcccgcttccgctgctgcattgctcaaccgatggccctggactgagctgtccagaatccaggaaaagaacctggagggaggtttagtcctgtgtatttatcgtattataatagacctgcgcttcagaatcagaaagccagctctcgacactctcgagtgtgccttctgtctttgacatgtttatcgtagattacacctagtttctgtcatcagagtgtaataggagttttatccttgactccatacctgcctgttgtaacaagtgcatgttcctgctgctcgctctgtttttttttttatcatcatgcggctacatgtgaaagctctgatgcttcatggtatatataatatgtataattaattagcatggatttgctc

SEQ ID NO: 38768 - protein, 422 aa, Panicum virgatum
  misc_feature: Ceres CLONE 1995409
  misc_feature (141)..(395): Pfam Name: Pkinase_Tyr Pfam Description: Protein tyrosine kinase
  misc_feature: SWISSPROT Homolog: EC 2.7.11.1 Non-specific serine/threonine protein kinase
MAQGANFPGFIGAAGGHDGGVNFGGGFCDMAFYQKLGEGSNMSMDSLNSMQTSMHGGSIAMSVDNSSVGSNSDSRTGMLGHPGLKGPVVVGSYSVGNSIFRPGRVSHALSEDALAQALMDNRFPTETLQNYEEWTIDLGKLHLGMPFAQGAFGKLYRGTYNGMDVAIKLLERPEADPEKAQLLEQQFVQEVMMLATLRHPNIVKFIGACRKPLVWCIVTEYAKGGSLKNFLSRRQNRSVPLKLAVKQALDVARGMAYVHELGFIHRDLKSDNLLISGDKSIKIADFGVARIEVKTEGMTPETGTYRWMAPEMIQHRPYDQKVDVYSFGIVLWELVTGNVPFANMTAVQAAFAVVNKGVRPTIPHDCLPALGEIMTRCWDSNPEVRPPFTEIVRMLDQVEMEVLRTVRRARFRCCIAQPMALD

SEQ ID NO: 38769 - DNA, 715 bp, Panicum virgatum
  misc_feature: Ceres CLONE 1995413
  misc_feature: Encodes the peptide sequence at SEQ ID NO. 38770
caatttcacttcacctcgacagcgcacaccccacccaccggtctccctcctccaccaccaccgaattagccaaggcacaggcggagcaggggggcctctcctctccttcccttcctcgccgccttcgcccggcgagccagccagccatggagccggcggcgaagacggtggagcggctggcgcagcgcctggtgccgccggcggagcccacgcccaccggcccgcaccgcctgtcctggctcgaccgctacccgacccagatggcgctcatcgagtcgctgcacgtcttcaagcccgacccggcgcgggacggggtcagccccgcggagaccatccagcgcgccctggcgcgggcgctcgtcgagtactacccgctcgcgggccgcctcgccgtgtccgacgccgccggggggctccacgtcgactgcagcggcgagggcgtctggttcgtcgaggccgccgttcggtgccggctcgaggacgtcgactacctcgagtacccgctgcagatccccaaggacgacctgctcccgcacccgctgccgcgccccacccgcgaggaggagaacaagctcatcctgctcgtccaggtacgcgggggcctcctcgattcgagccgcattgtgcggggttgctccgattgggcgcggattcgggatttccttccggctctctgaccgccggcgccgaatctgctgctgcaggtgaccacgtt

SEQ ID NO: 38770 - protein, 176 aa, Panicum virgatum
  misc_feature: Ceres CLONE 1995413
  misc_feature: SWISSPROT Homolog: EC 2.3.1.107 Deacetylvindoline O-acetyltransferase
MEPAAKTVERLAQRLVPPAEPTPTGPHRLSWLDRYPTQMALIESLHVFKPDPARDGVSPAETIQRALARALVEYYPLAGRLAVSDAAGGLHVDCSGEGVWFVEAAVRCRLEDVDYLEYPLQIPKDDLLPHPLPRPTREEENKLILLVQVRGGLLDSSRIVRGCSDWARIRDFLPAL

SEQ ID NO: 38771 - DNA, 673 bp, Panicum virgatum
  misc_feature: Ceres CLONE 1995418
  misc_feature: Encodes the peptide sequence at SEQ ID NO. 38772
gtgcgctgcggccgggtcggatctgagacgagcaatacccatcttcatccacgcacaccccgcctcctccctccggatcggatcggatccgcccgaccaccccgcgccgccgccgccgccgcagatcagataagatggccgcagttgacaccttcctctttacctcggagtctgtgaatgagggacaccctgacaagctctgcgaccaggtctcagatgccgttcttgatgcttgccttgctgaggacccagacagcaaggttgcttgcgagacctgcaccaagactaacatggtcatggtttttggtgagatcaccaccaaggccaacgttgactacgagaagattgttagggagacctgccgcaacatcggtttcgtgtctgcagatgttgggcttgatgctgacaactgcaaagtgcttgtgaacattgagcagcagtcccctgatattgctcagggtgtgcatggccacttcacaaagcggcctgaggagattggagctggtgaccagggacacatgttcgggtatgcaactgatgagaccccagagctgatgcccctcagtcatgtccttgccaccaagcttggtgctcgtctcactgaggtgcgcaagaacgggacctgcccctggctcaggcctgatgggaagacccaggtgactgttgagtaccg

SEQ ID NO: 38772 - protein, 179 aa, Panicum virgatum
  misc_feature: Ceres CLONE 1995418
  misc_feature (5)..(104): Pfam Name: S-AdoMet_synt_N Pfam Description: S-adenosylmethionine synthetase, N-terminal domain
  misc_feature (119)..(179): Pfam Name: S-AdoMet_synt_M Pfam Description: S-adenosylmethionine synthetase, central domain
  misc_feature: SWISSPROT Homolog: EC 2.5.1.6 Methionine adenosyltransferase
MAAVDTFLFTSESVNEGHPDKLCDQVSDAVLDACLAEDPDSKVACETCTKTNMVMVFGEITTKANVDYEKIVRETCRNIGFVSADVGLDADNCKVLVNIEQQSPDIAQGVHGHFTKRPEEIGAGDQGHMFGYATDETPELMPLSHVLATKLGARLTEVRKNGTCPWLRPDGKTQVTVEY

SEQ ID NO: 38773 - DNA, 743 bp, Panicum virgatum
  misc_feature: Ceres CLONE 1995423
  misc_feature: Encodes the peptide sequence at SEQ ID NO. 38774
acctccacccccgttccccacttccccttgcgcatctccctctctctctctctctctctctctctgcgttcgtggtgctcagccatggcggactaccatttcgtatacaaggacgtggagggggcgactacgcagtgggacgacatccagcgccgcctcgggaacctgccgccgaagccggagcccttcaagccgccgcccttcgtacccaaggtcgacgccgacgagcagcccaagtcaaaggaatggctcgacgcgcgcgagcccgaggagctcgaggaactcgaggacgacctggacgacgaccgcttcctcgagcagtacaggaaaatgaggcttgctgagctcagggaggcagcaaaagctgctcgttttggtagtatactgcccattactggctcagacttcgtgcgtgaggtgtctcaggcgccatcagatatctgggttgttgttttcctctacaaggacgggataccggaatgtggcttgcttcagaattgtttggaagaattggctacaagatacccagcaacaaaatttgttaagattatctccacagactgcattcccaactacccagatagaaatgttcctacaatactggtgtataacaacagtgctgtcaaagggacttatgttggtttgcagaagttcggtggaaagagatgcacgcctgagtctgttgcactagcactctgccagtcagacccagtactgaatgatgggcatggtggcagcgattc

SEQ ID NO: 38774 - protein, 219 aa, Panicum virgatum
  misc_feature: Ceres CLONE 1995423
  misc_feature (11)..(212): Pfam Name: Phosducin Pfam Description: Phosducin
MADYHFVYKDVEGATTQWDDIQRRLGNLPPKPEPFKPPPFVPKVDADEQPKSKEWLDAREPEELEELEDDLDDDRFLEQYRKMRLAELREAAKAARFGSILPITGSDFVREVSQAPSDIWVVVFLYKDGIPECGLLQNCLEELATRYPATKFVKIISTDCIPNYPDRNVPTILVYNNSAVKGTYVGLQKFGGKRCTPESVALALCQSDPVLNDGHGGSD

SEQ ID NO: 38775 - DNA, 723 bp, Panicum virgatum
  misc_feature: Ceres CLONE 1995428
  misc_feature: Encodes the peptide sequence at SEQ ID NO. 38776
aaacctcaggctcctctccgcacactccaccaccttcacgggcgccgccgtcgcacgcagccgcatccgccatgggtgagctcctcgccctccttctccctgatgatgtctctccggtcagcgtgcgtaggtcccgacggtgtgtttcttcgcttctcgctgtggcgcaggggcgtacaagtacgtgtcggagctatggaggaggaagcagtcggacgtgatgcggttcgtgcagcgcgtgcgctgctgggagtacagacagcagccggccatcgtccgcctcaccaggcccacccgccccgacaaggcccgccgcctcggctacaaggccaagcagggttatgttgtttaccgcgtccgtgtcaggcgtggtggccggaagaggcctgtgcctaagggtattgtctatggcaagcccaagcaccagggtatcacccagctcaagttccagaggaacaagaggtctgttgctgaggagagagctggacgtaagcttggtggactcagggttctcaattcctactgggtcaatgaggatagtacatacaagtactttgagatcatcctggttgatgtcgcccacaccgccattcgcaatgacccaaggatcaactggctatgcaaggatgtgcacaagcaccgcgagctccgtggtctcacttctgcaggcaagaagtaccgtggtctgcgaggcaagggccacacacaccacaagaacaggcc

SEQ ID NO: 38776 - protein, 167 aa, Panicum virgatum
  misc_feature: Ceres CLONE 1995428
  misc_feature (1)..(167): Pfam Name: Ribosomal_L15e Pfam Description: Ribosomal L15
MRFVQRVRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDSTYKYFEIILVDVAHTAIRNDPRINWLCKDVHKHRELRGLTSAGKKYRGLRGKGHTHHKNR

SEQ ID NO: 38777 - DNA, 1658 bp, Panicum virgatum
  misc_feature: Ceres CLONE 1995431
  misc_feature: Encodes the peptide sequence at SEQ ID NO. 38778
gagggagccctgcgcgattctcttcttgggacggaagcaaaactagagagagagagagagagagagcgaggccgagactgcgggaggacgagatggccgacggggaggacgccgccgccgcgcgccgccggtcagccatcaccgactaccggaagaagctgctcaactgcagggagctcgagtcgcgcgtcggcaccgtgagagagagcctaaaaaatgcaaagaaggactttgccaagactgaagacgacttgaaatcgctgcaaagcgtgggtcaaataattggagaggtcctccggcctctagataatgaacgtttcattgtgaaggccagcagtggtccccgatatgtggttggttgccgaagtaaagtggacaaggagaagttgacttctggaactcgtgttgtacttgacatgacgaccttgacaataatgcgcactctaccacgggaggttgatcctgtggtatacaacatgcttcatgaagaccctggaaatgtcagttactctgctgtaggcggtttgtctgatcagattagagaactcagggagtccattgagttaccgcttatgaaccctgaactctttcttcgggtgggaattaagcctcctaagggcgtcctactctacggtcctccagggactgggaagacactattggcgagggctatcgccagtaacatcgatgccaactttttgaagattgtttcaagtgctattattgacaagtacattggagaaagtgctcgtttgattagagaaatgtttggctatgcacgagatcaccaaccatgcatcatcttcatggatgaaattgatgccattggtgggcgaaggtttagtgagggaactagtgctgatcgtgagatccagcggacgttgatggagctccttaaccagctagacggatttgatgagcttgggaaggttaagatgatcatggctacgaaccgacctgatgttttggacccagccctcctgcgtcctggacgtttagacaggaagattgagattccactacccaacgagcaggcgagaatggaagttcttaaaattcatgctgctggtattgccaaacatggggaaattgattacgaagctgtcgtgaagcttgcagaaggtttcaacggggctgatcttcggaatgtctgcaccgaagctggtatggctgcaattcgggcagaaagggactatgtggtccatgaagacttcatgaaggctgtgcgcaagctgaatgatgcaaagaagctggaatcgagtgctcactacagcgcagactttgggaaagagtagtaacgtgcgattttgctacaaatgcatatgctgtgtatcactggggagctcagccatcaccatgccaaagcaagaaagaaattggctatttatgttcaggctccaggacactactctctttttctgatattcacaatcgtagtgaggaggattgtcaagctgaccactgggagaaaccattcgagaatttactaattttgaaccagttgctctttgcttcagtgatcatcatacgttatcagcttccctgtgtattagtctggtaactcttgttcgggcagttttatttccatcattccatgtacttggacagtgtgcttgcctgctcggtaagagtaagaaaaaagaggctagtttgtgttc

SEQ ID NO: 38778 - protein, 400 aa, Panicum virgatum
  misc_feature: Ceres CLONE 1995431
  misc_feature (176)..(363): Pfam Name: AAA Pfam Description: ATPase family associated with various cellular activities (AAA)
  misc_feature: SWISSPROT Homolog: EC 3.6.4.3 Microtubule-severing ATPase
MADGEDAAAARRRSAITDYRKKLLNCRELESRVGTVRESLKNAKKDFAKTEDDLKSLQSVGQIIGEVLRPLDNERFIVKASSGPRYVVGCRSKVDKEKLTSGTRVVLDMTTLTIMRTLPREVDPVVYNMLHEDPGNVSYSAVGGLSDQIRELRESIELPLMNPELFLRVGIKPPKGVLLYGPPGTGKTLLARAIASNIDANFLKIVSSAIIDKYIGESARLIREMFGYARDHQPCIIFMDEIDAIGGRRFSEGTSADREIQRTLMELLNQLDGFDELGKVKMIMATNRPDVLDPALLRPGRLDRKIEIPLPNEQARMEVLKIHAAGIAKHGEIDYEAVVKLAEGFNGADLRNVCTEAGMAAIRAERDYVVHEDFMKAVRKLNDAKKLESSAHYSADFGKE

SEQ ID NO: 38779 - DNA, 1063 bp, Panicum virgatum
  misc_feature: Ceres CLONE 1995436
  misc_feature: Encodes the peptide sequence at SEQ ID NO. 38780
attgctcgcaagattctcctccctttcttgtcatacatacgccctcaaagatcttgtttcgattgggagagcattgatttctcccctccttccttccttggcagctagctgatcctgatcgatatcgcgcctacactagtcagtagatgggagttcagacaatgtcgtcccacggcgacgacggccgccgcggcctcccgcggcagggctcggtgtacaacctcacgctgaccgaggtggagacccggctgggcgagccgctgcggagcatgaacctcgacgacctcctgcgcaccgtgctgcccgccgccccagccaccgagccggcgcccaagaagacggtcgacgaggtgtggcgcgacatccagagcgccagcggcgcccggcagccggccatgggcgagatgacgctggaggacttcctctcccgcgccggcgtcaccgtcgacgccggaccgcattggctgcaccagcaccagcaccagcaccagcaccagtacgtggtgccgctcgggtccccggcggtggacggcgtcggggttttcctatcgcaggtggccggccggaagcgcggcgcggcggcggcggcggcggcggacggggacggcgtggtggaggagaggacggtggagcggcggcagaagcgcatgatcaagaaccgcgaatccgcggcgaggtcccgggccaggaagcaggcatacaccaacgagctggagaacaaggtcgcccggctggaggaggagaaccagcgtctcaggaagctcaagatgctgccaccgctggagccgccaccggagcatgagcagcggccggtgccccagccggagcatgagcggcggccggtgacccagccggaggaggcgaagcagccgctccggcgaaggaattcagccaccttctgatgagacgatgggccgtgaaagctaactctgctctgttaagcgggttgggtctgtgctttggatagttgatggatggtgtccgcatgtgtacgaaccaactctgctctgtctgcagtagcagtgcagattgtgctgcatgcaatgaaagcagtgcttccttc

SEQ ID NO: 38780 - protein, 251 aa, Panicum virgatum
  misc_feature: Ceres CLONE 1995436
  misc_feature (158)..(221): Pfam Name: bZIP_1 Pfam Description: bZIP transcription factor
  misc_feature: The sequence is a functional homolog of SEQ ID NO 1540 in the 10/412,699 US patent application
  misc_feature: The sequence is a functional homolog of SEQ ID NO 1542 in the 10/412,699 US patent application
MGVQTMSSHGDDGRRGLPRQGSVYNLTLTEVETRLGEPLRSMNLDDLLRTVLPAAPATEPAPKKTVDEVWRDIQSASGARQPAMGEMTLEDFLSRAGVTVDAGPHWLHQHQHQHQHQYVVPLGSPAVDGVGVFLSQVAGRKRGAAAAAAADGDGVVEERTVERRQKRMIKNRESAARSRARKQAYTNELENKVARLEEENQRLRKLKMLPPLEPPPEHEQRPVPQPEHERRPVTQPEEAKQPLRRRNSATF

SEQ ID NO: 38781 - DNA, 725 bp, Panicum virgatum
  misc_feature: Ceres CLONE 1995438
  misc_feature: Encodes the peptide sequence at SEQ ID NO. 38782
acaagggggggcgccaggacactggtgcgcggcgcgccccgggggaagagcagcagcagcggcagcggagcagaacacgccagcgcctcgcgccaatggcggctccttcccgagcgtcgtcgtcgtcgtcgtccgcgcgcctcctcctcctcctgctctccctgctcgggtcctgcgtcgcgctgagccgccaggagtcgtcgtcgtcgacggactcgtgcgccgcggcgaagctcgcggtcgccagcctcgtgcccttcgacaccgcggggttccggtgcgccgccaactggaagcagcaggacttcgtcctccggtacaagaacacggggccgagcgtgtggagcttcgtcctgtcggcgccggacaggggctcgtacgtggcggtcggcttctcggggaagggcgccatggtcgggagcagcgccgtcgccgggtgggcgtccggcggcaggggcgccgtcaagcagtactacctcgccgggaagagccccgatgaggtcgcccccaacaggggcctcctcaagctcgtcaggaacaagtccgccgtcgtctcccactcgggccgcctctacctcgccttccagctcagcaccgactacccgcagccgtacctgatctacgccgtcgggcccgacggcaacctgccgccgtccagcaccctgcagctgccgatgcaccagagcgtggcctcccgcgccttcaactacacctccgggatgtct

SEQ ID NO: 38782 - protein, 209 aa, Panicum virgatum
  misc_feature: Ceres CLONE 1995438
  misc_feature (69)..(179): Pfam Name: DOMON Pfam Description: DOMON domain
MAAPSRASSSSSSARLLLLLLSLLGSCVALSRQESSSSTDSCAAAKLAVASLVPFDTAGFRCAANWKQQDFVLRYKNTGPSVWSFVLSAPDRGSYVAVGFSGKGAMVGSSAVAGWASGGRGAVKQYYLAGKSPDEVAPNRGLLKLVRNKSAVVSHSGRLYLAFQLSTDYPQPYLIYAVGPDGNLPPSSTLQLPMHQSVASRAFNYTSGM

SEQ ID NO: 38783 - DNA, 718 bp, Panicum virgatum
  misc_feature: Ceres CLONE 1995440
  misc_feature: Encodes the peptide sequence at SEQ ID NO. 38784
aaacgcaacggtcgaatcccctcgagttcgaattgcagccggagcggcacccacacccacctgacatggcggcggcggcgggggcggaagagatggtggcggtgctcgacgaggagacgctggcgctgatggggatcagcaacgccgccgccgtggcgccgccggtggctgtgggcgccgagtgggagacgttcaaggagaacgtgcgcccgctcaagcgcgggcgcgacgtgtccaagctcaaccgcgcgctcaaggcgcaggtcgaccccgcccagcgcgccgccctcctcgaagcccgcaggaggatgattgaggcaatctacgagtaccagggcgaggatccgctccaaccgtggctggactgcatcaagtgggttcaggagtcgttccctaccggcggcgagtgctcggggctggtggtgttgtacgagcagtgtgtgcggaccttctggcacgacgagcgctacaaggaggacctccgcttcctcaaagtgtggctggaatacgctgggaattgcactgatgctgaggtgatatacagatttctggaggcgaaccagattgggcagagccatgccatttactacatgtcctacgcgtcgttgttagaatcaaagaacaagctaaggaaagctaatgagatctttcaccttggtatatctagaaaagcaaagcctctggagaagttgggagctgtatacaggacatttctttc

SEQ ID NO: 38784 - protein, 217 aa, Panicum virgatum
  misc_feature: Ceres CLONE 1995440
  misc_feature (75)..(199): Pfam Name: Mad3_BUB1_I Pfam Description: Mad3/BUB1 homology region 1
  misc_feature: SWISSPROT Homolog: EC 2.7.11.1 Non-specific serine/threonine protein kinase
MAAAAGAEEMVAVLDEETLALMGISNAAAVAPPVAVGAEWETFKENVRPLKRGRDVSKLNRALKAQVDPAQRAALLEARRRMIEAIYEYQGEDPLQPWLDCIKWVQESFPTGGECSGLVVLYEQCVRTFWHDERYKEDLRFLKVWLEYAGNCTDAEVIYRFLEANQIGQSHAIYYMSYASLLESKNKLRKANEIFHLGISRKAKPLEKLGAVYRTFL

SEQ ID NO: 38785 - DNA, 696 bp, Panicum virgatum
  misc_feature: Ceres CLONE 1995447
  misc_feature: Encodes the peptide sequence at SEQ ID NO. 38786
acatcggtgagcagcttccccacattctcgttctccgtccaccaacctacccacctgcggcggcgcaaggaagcgaagcgacgcgatgtcggcgacgacggcggcggtgcccttctggcgcgcggcggggatgacctacatcggctactccaacatctgcgccgcgctggtgcggaactgcctcaaggagcccttcaagtccgaggccgcgtcccgcgagaaggtccacttctccgtctccaagtggacggacggcaagcaggagaagcctagtgagtgccccgcccctccaccacccgatccgctcatgtcccgcgctcttgattcggttcgatgcgatctggctcgttattatgtggtgctgttggatcctagggttcgcggaatcggttcctaagttttggctggatccaggtctagtttgatcttgtggctcactgatggtgatcctaacggtgagcggtgtcattttgttccgtgtgctggggttgtctgcgcttcatggcctatcatgggcagtcactggtggcataaatctgatctgctgtgctgattgcggcggtaggtcaaaatgtgacgcgtagagggaaaataattaactgggcgcataaaatgcaaccaaaggtcagctgtcaagaatttcattttcttgttttggggaagggataaactggggtaaaattgtttgtgaattgt

SEQ ID NO: 38786 - protein, 103 aa, Panicum virgatum
  misc_feature: Ceres CLONE 1995447
  misc_feature (9)..(57): Pfam Name: ATP-synt_Eps Pfam Description: Mitochondrial ATP synthase epsilon chain
MSATTAAVPFWRAAGMTYIGYSNICAALVRNCLKEPFKSEAASREKVHFSVSKWTDGKQEKPSECPAPPPPDPLMSRALDSVRCDLARYYVVLLDPRVRGIGS

SEQ ID NO: 38787 - DNA, 627 bp, Panicum virgatum
  misc_feature: Ceres CLONE 1995462
  misc_feature: Encodes the peptide sequence at SEQ ID NO. 38788
acttccggccccccccccaaaatccccggattcccacacgccccccccccccaaacccccccgccggcgccgtcgcgtcctccgccgccagtcatggccgccgcgggtcccgggctctacaccgagatcgggaagaaggccagagatctcctctacaaggactaccacacggaccagaagttcacgctcaccacctacgcctccaacggagctgccattactgctgcaagtactaggaaaaatgaagctatcttcagtgaaatccagagccagctgaagcatgaaaatgtgacagtggatgtgaaagcaacttcagaatcaactgtgacgactacatttacaattcatgagctgggcacaccaggtctgaaggcaattttatgcattcctttcccgtaccagaaatcagcaaaggctgaactccagtacttgcaccgccatgctggtgttgctgctagcgttggcctgaatgcaaaccctgttattaacttttctggtgtattcgggactaaaaccgtcgctgttggtgctgacgcctcatttgacacttcatctggggacttgaccaaatacaatggtggactgagctacactactagtgactttgttgctgcagccactctgaac

SEQ ID NO: 38788 - protein, 177 aa, Panicum virgatum
  misc_feature: Ceres CLONE 1995462
  misc_feature (5)..(177): Pfam Name: Porin_3 Pfam Description: Eukaryotic porin
  misc_feature: Useful for making plants with modulated drought sensitivity
MAAAGPGLYTEIGKKARDLLYKDYHTDQKFTLTTYASNGAAITAASTRKNEAIFSEIQSQLKHENVTVDVKATSESTVTTTFTIHELGTPGLKAILCIPFPYQKSAKAELQYLHRHAGVAASVGLNANPVINFSGVFGTKTVAVGADASFDTSSGDLTKYNGGLSYTTSDFVAAATL

SEQ ID NO: 38789 - DNA, 729 bp, Panicum virgatum
  misc_feature: Ceres CLONE 1995485
  misc_feature: Encodes the peptide sequence at SEQ ID NO. 38790
aaaaaaaaactccggaaggccgcgatgaggtcgtctctgctgaaatccacgtccgagctcctccgccgcacccgcggttactcctcctcggccaaaccggagcggaaggtggccatcctgggcgcggcgggtggcatcgggcagccgctctcgctcctcatgaagctcaacccgctcgtctcctccctctccctctacgatatcgcggggaccgtcggcgtcgccgccgacgtgtcccacatcaacacccccgccctggtgaaggggttcatgggggatgaccagctcggggaggcgctggagggatccgacgtcgttatcatccccgccggggtgcccaggaagcccggcatgaccaaggacgaccttttcaacatcaacgctggcattgttaaggcgctcagcaccgccatcgccaagcactgccccaacgctattgtcaatatgatcagcaaccctgtcaactccactgtcccgattgcagcagaggttttcaagaaggctggtccttatgatgagaagaagctgtttggtgtgaccactcttgatgttgttcgtgctaaaaccttttatgctggaaaggcgggcgtgccagttactgaggtgaatgttcctgttgttgggggccatgcgggtattactattctgccactcttctcacaggccactcctccaagcaattcattgtccccaagagacattgtggccctcacccagaggacacaggat

SEQ ID NO: 38790 - protein, 234 aa, Panicum virgatum
  misc_feature: Ceres CLONE 1995485
  misc_feature (27)..(170): Pfam Name: Ldh_1_N Pfam Description: lactate/malate dehydrogenase, NAD binding domain
  misc_feature: SWISSPROT Homolog: EC 1.1.1.37 Malate dehydrogenase
MRSSLLKSTSELLRRTRGYSSSAKPERKVAILGAAGGIGQPLSLLMKLNPLVSSLSLYDIAGTVGVAADVSHINTPALVKGFMGDDQLGEALEGSDVVIIPAGVPRKPGMTKDDLFNINAGIVKALSTAIAKHCPNAIVNMISNPVNSTVPIAAEVFKKAGPYDEKKLFGVTTLDVVRAKTFYAGKAGVPVTEVNVPVVGGHAGITILPLFSQATPPSNSLSPRDIVALTQRTQ

SEQ ID NO: 38791 - DNA, 725 bp, Panicum virgatum
  misc_feature: Ceres CLONE 1995527
  misc_feature: Encodes the peptide sequence at SEQ ID NO. 38792
gcttttcggatccgctgccttgctgacagcctgacaatgcggtgggagtgagggagcccgaccccgcgtgtccgccacgcccgaggccaccgccgcttcccgaatggccgccgccgcctcctcctcgccctcgcctccatcgccgccaacgccgtcgcctcccggggcggcgtccccggccgaggagccccgcgggggcgggggcgggggaggccggccgcctgtcccgccgtacgtgaaggcggcggcggggtccctgggcggcgtcatggaggcgtgctgcctgcagccgatcgacgtcgtcaagacgcggctgcagctcgaccgctcgggggcctaccggggcatcgcgcactgcggcgccaccgtcgcccgcgccgagggcgtgcgcgcgctctggaaggggctcacgcccttcgccacccacctcacgctcaagtacgcgctgcgcctcggctccaacgccgtgctgcagtccgccttcaaggaccctgccaccggcaaggtctccgcgcacgggcgcctcgcgtccgggttcggcgccggcgtcatcgaggcgctcctcatcgtcaccccctttgaggtggtaaagattagattgcaacagcaaaaaggattgagcccagacatgcttagatataaaggtcccatacactgtgcaaggactatagttcggggagaaagcctacttggtctgtggtctggagcattaccaactggtatgc

SEQ ID NO: 38792 - protein, 207 aa, Panicum virgatum
  misc_feature: Ceres CLONE 1995527
  misc_feature (42)..(131): Pfam Name: Mito_carr Pfam Description: Mitochondrial carrier protein
  misc_feature (136)..(207): Pfam Name: Mito_carr Pfam Description: Mitochondrial carrier protein
MAAAASSSPSPPSPPTPSPPGAASPAEEPRGGGGGGGRPPVPPYVKAAAGSLGGVMEACCLQPIDVVKTRLQLDRSGAYRGIAHCGATVARAEGVRALWKGLTPFATHLTLKYALRLGSNAVLQSAFKDPATGKVSAHGRLASGFGAGVIEALLIVTPFEVVKIRLQQQKGLSPDMLRYKGPIHCARTIVRGESLLGLWSGALPTGM

SEQ ID NO: 38793 - DNA, 1911 bp, Panicum virgatum
  misc_feature: Ceres CLONE 1995530
  misc_feature: Encodes the peptide sequence at SEQ ID NO. 38794
attgggcagttgcaatccaaagcccttctccattcttccctctcggcgccggcgccgccgtccgccggaccggtggcaagcattgctacattattctatatagaagaaagagatggactcgctgacctttgtttccccctaggtctaggattcttttaaataaaaaaatgaggagtcgtcgtcggagagcgttcgttgtcgccgccgagccgctccgtgccgttctcagatccgccgatgccgggcctcctctccacctcgcccgccctcctgtggcgccgtctcggccaccgcggcgccgcattcgccctcgcgctcctcgccgccgccctcctcttcaccttcttccgctacgccgcggtcccttcagcatccccatccccattcccaacctacgggcatcgcctccccaccctcgtcgacctcacgctcgtctacggcagggacgcactgtgcttggatgggacgccgccgggttaccactttctgccaggattcggagacggatcccacagctggctccttcacttggagggcggcagctggtgccgcaacttcaaatcctgcgctcgccgtaagaaaacaaatctcggctcctctgcccacatggatactcgcgtcaaattcgtcggcatccttagtgacgatgaatctcagaatccagatttttacaattggaacaaagtcaaaataagatactgtgatggtgcatcattctctggacatgtccaggatcaagtcaagaatggcacaggtttcttcttcagaggccagcgtatctgggaagcagtcatggccgaccttctgtcaaagggcctatccagggctaaacaggcttttcttactggatgctcggctggtggcctctctacatacattcactgtgatgatttccgagcacttctaccaaagacacctactgtcaagtgcctcgcagatggtggcttttttcttgatgtagaagacatagctggaagaaggtatatgcgggctttctataacgatgttgctcggctgcaggatgtgcgtaaaaagttccctaattgcagtccagatatggagccagggcagctggcgtatgctaattagtccccttgttaccagtgcttcttcccgcgggaagttgcgaaaagcatcaccacaccgatgtttatactcaatcctgcatatgatgtttggcaggtagagcatgtcttgtctccagaaggttctgaccctcaaaatttatggcgaaattgcagaatggatattaccaagtgtagctcaaaacagctggaaattctccaaggttttaggaaagcgctgcttgatgctataaatgaattcaagaatagaagagactggggtatgttcatcgactcgtgctttatacactgccagtcgatgaaagctattacttggcactccccatcaactgctagaatcaacaacaagacggctgctgaagcggtgggagattggttctttgatcggagggaggtgaaggaaatagactgtgaatatccctgcaacccgacttgctacaatacggttcttgatgagccctacaaggaagactgactgtgtttaggagttttgtcgatttattaggcgcaatcgcagttgcaaccgattctccatgaattgatatctgttgggttgaatgtgatcagaattcagacttacttgagacctatttctatatgttaaagccccgaggggcagcgagcggccagacaggtcacgtaggccagaaaaattcgaccgtccgatcgcgatccgatggctatggatgaaagggaatcttgctatttcagagtactaaataaaatctatttaaattttttttatatggatgggttgtaaatcacgagattaatctaataagcatacttaatttatgattaattcataattagtgaatggttactg

SEQ ID NO: 38794 - protein, 160 aa, Panicum virgatum
  misc_feature: Ceres CLONE 1995530
  misc_feature (1)..(157): Pfam Name: PAE Pfam Description: Pectinacetylesterase
  misc_feature: Useful for making plants with altered cell wall content and/or composition
  misc_feature: Useful for making plants with altered carbohydrate content
MDTRVKFVGILSDDESQNPDFYNWNKVKIRYCDGASFSGHVQDQVKNGTGFFFRGQRIWEAVMADLLSKGLSRAKQAFLTGCSAGGLSTYIHCDDFRALLPKTPTVKCLADGGFFLDVEDIAGRRYMRAFYNDVARLQDVRKKFPNCSPDMEPGQLAYAN

SEQ ID NO: 38795 - DNA, 263 bp, Panicum virgatum
  misc_feature: Ceres CLONE 1995537
  misc_feature: Encodes the peptide sequence at SEQ ID NO. 38796
aagcgctacacaggcgtatatgtatccgcctcactgcgcgacgatgaggtttgccccccacgccggttccccagcggggccgccccgcccttacggcgacacgatgagggattgcatgtcgatgcacatgggtcaggccgggatgcaggtgggaaacgcgtgctgggagctctactgcctcgagcatggcattcaggctgatggccgcaggcgtggtgacaaggacattggaggaggtgatgatgctgtggacaacttcttca

SEQ ID NO: 38796 - protein, 53 aa, Panicum virgatum
  misc_feature: Ceres CLONE 1995537
  misc_feature: Useful for making plants with altered cell wall content and/or composition
MRDCMSMHMGQAGMQVGNACWELYCLEHGIQADGRRRGDKDIGGGDDAVDNFF

SEQ ID NO: 38797 - DNA, 659 bp, Panicum virgatum
  misc_feature: Ceres CLONE 1995543
  misc_feature: Encodes the peptide sequence at SEQ ID NO. 38798
atcatcacccgccgccgccgacacagccgccggagcaccttgactgcttgagcgtagtttaggagagaggattcgaggagtgatgtcgaccgaggaggctgccgctgcggcgaccgaggtccccgcgaccgaggtcgagtccgaggcgccccccgccgaggaggcggaggcgaagcccgccaaggccaagaaggcggcgcccaaggagaagaaggcccccaaggagaagaaggcggccaaggagaagaagcccgccgcggcgaggaagccggccgcccacccgccgtacgccgagatgatctcggaggcgattgcggcgctcaaggagaggaccgggtcgagctcggtggccatcggcaagtacgtggaggagaagcacggcgggcagctgccgcccaacttccgcaagctgctggccgggcagctcaagaagctcgccgccgcggggaagctgacccgcgtcaagaactcgttcaagctgccggccgccgccgacgccaagtccaaggcgcccaagcccgccgccgcggccaagccgaagccagccaaggccgccaagcccgccgtcaagcccaaggcgtccccgaaggcgaagaccaagaccgccgccaagcccaaggcggccgccgcctcccccaagcgcaaggccaaggccgccg

SEQ ID NO: 38798 - protein, 192 aa, Panicum virgatum
  misc_feature: Ceres CLONE 1995543
  misc_feature (65)..(135): Pfam Name: Linker_histone Pfam Description: linker histone H1 and H5 family
MSTEEAAAAATEVPATEVESEAPPAEEAEAKPAKAKKAAPKEKKAPKEKKAAKEKKPAAARKPAAHPPYAEMISEAIAALKERTGSSSVAIGKYVEEKHGGQLPPNFRKLLAGQLKKLAAAGKLTRVKNSFKLPAAADAKSKAPKPAAAAKPKPAKAAKPAVKPKASPKAKTKTAAKPKAAAASPKRKAKAA

SEQ ID NO: 38799 - DNA, 737 bp, Panicum virgatum
  misc_feature: Ceres CLONE 1995547
  misc_feature: Encodes the peptide sequence at SEQ ID NO. 38800
acctcccctcctccacttatccgccgcctcccaatcatcctccccagtccccacccctccgacccccgccgccacacctcttcgcgccgccgccaccgccaccggcgagatggtcgggccaggcctctacaccgagatcggcaagaagaccagggatctgctgtacaaggactaccagaccgaccacaagttcaccctcaccacctacacctccaatggcgtcgctgtcacagctactagcacgaagaaagctgacctgatttttggtgagatccaatcacagataaagaacaagaacgtcaccgtagatgtgaaagcaaattcaggctcaaatgtcattactacagttactgttgatgagattgctacaccaggactgaagactatcttgagctttgctgttcctgatcagagatctggaaagtttgagcttcagtacttgcatgatcatgctggggttaacgcaagcattggtctgactgccaatcctgtagtcaacctctctggctcctttggaaccaaggctctggcaattggcgcagatttctcacttgatactgcatctgggaacttaatcaaatacaatgctggactgagcatcactcatgaagaccttatcgcatccctgaacctgaacaacaagggagacagcctaaccgcagcttactaccacaatgttaaccaattgactagcacagctgttgggtcagagctgacccactgcttctccaccaacg

SEQ ID NO: 38800 - protein, 209 aa, Panicum virgatum
  misc_feature: Ceres CLONE 1995547
  misc_feature (3)..(209): Pfam Name: Porin_3 Pfam Description: Eukaryotic porin
  misc_feature: Useful for making plants with modulated drought sensitivity
MVGPGLYTEIGKKTRDLLYKDYQTDHKFTLTTYTSNGVAVTATSTKKADLIFGEIQSQIKNKNVTVDVKANSGSNVITTVTVDEIATPGLKTILSFAVPDQRSGKFELQYLHDHAGVNASIGLTANPVVNLSGSFGTKALAIGADFSLDTASGNLIKYNAGLSITHEDLIASLNLNNKGDSLTAAYYHNVNQLTSTAVGSELTHCFSTN

SEQ ID NO: 38801 - DNA, 712 bp, Panicum virgatum
  misc_feature: Ceres CLONE 1995549
  misc_feature: Encodes the peptide sequence at SEQ ID NO. 38802
cggagaagagaccgcaactgcaaggcaccgcacaagaactcgccaggaagcgacgacgcggaaagccaagagaagccgcccgccgctgttggattgttccgttcttcgattcccccgcggagcgaaaatgagtgacaacttgatggacaaggttagcgcctttggcgagcgcctcaagatcactgggacggaggtcagcaagaagatgacggccggcatgagctccatgagcttcaagatgaaggaattgttccaggggcagactccggccgacaagatcgttgaggatgccacttcggagaacctggatgggcctgactggaacttgaacttggagatttgcgacctgatcaacactgagaaggttaacagtgtggagctcatccgtggcatcaagaagcagatcatgctgaaggatgcgaggatccagtacctctccttaatcctgctcgagactattgtgaagaactgcgagaaggccttctcggaggttgcggctgagcgggttcttaacgagatggttaggctgattgatgaccctcagacagttgtcaataacaggaacaaggcccttatgctgattgaagcgtggggggagtctggtgatgagctacgctacctgccagtctatgaggaaacctacaagagcttgaaatcaagaggagtgcggttttctggacgtgacaatgagagcttggctcccatattttct

SEQ ID NO: 38802 - protein, 194 aa, Panicum virgatum
  misc_feature: Ceres CLONE 1995549
  misc_feature (42)..(179): Pfam Name: VHS Pfam Description: VHS domain
MSDNLMDKVSAFGERLKITGTEVSKKMTAGMSSMSFKMKELFQGQTPADKIVEDATSENLDGPDWNLNLEICDLINTEKVNSVELIRGIKKQIMLKDARIQYLSLILLETIVKNCEKAFSEVAAERVLNEMVRLIDDPQTVVNNRNKALMLIEAWGESGDELRYLPVYEETYKSLKSRGVRFSGRDNESLAPIF

SEQ ID NO: 38803 - DNA, 604 bp, Panicum virgatum
  misc_feature: Ceres CLONE 1995560
  misc_feature: Encodes the peptide sequence at SEQ ID NO. 38804
gatccctgtctcatcccgctctacctcgcccgccgctccatccagcatgctcggcctccggcggatcctcgccgtctccggccacctgggcggctgccgcgcgccggcggtctcccccgcctccacggcctcctcccacagcgccttcttcgttcgcgccctccaaatcctcgcccaaccgggggccgtccgcatccagaagctctcggcgcccgacgatggtccgtgtctgtgtgtgctggcccccattccgagaaatttttgggtttacttgtggggatgggtttacttgtggggatcgcgtttcccagctctggttaatgggctacacggatcgtggagctgatgctggagcggccggaggccaagaacgccgtagggcgcggggatgctccaggggctgcgaagcgccatcgaggaggtggagaccgacaccacagccaaagtcttcttggtggccagctccgtgcccaaggttttctgcgcggccgccgatctcaaggaaaggaggttaatggggcctgctgaagttcgggactttgttaattccttaatatctacattttcatacactgaagcactgtcaattcctacgattgctgtt

SEQ ID NO: 38804 - protein, 71 aa, Panicum virgatum
  misc_feature: Ceres CLONE 1995560
  misc_feature: SWISSPROT Homolog: EC 4.2.1.18 Methylglutaconyl-CoA hydratase
MLQGLRSAIEEVETDTTAKVFLVASSVPKVFCAAADLKERRLMGPAEVRDFVNSLISTFSYTEALSIPTIA

SEQ ID NO: 38805 - DNA, 681 bp, Panicum virgatum
  misc_feature: Ceres CLONE 1995562
  misc_feature: Encodes the peptide sequence at SEQ ID NO. 38806
attccaaagcccttcctctcgctctcgcctccgcgccctagggtttcgccgccttgccggggacgagatgcagccgccggtgaacgggcagcagggcccgcccccgccgcagggctctggggccccggcaccgcctccacagcagcaccaggcgccaccagcaccgtattaccagcagcagccgcagtactaccagccggggccgcccccgcagccgtggggccagcagcagcagtatcctcctccgccgcagcagtacgctccgccgccgcagcagtacgccccgccgccaccccagcagtacgctcctccaccaccccagcagtacgcgcctccgccacagcagtacgcgccgcagcagcagtacggcaccgcgccaggaagcggcgagatcaggtctctttggatcggggatctccagtcctggatggacgagaactaccttaactaccaagccttcgcgtccgtggcgccacagattgccaatgtgaaaattatacggaacaaacagagtgggctgtctgaaggttatggatttattgagtttcactcccgagctgctgcagaatatactctgatgaacttcaatgggcagatgatgccgaatgttgacatggcttttaagctaaactgggcttcagctagcactggggataagcgtggagacaatggttctgatca

SEQ ID NO: 38806 - protein, 204 aa, Panicum virgatum
  misc_feature: Ceres CLONE 1995562
  misc_feature: The sequence is a functional homolog of SEQ ID NO 536 in the 10/666,642 US patent application
MQPPVNGQQGPPPPQGSGAPAPPPQQHQAPPAPYYQQQPQYYQPGPPPQPWGQQQQYPPPPQQYAPPPQQYAPPPPQQYAPPPPQQYAPPPQQYAPQQQYGTAPGSGEIRSLWIGDLQSWMDENYLNYQAFASVAPQIANVKIIRNKQSGLSEGYGFIEFHSRAAAEYTLMNFNGQMMPNVDMAFKLNWASASTGDKRGDNGSD

SEQ ID NO: 38807 - DNA, 1071 bp, Panicum virgatum
  misc_feature: Ceres CLONE 1995565
  misc_feature: Encodes the peptide sequence at SEQ ID NO. 38808
actcacaccgagcaagcaattaaacgagtgagagctccagcagttcagccactgtgaaccgagaacccgttgattgatcatggcgtctgagaagagcaagatcctggtggtcggcgccacgggttacctgggccggcacgtcgtggcggcgagcgcgcggctgggccacccgaccttcgcgctggtcagggacccagcgccgtccgatccggccaaggcgcaggtgctcaagggcttccaggagtccggcgtcacgctcgtcaagggcgacctgtacgaccacggcagcctggtcagcgcggtcaaggccgccgacgtggtcatctccacgctcggcgcgctgcagatcgccgaccagaccaagctcatcgacgccatcaaggaggccggcaacgtgaagaggttcttcccgtcggagttcggtctggacgtggatcgcacgggcgcagtggagccggccaagtccatcttcgcggggaaggtggcgatccgccgcgccgtggaagcctccggcgtgccgtacaccttcgtggtggtgggctacttcgctggctacgggctgccgaacatcgggcaggcgctctcccccgcgccgccgacggacaaggccgtcgtcctcggcgacggcaacaccaaggtcgtgttcgtggaggaaggcgacatcgggacgtacacgatgctcgccgccgacgacccccgcgtggcgaacaagacgctgtacatcaagcccccggccaacacgctgacgcacaacgagctgctgtcgctgtgggagaagaagaccggcaagacgttcgagagggtgtaccttcccgaggaggccgtgctcaagcagatccaagaatcccctatcccgctgaacatcattctggcgatcgcgcacgcggcgtatgtcaggggggagcagaccggtttcgagatcgacccggcaaagggggtggacgccagcgagctgtacccagacgtcaagtacaccacggtcgacgagtacctcaacaggttgctctgaacaaatgatggaccagctagtgactggtgaaggctatgcattgtcactgtggcatttattcg

SEQ ID NO: 38808 - protein, 309 aa, Panicum virgatum
  misc_feature: Ceres CLONE 1995565
  misc_feature (8)..(300): Pfam Name: NmrA Pfam Description: NmrA-like family
  misc_feature: SWISSPROT Homolog: EC 1.3.1.45 2'-hydroxyisoflavone reductase
MASEKSKILVVGATGYLGRHVVAASARLGHPTFALVRDPAPSDPAKAQVLKGFQESGVTLVKGDLYDHGSLVSAVKAADVVISTLGALQIADQTKLIDAIKEAGNVKRFFPSEFGLDVDRTGAVEPAKSIFAGKVAIRRAVEASGVPYTFVVVGYFAGYGLPNIGQALSPAPPTDKAVVLGDGNTKVVFVEEGDIGTYTMLAADDPRVANKTLYIKPPANTLTHNELLSLWEKKTGKTFERVYLPEEAVLKQIQESPIPLNIILAIAHAAYVRGEQTGFEIDPAKGVDASELYPDVKYTTVDEYLNRLL

SEQ ID NO: 38809 - DNA, 760 bp, Panicum virgatum
  misc_feature: Ceres CLONE 1995566
  misc_feature: Encodes the peptide sequence at SEQ ID NO. 38810
cgtggactcccggctgccccgcctccctgctgtgctgccgccccgctccagcattcccaacccccaccccgcgcggccgtcgccggagcgagcagagcagccggagggcacgtcggatccgccgccgccaagatgaacgacgccgatgtctccaagcagatccagcagatggtgcggttcatctgccaggaggccgaggagaaggccagcgagatctccgtctccgccgaggaggaattcaacattgagaagttgcagcttgttgaagctgagaaaaagaagatcaggcaagagtatgaacgaaaagggaagcaggttgaagtacggaagaaaattgagtactctatgcagttgaatgcttctcgcatcaaagttcttcaagctcaggatgatctagttaacaaaatgaaagaggatgccatgaaggaactccttcgtgtcagcgacaaccaccacgaatacaagaaccttttgaaagatctaatcgttcagggcttgctcaggttgaaagagccagctgtactgctccgttgccgtaaagaggaccaccatcatgtggaatctgtactgcattcagcaaagcatgagtatgcatcaaaagcagatgtccatcaaccagagatatttgttgaccatgatgtgtacctgccacctgccccaagccatcatgatgttcatggccagttttgcttttggaggtgttgtcctggcttctcgagatggaaaagattgtgtttgagagtacacttgatgcaagact

SEQ ID NO: 38810 - protein, 209 aa, Panicum virgatum
  misc_feature: Ceres CLONE 1995566
  misc_feature (16)..(187): Pfam Name: vATP-synt_E Pfam Description: ATP synthase (E/31 kDa) subunit
  misc_feature: SWISSPROT Homolog: EC 3.6.3.14 H(+)-transporting two-sector ATPase
MNDADVSKQIQQMVRFICQEAEEKASEISVSAEEEFNIEKLQLVEAEKKKIRQEYERKGKQVEVRKKIEYSMQLNASRIKVLQAQDDLVNKMKEDAMKELLRVSDNHHEYKNLLKDLIVQGLLRLKEPAVLLRCRKEDHHHVESVLHSAKHEYASKADVHQPEIFVDHDVYLPPAPSHHDVHGQFCFWRCCPGFSRWKRLCLRVHLMQD

SEQ ID NO: 38811 - DNA, 746 bp, Panicum virgatum
  misc_feature: Ceres CLONE 1995620
  misc_feature: Encodes the peptide sequence at SEQ ID NO. 38812
agaagagtcccttagcaacacacacacacaagagaaaagagaggccgagcaagcaaggcccaagcctacgatgggcgcgctcatgcttcttcatgtcctcctcgttgcggtggcggcgagggctcctgccgctcaggcatggggcaaggaggggcactacatggtgtgcaagatcgccgagagctttctgacggaacaggcctcgacggcggtgaagggcctgctgccggggtgggccggcggcgacctcgcggagacgtgctcgtgggcggaccagcagcggttccggtaccggtggtccagccccctgcacttcgccgacacgccgggggactgcaagttcgactatgccagggactgccacaacacggaaggagagaaggacatgtgcgtggttggagcaatcaacaactacaccgcggctctgaaggactcatcaagtccatatgatccgaccgagagcttgatgttccttgcacacttcgtcggcgatgtccaccagccgctccactgcggcaacgccgacgatctcggcggcaacaccatcatcgtccactggtacagaaggaagagcaacctgcaccatgtgtgggatgtgaacgtgattgagacagccatgaaggatttctacgacaacgatctaagcaccatgatacaggccatacagcagaacatcactgaggagtgggctaaatgaagagaaacagtgggagacgtgccgtagccggataaagacttgtgctgac

SEQ ID NO: 38812 - protein, 208 aa, Panicum virgatum
  misc_feature: Ceres CLONE 1995620
  misc_feature (24)..(208): Pfam Name: S1-P1_nuclease Pfam Description: S1/P1 Nuclease
  misc_feature: SWISSPROT Homolog: EC 3.1.30.1 Aspergillus nuclease S(1)
MGALMLLHVLLVAVAARAPAAQAWGKEGHYMVCKIAESFLTEQASTAVKGLLPGWAGGDLAETCSWADQQRFRYRWSSPLHFADTPGDCKFDYARDCHNTEGEKDMCVVGAINNYTAALKDSSSPYDPTESLMFLAHFVGDVHQPLHCGNADDLGGNTIIVHWYRRKSNLHHVWDVNVIETAMKDFYDNDLSTMIQAIQQNITEEWAK

SEQ ID NO: 38813 - DNA, 728 bp, Panicum virgatum
  misc_feature: Ceres CLONE 1995622
  misc_feature: Encodes the peptide sequence at SEQ ID NO. 38814
accactttttcctgaggtaggctttgcgctctctccgcctctcgtctccccctcgctgccttcctcttccgctctagggtttataccattcgactctccgccggcgtctccgcaggctcgccaaggaggggagacacgatgaggccggtcttctgcggcaacttcgactacgacacgcgccagtacgacctggagggtctcttctccaagtacggccccatccgccgcatcgacatgaagtcaggttatgctttcatttactttgaagatgagcgcgatgcagaggatgctataaggcgtctcgacaatgtgtcttttggttatagcaggcgcaggctctctgtagaatggtcgaggcaagttgaaccagtgtcaaggagccgtgataggcctgctggggatgtaaagccaactagaactctctttgttatcaattttgaccccatacgcactaaaattcaagatattgagaggcattttgaaccatatggcaagattacaaacattcgtgttcgaaggaactttgcgtttgtacagtacgagacacaagaggaagctagtgctgctgtcaagaacactgataagagcacaatattggacagggtggtgacagtagaatacgccttccgggatgatgacaatgaaagagatgacagatatggtggcagccccaagcggcgtggtcacgacaggcatcacggtagcccctacacgcgctcacctagccc

SEQ ID NO: 38814 - protein, 196 aa, Panicum virgatum
  misc_feature: Ceres CLONE 1995622
  misc_feature (4)..(69): Pfam Name: RRM_1 Pfam Description: RNA recognition motif. (a.k.a. RRM, RBD, or RNP domain)
  misc_feature (95)..(159): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated biomass
MRPVFCGNFDYDTRQYDLEGLFSKYGPIRRIDMKSGYAFIYFEDERDAEDAIRRLDNVSFGYSRRRLSVEWSRQVEPVSRSRDRPAGDVKPTRTLFVINFDPIRTKIQDIERHFEPYGKITNIRVRRNFAFVQYETQEEASAAVKNTDKSTILDRVVTVEYAFRDDDNERDDRYGGSPKRRGHDRHHGSPYTRSPS

SEQ ID NO: 38815 - DNA, 674 bp, Panicum virgatum
  misc_feature: Ceres CLONE 1995628
  misc_feature: Encodes the peptide sequence at SEQ ID NO. 38816
atcgagtcgataagatcgagctcggggaggttggggcgcaggaaaaaaaatcatctccaatctccaaccaaactaaccctagcagcagccggcggttagggtttcgagcgagatggcggcggcggcgaggcagcgggggacggtgaagtggttcaacgacaccaagggcttcggcttcatctcccccgaggacggcagcgaggacctcttcgtccaccagtcgtccatcaagtcggagggcttccgctccctcgccgagggcgaggaggtcgagttctccgtctcggagggcgacgacggccgcacaaaggccgtcgacgtcaccggccccgacggatccttcgtcaagggcggctccggcggcggcgggggcgccttcggatctcgcggcggggccggatctggcggcggcggccgcagctacggcggcagctggggcggcgggaggagatccggccccggcggcggtggcggcggcggcggcgcgtgctacaagtgcggggagcccggccacatggctagggactgccccaccgccgacggaggcagcggttacggcgggggaggctacggtggcggcggcggcggcggcggcggctgctttaagtgcggggagcctggccacatggccagggactgctccagcggcggcggcggcggcggcggcggctacg

SEQ ID NO: 38816 - protein, 187 aa, Panicum virgatum
  misc_feature: Ceres CLONE 1995628
  misc_feature (6)..(73): Pfam Name: CSD Pfam Description: 'Cold-shock' DNA-binding domain
  misc_feature (124)..(141): Pfam Name: zf-CCHC Pfam Description: Zinc knuckle
  misc_feature (161)..(178): Pfam Name: zf-CCHC Pfam Description: Zinc knuckle
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 468 in the 11/479,226 US patent application
MAAAARQRGTVKWFNDTKGFGFISPEDGSEDLFVHQSSIKSEGFRSLAEGEEVEFSVSEGDDGRTKAVDVTGPDGSFVKGGSGGGGGAFGSRGGAGSGGGGRSYGGSWGGGRRSGPGGGGGGGGACYKCGEPGHMARDCPTADGGSGYGGGGYGGGGGGGGGCFKCGEPGHMARDCSSGGGGGGGGY

SEQ ID NO: 38817 - DNA, 738 bp, Panicum virgatum
  misc_feature: Ceres CLONE 1995647
  misc_feature: Encodes the peptide sequence at SEQ ID NO. 38818
cacggactacgcatgccggagcgcgctcagcgagtgcgtggactccatcaacggcccagggtaccggtgcagctgctccagcggctacgagggcaacccatacctcgacggtggatgtatagacatcgacgagtgccagcgcagagaccagtacccatgcttcggcgtctgtacaaacactccgggaagctatacctgtcaatgtcatccagggacaagtggagacgcctctaggaagaatggttgccggccaaaggacaagttcaccttagctctcagagttgttacaggagtcagcgctggcgtattcttgttaggcttcacatgcttctggctctacctgggacaccagaagaggaagctcatcagagccaagcagaagttctttgagcagaacgggggcatgcttctccagcaacagatgcgctcctacgacagggctggcgccgcagcgacagggttcaagatattctccaaggaagagctcgacaaggcaaccaatggcttcgccgccgaccgcgttctaggacgtggtgggcacggcatcgtctacaagggtgtactcgaggacaagagggttgtggccatcaagaagtcaaagatgatggaggaggccgagaccagggagttcgcgagggaaatgttcatcctctcccagatcaaccatagaaacgtcgtcaagctgctcggctgctgcctcgaagtcgaggtgcccatgctggtgtacgagttcgtctc

SEQ ID NO: 38818 - protein, 245 aa, Panicum virgatum
  misc_feature: Ceres CLONE 1995647
  misc_feature: SWISSPROT Homolog: EC 2.7.11.1 Non-specific serine/threonine protein kinase
TDYACRSALSECVDSINGPGYRCSCSSGYEGNPYLDGGCIDIDECQRRDQYPCFGVCTNTPGSYTCQCHPGTSGDASRKNGCRPKDKFTLALRVVTGVSAGVFLLGFTCFWLYLGHQKRKLIRAKQKFFEQNGGMLLQQQMRSYDRAGAAATGFKIFSKEELDKATNGFAADRVLGRGGHGIVYKGVLEDKRVVAIKKSKMMEEAETREFAREMFILSQINHRNVVKLLGCCLEVEVPMLVYEFV

SEQ ID NO: 38819 - DNA, 732 bp, Panicum virgatum
  misc_feature: Ceres CLONE 1995658
  misc_feature: Encodes the peptide sequence at SEQ ID NO. 38820
attcatagacactgccactcccccgctatagctgcttgctcgccagtcgccatggcggccaccaccatcctcctcctcctcgccgccactgcggcctcggccgccgagctctccgtgtaccacaacgtgcacccgccgtccccgtccccgctcgagtccatcatcgcgctcgcgcgcgccgatgacgcgcgcctcctcttcctctcctccaaggccgccgcctcgcccggcgtcacctccgcgcccgtcgcctccggccaggccccgccctcgtacgtcgtccgcgccgggctcggcaccccggtgcagcagaccctcctcgcgctcgacaccagcgccgacgccacctgggcgcactgcgccccctgcgacacgtgccccgcgggcagccgcttcatcccggccagctcttcctcgtacgcggcgctcccgtgcgcctccgactggtgccccctcttccagggccagccgtgcccggcgaaccaggccgccagcgcggcgctgcccgcgtgcgccttctccaagccgttcgccgacgcctccttccaggcgtcgctgggcagcgacacgctgcggctgggcaaggacgccatcgccaacttcgccttcgggtgcgtgggcgcggtgaccgggccgaccacgaacctgccgaagcaggggctcctcggcctcggccgtggccccatgtccctgctgtcccagaccgggagcaggtacaacggcgtcttctcc

SEQ ID NO: 38820 - protein, 226 aa, Panicum virgatum
  misc_feature: Ceres CLONE 1995658
  misc_feature: SWISSPROT Homolog: EC 3.4.23.12 Nepenthesin
MAATTILLLLAATAASAAELSVYHNVHPPSPSPLESIIALARADDARLLFLSSKAAASPGVTSAPVASGQAPPSYVVRAGLGTPVQQTLLALDTSADATWAHCAPCDTCPAGSRFIPASSSSYAALPCASDWCPLFQGQPCPANQAASAALPACAFSKPFADASFQASLGSDTLRLGKDAIANFAFGCVGAVTGPTTNLPKQGLLGLGRGPMSLLSQTGSRYNGVF

SEQ ID NO: 38821 - DNA, 1858 bp, Panicum virgatum
  misc_feature: Ceres CLONE 1995660
  misc_feature: Encodes the peptide sequence at SEQ ID NO. 38822
cccccccccccgcggtaattctcttcctctgctcgcaagcagctcgagcttgctcagatggatttatctctccgttcagttagtcgccaatttgtctgactgcgagatagattaggctccgcttcctcggcgcgcgagatcgattgatgtcggttggcgcggcttggtacctaggggccgcgcaagctttatgtgccgaaataatttggagggttcagttaagctcagtgcagatcgggtgtgcgcattttctgtttcttcttcttcttgatttgatttgtgatgcggccaacagggatttagggaggagaggaagcaagtggttcaccatgaaggcgctcattcttgttgggggtttcggaacccgcctgcgccctttgactctcagcttcccaaagccccttgttgattttgcaaacaagcccatgattctgcatcagattgaagctttgaaagaagttggggtcacggaggtggttttagccatcaactaccgcccagaggtgatgattaacttcttgaaggactttgaggataagcttggcatcacaattacatgctctcaagagatcgagcccttaggaactgctggcccacttgctctagcaagggacaagcttgtggatggatctggcgagccattctttgtcctcaacagtgatgtcataagtgaatacccatttgctgaactcatcaaatttcacaagggccatggtggtgaggcaacaattatggtcactaaggtggatgaaccatcaaaatatggtgttgtggtcatggaggaggcaactggaagggtggatagatttgtagagaagccaaaaatatttgtgggcaacaagatcaatgctgggatttacttgctgaacccatctgtccttgatcgcattgaactgaggccaacatcaattgagaaagaggtcttccctcaaattgcagctgaccaaaagctctatgcgatggttcttccaggattttggatggatgttggtcagccgagggactacattactggattgcgtctttatctagattcacttaggaagaaatcagctgccaggcttgctactggagcacatgtcgttggcaatgtgttggtgcatgagagtgccaagattggagagggttgtctgattggtcctgatgtcgctattggacctggatgcaccgtggaggatggtgtgaggctttcccgttgcactgtcatgcgtggtgttcgtatcaagaagcacgcttgcatctcaaacagcattatcggttggcactcaactgttggacaatgggcacggatagagaatatgactatcctgggggaggatgttcatgtatgcgatgaagtatacagcaatggcggtgttgttctcccacacaaagagatcaagtcaagcatcttgaaacctgagatcgtcatgtgagctatccagtttagctacagtacattcttaccaatgaggatcccaaaccccccttttacaaacgatctctcttggtgtctttgtcctagtggaaacagcatgatacatgttcgcttgttaaattattgacaatgtatccttgattccttgttctatgttgaaaaaatttagtgtgtaatcatgagtgacaaatcacaagtgattgtgctctcttgagctacgaggttttggactctttggtgtctgcagaagttcaataccatagcaataataagttgaagaaaaagattgtggtccaaggtgactttgagtgagattaagtctgtttgtgtgctaattgataaatgctattcagtagaaatgtacacagaagccatgtgtaatgtaaccgaatattgtgcatatcattttgtaccaatgaatatactgtcggtctgctacct

SEQ ID NO: 38822 - protein, 422 aa, Panicum virgatum
  misc_feature: Ceres CLONE 1995660
  misc_feature (63)..(297): Pfam Name: NTP_transferase Pfam Description: Nucleotidyl transferase
  misc_feature: SWISSPROT Homolog: EC 2.7.7.13 Mannose-1-phosphate guanylyltransferase
MSVGAAWYLGAAQALCAEIIWRVQLSSVQIGCAHFLFLLLLDLICDAANRDLGRRGSKWFTMKALILVGGFGTRLRPLTLSFPKPLVDFANKPMILHQIEALKEVGVTEVVLAINYRPEVMINFLKDFEDKLGITITCSQEIEPLGTAGPLALARDKLVDGSGEPFFVLNSDVISEYPFAELIKFHKGHGGEATIMVTKVDEPSKYGVVVMEEATGRVDRFVEKPKIFVGNKINAGIYLLNPSVLDRIELRPTSIEKEVFPQIAADQKLYAMVLPGFWMDVGQPRDYITGLRLYLDSLRKKSAARLATGAHVVGNVLVHESAKIGEGCLIGPDVAIGPGCTVEDGVRLSRCTVMRGVRIKKHACISNSIIGWHSTVGQWARIENMTILGEDVHVCDEVYSNGGVVLPHKEIKSSILKPEIVM

SEQ ID NO: 38823 - DNA, 1257 bp, Panicum virgatum
  misc_feature: Ceres CLONE 1995663
  misc_feature: Encodes the peptide sequence at SEQ ID NO. 38824
gttgttgcctccgcttccatcccaatcccaccaaggagaagcaaggcaccaagccatgagccaacccgacttctctccgtcgcagttctcccagtcccagaatgccgccgccgatgccaccgcaccgtccaagatgcggggcgcgtccagcaccacgccgctcaccgtcaagcagatcgccgacgcgcaccaatctgccaacggcgacaagggcgcccccttcgtcgtcgacggcgtcgagacggctaatattagacttgtggggatggtcaacggcaaggcggagaggaccaccgatgtgtcgttcacgctcgacgacggcacaggccgcctcgatttcattagatgggtgaatgatgcttccgattcttctgaaactgctgctattcagaatggtatgtacatctctgtcattggtagcatcaagggacttcaagagcgaaagcgtgccactgctttctcaatcaggcctgtaactgatttcaatgaggttatgctgcatttcattcagtgtgttcggatgcatatagagaacactaaatctaaggttggcagtcccgcacgaaccagttcttcaatgggagtgtctgtctcaaatgggttcagtgaatcaagcacaccaacatctttgaaatccaatcccgcacccatgaccagtggagcaaatggaaatgacactgatttgaacacacacgtgctgaatattttccgtgaaccagcaaacattgagagtgagcatggggtgcacatcgatgaggtagtcaagcggctcaaattgccagaggagaagatcaaggaagctattgtttacaatgtggatgttgggcatatttactcaaccattgatgattttcacttcaagtcagctttgaccgactgaagttgcaagcaaaatcaagcatgtttatcagtaccctagctggctgcttgcaagtcagattatcctagagggggcgttgctgactatccatggtttcacaaacctgattccaccttgtcgtactaagttaggaaaggaaagggtgctgttgagaaaagaccatttgatggtgttaaccctaagataagttgatcctatatgtactgtgtgtggagatatcgtgttgttgtgtctcggttaatttctttgcatcgtctgatgcagttgcgacggtgaagatgagtggcaaaatcctagcctcatctgtgtcaaatcatatccgagtgtttttgtatgtggtgatgcattcaaaatcaaatcatagcctcattatgtgc

SEQ ID NO: 38824 - protein, 274 aa, Panicum virgatum
  misc_feature: Ceres CLONE 1995663
  misc_feature (157)..(266): Pfam Name: RPA_C Pfam Description: Replication protein A C terminal
  misc_feature (66)..(140): Pfam Name: tRNA_anti Pfam Description: OB-fold nucleic acid binding domain
MSQPDFSPSQFSQSQNAAADATAPSKMRGASSTTPLTVKQIADAHQSANGDKGAPFVVDGVETANIRLVGMVNGKAERTTDVSFTLDDGTGRLDFIRWVNDASDSSETAAIQNGMYISVIGSIKGLQERKRATAFSIRPVTDFNEVMLHFIQCVRMHIENTKSKVGSPARTSSSMGVSVSNGFSESSTPTSLKSNPAPMTSGANGNDTDLNTHVLNIFREPANIESEHGVHIDEVVKRLKLPEEKIKEAIVYNVDVGHIYSTIDDFHFKSALTD

SEQ ID NO: 38825 - DNA, 685 bp, Panicum virgatum
  misc_feature: Ceres CLONE 1995712
  misc_feature: Encodes the peptide sequence at SEQ ID NO. 38826
actcgcacacagccgccgcccgaccaactagggacctgcacgagcgccgccgttcgccgtcgccggcgacgagccgctgcccgccggcaaggagcgcaggctgtaacccctgcagtagtgaatagcaaggagttaggcgaaatggatatgcaagagaacacaacccgcattcatcatggaaagacaaagaaaaaagaaagtgcaaagaaaaaagagaaagcaaggaagaggacatcatctgttttggattctactaatgaaacagcctatgaggaaatgccagagtatgatcttgatggacctactatcggcgaaaaactagctactctggatttgatcaatagagataatgaaaagaatgatactcaagagcaaacactatctatggtgccaccaagtgcagattcagtccatattttgctcaagcaagctctgcgtgctgatgataacgtatcattgctaacttgcttgtataatagagatgaaaaggttattgcaaaatctatatcactcctaacaccagcagatgttgtgaagcttctcaagttcttcgtattgcaaatacaatctaggggcgcagtcttggtttgtttgcttccctggctgcaaactttacttaatctgcacatgagcagcatagtgtcccaggaatcttctctgtccttgctcaactcgctctaccagc

SEQ ID NO: 38826 - protein, 181 aa, Panicum virgatum
  misc_feature: Ceres CLONE 1995712
  misc_feature (118)..(181): Pfam Name: NUC189 Pfam Description: NUC189 domain
MDMQENTTRIHHGKTKKKESAKKKEKARKRTSSVLDSTNETAYEEMPEYDLDGPTIGEKLATLDLINRDNEKNDTQEQTLSMVPPSADSVHILLKQALRADDNVSLLTCLYNRDEKVIAKSISLLTPADVVKLLKFFVLQIQSRGAVLVCLLPWLQTLLNLHMSSIVSQESSLSLLNSLYQ

SEQ ID NO: 38827 - DNA, 678 bp, Panicum virgatum
  misc_feature: Ceres CLONE 1995713
  misc_feature: Encodes the peptide sequence at SEQ ID NO. 38828
aggctgtaacccacccacccccccaccaacccgaccaccccgccgcgccgccgcgtcaagcaacggcgcaacgcagcccatggccttcacctcccaatccctaatcttccgggcacccgtctccctccccagcggccgcctcgccgccccaggtcgcgttgccctccggggccgcggtgccgcgtttccttccgtcgcggccgcctccactccgagtccgatggcgaagtcggatggcgacgagaaggagatgaagctttggggcgggcgcttcgaggagggcgtcacggacgccgtggagcgcttcacggagtccatctcctacgactggcagctctacaagtacgacatcatgggcagcaaggctcatgccaccatgctcgcctcccagggtttgataactgctggcgatagggatatcatcttagagggtctcgatcagattgagacgcttattcaagaaggcaagtttgagtggagaaaggatcgggaggatgtgcatatgaacattgaagcagctctgattgagagggttggtgagccggcgaagaagctgcacactgctaggagccgcaatgaccaaattgtgacggatctaaggctatggtgccgtgatgctatcgataagattttgattcgtatcaagcagtttcaggtgtctttggttacattagcttc

SEQ ID NO: 38828 - protein, 199 aa, Panicum virgatum
  misc_feature: Ceres CLONE 1995713
  misc_feature: SWISSPROT Homolog: EC 4.3.2.1 Argininosuccinate lyase
  misc_feature: Useful for making plants with modulated salt sensitivity
MAFTSQSLIFRAPVSLPSGRLAAPGRVALRGRGAAFPSVAAASTPSPMAKSDGDEKEMKLWGGRFEEGVTDAVERFTESISYDWQLYKYDIMGSKAHATMLASQGLITAGDRDIILEGLDQIETLIQEGKFEWRKDREDVHMNIEAALIERVGEPAKKLHTARSRNDQIVTDLRLWCRDAIDKILIRIKQFQVSLVTLA

SEQ ID NO: 38829 - DNA, 679 bp, Panicum virgatum
  misc_feature: Ceres CLONE 1995718
  misc_feature: Encodes the peptide sequence at SEQ ID NO. 38830
agttaagcaagcaagcaagctactgatcgagctagcagctggctagtcttctagtggtccctggatctcgggattggttgggaagaaatcgcctgatcatcatttgcctattactagctgctatagatctctggccatggcggcttcgttccggtcttccggacattgcattgcttgatgctcgccttgctcgtgctcgctccggcggcgcacgggcagctctcgccgtcgttctacgcgaggagctgcccgacgctggggctcatcgtgcgcgccaccatgatcagggccctcctcgccgagcgccggatgggcgcctccctcatcaggctcttcttccacgactgcttcgtccagggatgcgacggctcgattcttcttgacgacgtgggcagcttcgtcggcgagaagggcgctggccccaacgtcaactccgtccgcggctacgaggtcatcgaccagatcaaggccagcgtcgaggccatctgccccggcgtcgtctcctgcgccgacatcgtcgccctcgccgcccgcgacagcaccttcctgctcggagggccgacatgggcggtgccgctcggccggcgcgactcgacgacggcgagccagagcatggcgaacaccgacctcccgtcgccggcctccgacctcgccaccctcatctcggcgttcggcaaca

SEQ ID NO: 38830 - protein, 167 aa, Panicum virgatum
  misc_feature: Ceres CLONE 1995718
  misc_feature (31)..(167): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MLALLVLAPAAHGQLSPSFYARSCPTLGLIVRATMIRALLAERRMGASLIRLFFHDCFVQGCDGSILLDDVGSFVGEKGAGPNVNSVRGYEVIDQIKASVEAICPGVVSCADIVALAARDSTFLLGGPTWAVPLGRRDSTTASQSMANTDLPSPASDLATLISAFGN

SEQ ID NO: 38831 - DNA, 717 bp, Panicum virgatum
  misc_feature: Ceres CLONE 1995774
  misc_feature: Encodes the peptide sequence at SEQ ID NO. 38832
tgagcggctatccaccgccgccgggggcctggaccaccggcctctgtggctgctgcagcgactgcaagagctgctgcctggcgttcttctgcccgtgtgtcgcattcggccaggtggcagagaccttggacaagggatccacatgtaagtctgttttgctaaataaagctggtgtagatcgatgatggaagtcttgtgtgcccatcgagtatcgtctctgctcagagacctgttgtatatatgcagcctgtggtatggctggtgcgatctactgcgggctgcagcacgcggggttgtgcctgctccactgcctctactcctgctcctaccgccgcaagctccgggcggcgtacggcctgccggcggagccatgcgccgacggctgcgtccactgcttctgcgagccatgtgcgctctcccagatgtaccgggagctcaagaaccgaggcgccgacccggcagatggtaagagtatgggattgtatacattcatcgtccacgtcatatgcttttttttttttaagaaacatccacctcatatgctctcagcccagtaaggtattcatccacctcatacatacatgcgtaactcaataaaattactaataacaaaaagagcatatacatgctttagaccactgaaaaatcagtggtgaaaactgagaatcttgtcgttcatgcttgtaggagtacatgctgtgttcagtcatgcttttt

SEQ ID NO: 38832 - protein, 100 aa, Panicum virgatum
  misc_feature: Ceres CLONE 1995774
  misc_feature (1)..(61): Pfam Name: PLAC8 Pfam Description: PLAC8 family
MAGAIYCGLQHAGLCLLHCLYSCSYRRKLRAAYGLPAEPCADGCVHCFCEPCALSQMYRELKNRGADPADGKSMGLYTFIVHVICFFFFKKHPPHMLSAQ

SEQ ID NO: 38833 - DNA, 229 bp, Panicum virgatum
  misc_feature: Ceres CLONE 1995777
  misc_feature: Encodes the peptide sequence at SEQ ID NO. 38834
aaccgcgtccgcttctcccagatcccctgcgcccgccgcatccctgtagccgcccctgctgccggcgagcccgatccgccccgccgcttctcccccgcccgcagccagccatgtcgccgtcggagccgacgcgcgaggagagcgtgtacatggcgaagctcgccgagcaggcggagcggtacgaggagatggtggagttcatggagcgcgtggcgcgctcggctggcgg

SEQ ID NO: 38834 - protein, 39 aa, Panicum virgatum
  misc_feature: Ceres CLONE 1995777
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 786 in the 11/479,226 US patent application
  misc_feature: The sequence is a functional homolog of SEQ ID NO 789 in the 11/479,226 US patent application
  misc_feature: The sequence is a functional homolog of SEQ ID NO 801 in the 11/479,226 US patent application
  misc_feature: The sequence is a functional homolog of SEQ ID NO 797 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 793 in the 11/479,226 US patent application
MSPSEPTREESVYMAKLAEQAERYEEMVEFMERVARSAG

SEQ ID NO: 38835 - DNA, 702 bp, Panicum virgatum
  misc_feature: Ceres CLONE 1995779
  misc_feature: Encodes the peptide sequence at SEQ ID NO. 38836
acacaccgaacccacccccgcacccaccgccgcacccgccgtggccgccgcggcagcgcccctcccggcggtgagcgcagcccagatctagggctggtagaggcgtgctcgccccccgcggcagctccatggcgccgcgacagccgtggtggacggcgctgctcttacccttcctcctcgccggcgtcgggccctccaccgccgcttcgattcctaccgatgcgtgccgggtccctactatcgtggaatccgttctcgggactcccgagatgtgctcggcgctggatcgccttttcggcgacccggtcggcgtcatcgagggagatgaggtcacattggcaaaggcagttaatcttcttcacatgaacaaggatgactatattgctgtccttttttatgcatcatggtgcccattctcacaagaatgcaaaccaaattttgaggcattagcttccttattcccaactattcggcattttgcatttgaggaatctgcaattaggccaagcataatatcgagatatggaattcatggttttccaacactgtttctcttgaattcgaccatgagagtgcggtatcatggaccaaggactgtaaaatcacttgctgctttctacactgatgtctcaggtatcaatgcttcggtgaagtcaactgcaggggaggccatagtacattcattagatgatattgagcata

SEQ ID NO: 38836 - protein, 191 aa, Panicum virgatum
  misc_feature: Ceres CLONE 1995779
  misc_feature: SWISSPROT Homolog: EC 5.3.4.1 Protein disulfide-isomerase
MAPRQPWWTALLLPFLLAGVGPSTAASIPTDACRVPTIVESVLGTPEMCSALDRLFGDPVGVIEGDEVTLAKAVNLLHMNKDDYIAVLFYASWCPFSQECKPNFEALASLFPTIRHFAFEESAIRPSIISRYGIHGFPTLFLLNSTMRVRYHGPRTVKSLAAFYTDVSGINASVKSTAGEAIVHSLDDIEH

SEQ ID NO: 38837 - DNA, 654 bp, Panicum virgatum
  misc_feature: Ceres CLONE 1995781
  misc_feature: Encodes the peptide sequence at SEQ ID NO. 38838
ctttctcgcgagcaaaacaggcaaaggttacgggcagccatgaggcggcggccaccttcccattcccgtgccgccgccgccgctgccgtgctcctgctcctgctgctgtcccccgctccgagctcccagctcgacctgggctccgccattgccgcctggatcaacggcgcgccaccgccgtctcctagccctcccgccggcgccggcgtcggcgcctcctcctcctcatcctcagccgcgccgagtcaggagtacacggcgctgcaggcgctgaaggcggccgtcaccgaggacccccgcggcgcgctgtcgtcgtggcagggcgccaatgtctgcgcctacagtggcgtctactgctccgcgccgcccgacggcgcgggcgcgcccacggtggtggcggggatcgacctcaaccgcgccagcctcaggggcacgctccccgaggcggtctccctcctggcgcacctcacgttcctccacctcaacagcaaccgcctgggcggcgccgtcccagactcgctccgggacctgcagtacctgacggagctggacctcagcaacaacctcttctccggcccgttcccggcgtccacgctgctcatcccgtcgctggtgtacctggacctccgcttcaacgccttctccggggagctc

SEQ ID NO: 38838 - protein, 204 aa, Panicum virgatum
  misc_feature: Ceres CLONE 1995781
  misc_feature (68)..(107): Pfam Name: LRRNT_2 Pfam Description: Leucine rich repeat N-terminal domain
  misc_feature: SWISSPROT Homolog: EC 2.7.11.1 Non-specific serine/threonine protein kinase
MRRRPPSHSRAAAAAAVLLLLLLSPAPSSQLDLGSAIAAWINGAPPPSPSPPAGAGVGASSSSSSAAPSQEYTALQALKAAVTEDPRGALSSWQGANVCAYSGVYCSAPPDGAGAPTVVAGIDLNRASLRGTLPEAVSLLAHLTFLHLNSNRLGGAVPDSLRDLQYLTELDLSNNLFSGPFPASTLLIPSLVYLDLRFNAFSGE

SEQ ID NO: 38839 - DNA, 735 bp, Panicum virgatum
  misc_feature: Ceres CLONE 1995784
  misc_feature: Encodes the peptide sequence at SEQ ID NO. 38840
gagagagagagcagtggtgactgcggagagccgagagggcgcggtggccggtggatggcgatggccggcggcgggggactgaaccggtcgtcgtcgagggggcagatgccaccacaagagcttctcgacgatctctgcagccgcttcctgctgaacgtgcccaaggaggagctcgagtcgttcgagcggatcctgttcctgctggagcaggcgcactggttctacgaggacaactccgtcgagcacaaccccaacctcaagtccctgtccttcaaggacttcacctccctcatgttcaagagctgcactgctctcaggccctacatcgcgcacctggatgatatctacaaggacttcaacaactacaagttccgcgtccctgtgtccggcgccatcatcctggatgacacctatgagaggtgcttgcttgttaagggatggaaagctggggccagctggagctttcctcgtggaaagaggaataaagatgaggaagatcacacctgtgctgttagagaagttctggaggaaactgggtgtgatgtttctacgctattaaatttggatgattacattgaagtttcaattggacaacaaaaagttcggctctatatcataactggtgttaagagagatactgtgtttgcacctcaaacaaagaaggaaatcagtgaaatctcatggcacagaattgacgatcttttaccagctagtgatgatgcggtatctcgtgga

SEQ ID NO: 38840 - protein, 226 aa, Panicum virgatum
  misc_feature: Ceres CLONE 1995784
  misc_feature (21)..(105): Pfam Name: DCP2 Pfam Description: Dcp2, box A domain
  misc_feature (107)..(226): Pfam Name: NUDIX Pfam Description: NUDIX domain
MAMAGGGGLNRSSSRGQMPPQELLDDLCSRFLLNVPKEELESFERILFLLEQAHWFYEDNSVEHNPNLKSLSFKDFTSLMFKSCTALRPYIAHLDDIYKDFNNYKFRVPVSGAIILDDTYERCLLVKGWKAGASWSFPRGKRNKDEEDHTCAVREVLEETGCDVSTLLNLDDYIEVSIGQQKVRLYIITGVKRDTVFAPQTKKEISEISWHRIDDLLPASDDAVSR

SEQ ID NO: 38841 - DNA, 720 bp, Panicum virgatum
  misc_feature: Ceres CLONE 1995792
  misc_feature: Encodes the peptide sequence at SEQ ID NO. 38842
aaaatgctttgcctcctatacagctcatgtcagctgattttccggaagctccttctgtgattgatcctccaaatgatgataacatgtgggacatggatgaatatcattatgttcttgattcaaagcattttggatggaagcttaaaaaggaaagggttgttctatgtgaagatgtaagctttggcagggagaaagttccaattgtctgtgtcattgatgttgatgcaaaagattcttttagtatgaagcctgaagaacttctgccacatggcagttctgtgccttggcatggtttacactatatcacaaaacgcgtgatggattcgtctcttgttgattcagagaacactatgcctgggtgtgcatgttcttatactgaatgctcccctgagaaatgtggtcatgtgagtctctttgacagtgtttacaataacctggtggatatccatggaacaccaatgcatggcagatttgcatatgatgaagatagtaagattattttacaggaagggtatccaatatatgagtgcaattcatcatgtacttgtgattcatcctgcctgaataaagtattgcagagaggcctgcttgttaagttggaactctttagtactgagaataagggttgggctattagagctgctgaacctattccacagggcaccttcatctgcgagtatgttggcgaagtcctaaagactgatgaggccatgaaaaatg

SEQ ID NO: 38842 - protein, 239 aa, Panicum virgatum
  misc_feature: Ceres CLONE 1995792
  misc_feature (57)..(189): Pfam Name: Pre-SET Pfam Description: Pre-SET motif
  misc_feature: SWISSPROT Homolog: EC 2.1.1.43 Histone-lysine N-methyltransferase
NALPPIQLMSADFPEAPSVIDPPNDDNMWDMDEYHYVLDSKHFGWKLKKERVVLCEDVSFGREKVPIVCVIDVDAKDSFSMKPEELLPHGSSVPWHGLHYITKRVMDSSLVDSENTMPGCACSYTECSPEKCGHVSLFDSVYNNLVDIHGTPMHGRFAYDEDSKIILQEGYPIYECNSSCTCDSSCLNKVLQRGLLVKLELFSTENKGWAIRAAEPIPQGTFICEYVGEVLKTDEAMKN

SEQ ID NO: 38843 - DNA, 741 bp, Panicum virgatum
  misc_feature: Ceres CLONE 1995810
  misc_feature: Encodes the peptide sequence at SEQ ID NO. 38844
attcactcaccaagaagttgagcacccagagcttcagctcagctctcattcgtttcttccggcttcccatctgggcttaccactagtgatcgctagctagcgaacagctctctgaagttgtcgagctgagcactagctagcatctccctgaacgaagccagcgaccatgatctccccggacaccatccgcacggccattggcgtcatcggcaatgggactgctcttgtgctcttcctctccccagtgccgacgttcatccgcatctggaagaaggggtcggtggagcagtactcgccggtgccgtacgtggcgacgctcctcaactgcatgatgtgggtgctgtacgggctgccgctggtgcacccccacagcatgctcgtcatcaccatcaacggcaccggcatggccatcgagctcacctacgtcacgctcttcctcctctactccacgggggccgctcgccgcaaggtcgtcctactcctcgccaccgaggtcgccttcgtcggcgccgttgccgttcttgtgctcagcctggcgcacacgcacgagcgcaggtccatgatcgtcggcatcctctgcgtcctcttcggcaccggcatgtacgcggcgccgctctccatcatgaaaatggtgatccagacgaagagtgtggagtacatgcccctgttcctgtcccttgcttctctggtgaacggcatctgctggactgcctacgccctcatcaaattcgacctctacat

SEQ ID NO: 38844 - protein, 191 aa, Panicum virgatum
  misc_feature: Ceres CLONE 1995810
  misc_feature (9)..(98): Pfam Name: MtN3_slv Pfam Description: MtN3/saliva family
  misc_feature (132)..(190): Pfam Name: MtN3_slv Pfam Description: MtN3/saliva family
MISPDTIRTAIGVIGNGTALVLFLSPVPTFIRIWKKGSVEQYSPVPYVATLLNCMMWVLYGLPLVHPHSMLVITINGTGMAIELTYVTLFLLYSTGAARRKVVLLLATEVAFVGAVAVLVLSLAHTHERRSMIVGILCVLFGTGMYAAPLSIMKMVIQTKSVEYMPLFLSLASLVNGICWTAYALIKFDLY

SEQ ID NO: 38845 - DNA, 592 bp, Panicum virgatum
  misc_feature: Ceres CLONE 1995818
  misc_feature: Encodes the peptide sequence at SEQ ID NO. 38846
cccgtccaattcgatccgccatgaactcgctccagtccttcctcgccgtcgcgcccgtcgccgcctccgccgcgggcgcgggttcgggcgtgcggctcgccccgtcgtcgtcccgccgcgcccgcatctcggcctgcctcgccacgccgccgccgccgcccccgaccgccgcggcgcccgcgggggcggcgcggcgggagctgtcggcggcgagcctggcggttgtcgaggacgaggagcggtacctcatgggcacctacaaccgctcccgcgtcgtcatcgacggcaggcgcgggtgcaagctctacgacctcgacggccgcaagtacctcaacatggcctccggaatcgccgtcaccgagctcgggcacggcgaccccgacgtgaccaccaccatcacgcgccagtccgccaccctcatccacgccagcaacgtgcagtacaccaggccccaggaggcgctcgcaaagcagctcgtggaggcgtccttcgcggaccgcgccttcttcgccaactccggcaccgaagccaacgaggcggccatcaagttctcccgcaagttccagcgggtcgcgcaccccgacaccgacgc

SEQ ID NO: 38846 - protein, 190 aa, Panicum virgatum
  misc_feature: Ceres CLONE 1995818
  misc_feature: SWISSPROT Homolog: EC 2.6.1.11 Acetylornithine transaminase
MNSLQSFLAVAPVAASAAGAGSGVRLAPSSSRRARISACLATPPPPPPTAAAPAGAARRELSAASLAVVEDEERYLMGTYNRSRVVIDGRRGCKLYDLDGRKYLNMASGIAVTELGHGDPDVTTTITRQSATLIHASNVQYTRPQEALAKQLVEASFADRAFFANSGTEANEAAIKFSRKFQRVAHPDTD

SEQ ID NO: 38847 - DNA, 737 bp, Panicum virgatum
  misc_feature: Ceres CLONE 1995825
  misc_feature: Encodes the peptide sequence at SEQ ID NO. 38848
atcgctgagcccacccacttccactctaccgcccgcgcccgactccgcctgctcccctccccaaccccgccgcggcggagcgctaaaccctaggcgtcggcggcggcggcggaggagggggacgagccgcgatgtcgcacttcgggaggtcggggccgccggacatccgcgacaccttctcgctcctcgtcctcaacatcagcttccgcaccacggcggacgacctcttcccgctcttcgagcgctacggcaaggtcgtcgacgtcttcatcccgagggaccggaggaccggggactcgaggggtttcgcgttcgtgcggtacaagtacgctgacgaggcgcagaaggctatagagcgccttgacggcaaaaatgtggatgggaggaacatcatggtgcagtttgcaaagtacggccctaatgctgagccagtccgtaaaggaagggtcatagaggttgttgagaaaccacgagacaggtcaagaagccgtagtccaaggccaaggcacagagacaaagatcataggaggcgaagtcgcagcaggagcagagaaaggcatgggcgtgatagagacagggactatcgtcgccagagcagaagcagaagcagaagcagaagtagaaaccgaagtccgagttcaagtcctgaccgcaaaaatcatcgtagagcaagagatgatgataagcgcaggagcagggagcagagtaggagcaaaagcagaagcagaagcaggagt

SEQ ID NO: 38848 - protein, 201 aa, Panicum virgatum
  misc_feature: Ceres CLONE 1995825
  misc_feature (18)..(89): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSHFGRSGPPDIRDTFSLLVLNISFRTTADDLFPLFERYGKVVDVFIPRDRRTGDSRGFAFVRYKYADEAQKAIERLDGKNVDGRNIMVQFAKYGPNAEPVRKGRVIEVVEKPRDRSRSRSPRPRHRDKDHRRRSRSRSRERHGRDRDRDYRRQSRSRSRSRSRNRSPSSSPDRKNHRRARDDDKRRSREQSRSKSRSRSR

SEQ ID NO: 38849 - DNA, 753 bp, Panicum virgatum
  misc_feature: Ceres CLONE 1995829
  misc_feature: Encodes the peptide sequence at SEQ ID NO. 38850
agtacgccactagcgcagcagcggttggccaccacccgacgccggaggaggaggcggcggcgaggcgatggcggggaagcacggccgctacgacgacgacgacgtcaaccccttcgcgggaggaagtgttccaccagccaccaattctcggctctcacctctatcgcatgaaccagctgatttctacaatgtagatattcctcttgattcaacaaaggatctgaagaaaaaggagaaagagctccaggctatggaagctgagctaaacaagagagagagggaattgaaaaggaaggaagaggcggcatcccgagctggcattgtgatagaagagaaaaattggcctccctttttccctctcatccaccacaacatttccaatgagatacctatccatctacaaaggatgcagtatcttgcattttcgtcgtttttgggattgatagcatgcctattttttaatatcattgcaactacaacagcatggatcaaaggggaaggtgttatcatctggttgcttgccattatctacttcatatctggtgcacctggggcttatgtgttatggtatcgccctctttataatgcaatgagaactgagagtgctttgaagtttgggtggttttttctgttttacatgattcatattatcttctgtgtgtgggcagctgtggctcctccatttccttttaaaggaaaatcccctggctgggattttgccagcaatttgatgtcataaagcaagagtgctta

SEQ ID NO: 38850 - protein, 223 aa, Panicum virgatum
  misc_feature: Ceres CLONE 1995829
  misc_feature (88)..(223): Pfam Name: SCAMP Pfam Description: SCAMP family
  misc_feature: Useful for biocontainment applications
MAGKHGRYDDDDVNPFAGGSVPPATNSRLSPLSHEPADFYNVDIPLDSTKDLKKKEKELQAMEAELNKRERELKRKEEAASRAGIVIEEKNWPPFFPLIHHNISNEIPIHLQRMQYLAFSSFLGLIACLFFNIIATTTAWIKGEGVIIWLLAIIYFISGAPGAYVLWYRPLYNAMRTESALKFGWFFLFYMIHIIFCVWAAVAPPFPFKGKSPGWDFASNLMS

SEQ ID NO: 38851 - DNA, 601 bp, Panicum virgatum
  misc_feature: Ceres CLONE 1995835
  misc_feature: Encodes the peptide sequence at SEQ ID NO. 38852
ccagcaagaaatggcgacaagaatgaaagacaagtatgacaagtcattgggcgaattgccctcaaacttcacacgtgcaacctgataacggaaagggaaagggaaaggacaaggagaacgaaaatcttcacttgctcacttctgtcgctgctgtacttgatcctagatacaagctttcacagtatatacagatgataatccaagagatgtatggtgccggtgttagacagaaactttgggctgcaattaccaaatgcttggaacacctttttgaagaatataacaaaaatacttctccaagtgatgtgcagtcccaaccaagtcaatcgtccataactaaagaaagtcgagaggatggtggtaagttgaaggctaagctggccaagaagattacgctgaacagtggaacaagcagttccagcaggggcagcaggactgaactggatcggtacttggctgaagagtctgaacaacatagccaaaagtttgatattcttgcttggtggaaggggcagtccagtagatttcccatattgtctacattggcctgtgatgtgctccccattccaatatctacagttgctagtgaatcggcctttag

SEQ ID NO: 38852 - protein, 188 aa, Panicum virgatum
  misc_feature: Ceres CLONE 1995835
  misc_feature (135)..(188): Pfam Name: hATC Pfam Description: hAT family dimerisation domain
MTSHWANCPQTSHVQPDNGKGKGKDKENENLHLLTSVAAVLDPRYKLSQYIQMIIQEMYGAGVRQKLWAAITKCLEHLFEEYNKNTSPSDVQSQPSQSSITKESREDGGKLKAKLAKKITLNSGTSSSSRGSRTELDRYLAEESEQHSQKFDILAWWKGQSSRFPILSTLACDVLPIPISTVASESAF

SEQ ID NO: 38853 - DNA, 569 bp, Panicum virgatum
  misc_feature: Ceres CLONE 1995843
  misc_feature: Encodes the peptide sequence at SEQ ID NO. 38854
tcccgccacaccactggcacccaccccccacccagcaccaaattaggggccggatgaccaccaggcctgcagacgggggcgccgccgccgccgccgccgctgccgacaagcagctcgtccccgcctccaacggcaacgctctcgccgtccgcaaggccccctccaaggaccgccacagcaaggttgacggccggggccgccgcatccgcatgcccatcatctgcgccgcccgcgtcttccagctcacccgcgagctcggccacaagtccgacggccagaccatcgagtggctgctccgccaggccgagccctccatcatcgccgccaccggcaccggcaccaccccggcctccttctccacctcctcgccatcctccctccgctccacctcctcgcagaccacgcccttcgtcctcggcaagcgcgtccgcaacgacgccgacgccgagcccacagtcgccgcccccgcccctggattctgggcgctgccggcgcgggcagacttcggccagctctggagcttcgcggcagcgccggagatgatggtggccgccgccgccgccgcggct

SEQ ID NO: 38854 - protein, 171 aa, Panicum virgatum
  misc_feature: Ceres CLONE 1995843
  misc_feature (21)..(169): Pfam Name: TCP Pfam Description: TCP family transcription factor
  misc_feature: The sequence is a functional homolog of SEQ ID NO 1222 in the 11/479,226 US patent application
  misc_feature: The sequence is a functional homolog of SEQ ID NO 136 in the 10/225,068 US patent application
  misc_feature: The sequence is a functional homolog of SEQ ID NO 162 in the 10/374,780 US patent application
  misc_feature: The sequence is a functional homolog of SEQ ID NO 550 in the 10/412,699 US patent application
  misc_feature: The sequence is a functional homolog of SEQ ID NO 970 in the 10/225,066 US patent application
  misc_feature: The sequence is a functional homolog of SEQ ID NO 1229 in the 11/479,226 US patent application
  misc_feature: The sequence is a functional homolog of SEQ ID NO 226 in the 10/225,066 US patent application
  misc_feature: The sequence is a functional homolog of SEQ ID NO 2424 in the 10/374,780 US patent application
  misc_feature: The sequence is a functional homolog of SEQ ID NO 316 in the 10/666,642 US patent application
MTTRPADGGAAAAAAAADKQLVPASNGNALAVRKAPSKDRHSKVDGRGRRIRMPIICAARVFQLTRELGHKSDGQTIEWLLRQAEPSIIAATGTGTTPASFSTSSPSSLRSTSSQTTPFVLGKRVRNDADAEPTVAAPAPGFWALPARADFGQLWSFAAAPEMMVAAAAAA

SEQ ID NO: 38855 - DNA, 672 bp, Panicum virgatum
  misc_feature: Ceres CLONE 1995849
  misc_feature: Encodes the peptide sequence at SEQ ID NO. 38856
ccctcgcgctcccgcaaccggcacccgctcttgtggcaatgtcgccagccgccgccgccgcctccttcgccgccgcagccgccgtggcagcgcccaccgccccgtttcgcgcccgcgtcctacttccgctccgcgggggccccggtgcccctcgccgcgccgtcgcctcgatggccgtttccaccccgaggtccgccgccgccgcctcgttcctcgagcgccgcgagtccgagcgcgccctccacttcgtcaagtaccagggcctgggaaacgacttcatcatggtggacaatcgggattcgtctgtgccgaaggtgactcctgaggaagcggcgaagctgtgcgaccggaacttcggcattggcgccgacggcgtcatcttcgtcatgccagggtccaatggcgcggactacaccatgaggatcttcaactccgacggcagcgagccggagatgtgtggtaatggagtccgttgctttgctcggtttatagctgagcttgaaaacctgcagggaacacatagcttcacgattcatactggtgctggattgatcattcctgaaatacaaagtgatgggcaggtaaaggttgatatgggtgagcccatcctttctggaccagagatccccacaaaactgctagctaccaagaacaaagctgttgtccaagctg

SEQ ID NO: 38856 - protein, 211 aa, Panicum virgatum
  misc_feature: Ceres CLONE 1995849
  misc_feature (70)..(192): Pfam Name: DAP_epimerase Pfam Description: Diaminopimelate epimerase
  misc_feature: SWISSPROT Homolog: EC 5.1.1.7 Diaminopimelate epimerase
MSPAAAAASFAAAAAVAAPTAPFRARVLLPLRGGPGAPRRAVASMAVSTPRSAAAASFLERRESERALHFVKYQGLGNDFIMVDNRDSSVPKVTPEEAAKLCDRNFGIGADGVIFVMPGSNGADYTMRIFNSDGSEPEMCGNGVRCFARFIAELENLQGTHSFTIHTGAGLIIPEIQSDGQVKVDMGEPILSGPEIPTKLLATKNKAVVQA

SEQ ID NO: 38857 - DNA, 722 bp, Panicum virgatum
  misc_feature: Ceres CLONE 1995860
  misc_feature: Encodes the peptide sequence at SEQ ID NO. 38858
accgcctccctctcattgcattgcgcccattcatccccgccggcagggcagcggcgcaagaagacgatgaagctctccgtgcagtccctggccaggaagctctccctcccgtccccgaagcggtcgtggagtagcggcggcagcaagaaggacggcagcgggaagcgctccctgtcgcgcagcgaggcgccgtccttcgcgtccgcgtcctcgtcctcctccgacgacgcgctggcgcggtcctccacgccgcggtccgtgctgccgctctcccccgccgagatcccgcggcgggagctggaggccgtgctgcggcgcctcggccacggggagccctccgacgacgagctggacgccgtggccgccatggccgcgcagccgcccgcccccggcggggaggacgacctcatggaggccttccgggtgttcgacgccgacggcgacggccgcatcaccgccgaggagctccgcgccttcatggaggccatcctcggcgccgagggctgcagcctcgacgactgccgccgcatgatcggcggcgtcgacgccgacggcgacggcttcgtcggcttccaggacttcgcgcgcatgatgatgaacgcggccgacgccccagcgacaaccttcttgtgatccctcgtcgcctgagcagagagagaatggccctgatgcgcgctcagatcagagtatccttttgggcgcgcaggatgataggctgcttc

SEQ ID NO: 38858 - protein, 188 aa, Panicum virgatum
  misc_feature: Ceres CLONE 1995860
  misc_feature (113)..(141): Pfam Name: efhand Pfam Description: EF hand
  misc_feature (151)..(179): Pfam Name: efhand Pfam Description: EF hand
MKLSVQSLARKLSLPSPKRSWSSGGSKKDGSGKRSLSRSEAPSFASASSSSSDDALARSSTPRSVLPLSPAEIPRRELEAVLRRLGHGEPSDDELDAVAAMAAQPPAPGGEDDLMEAFRVFDADGDGRITAEELRAFMEAILGAEGCSLDDCRRMIGGVDADGDGFVGFQDFARMMMNAADAPATTFL

SEQ ID NO: 38859 - DNA, 720 bp, Panicum virgatum
  misc_feature: Ceres CLONE 1995874
  misc_feature: Encodes the peptide sequence at SEQ ID NO. 38860
atcatctccaccgcacccttcctcctccccacctcccccgccgcctccagaaccctagccccgacccccaccctcgccccgctccgcctcgtctgccgcttcgccgccatggccgccggcgccgccgaggagttcgtcaagggccgcgtcttccccaacggcgtcgccgtcatcacgctcgaccgccccaaggccctcaacgccatgaacctcgaaatggacattagatacaaggcacttcttgatgaatgggaaacaaatccaagtgtcaagtgtattcttgtggaaagcagctctccccgtgccttctcagctgggatggatattaagggtgttgccgcagaaatacagaaggacaaaaacacaccacttgtgcaaaaggttttcacagcagaatactcgttgatttgcaagatacatgagtatgcaaaaccttatatctgcttgatggatggagtgacgatgggatttggaattggtctgtcaggacacggccgctaccgtattattactgagaagacactcctagccatgcctgaaaatggtattggcctgttcccagatgttggctttgcttacattggtgcaaaagccccaggagggggtgcagttggagcttaccttgggattacgggaaaaaggatatcatcacctgctgatgctatattcataggccttggtactcactatgtaccttctgggagtttggggtctctgaag

SEQ ID NO: 38860 - protein, 203 aa, Panicum virgatum
  misc_feature: Ceres CLONE 1995874
  misc_feature (20)..(196): Pfam Name: ECH Pfam Description: Enoyl-CoA hydratase/isomerase family
  misc_feature: SWISSPROT Homolog: EC 3.1.2.4 3-hydroxyisobutyryl-CoA hydrolase
MAAGAAEEFVKGRVFPNGVAVITLDRPKALNAMNLEMDIRYKALLDEWETNPSVKCILVESSSPRAFSAGMDIKGVAAEIQKDKNTPLVQKVFTAEYSLICKIHEYAKPYICLMDGVTMGFGIGLSGHGRYRIITEKTLLAMPENGIGLFPDVGFAYIGAKAPGGGAVGAYLGITGKRISSPADAIFIGLGTHYVPSGSLGSL

SEQ ID NO: 38861 - DNA, 624 bp, Panicum virgatum
  misc_feature: Ceres CLONE 1995889
  misc_feature: Encodes the peptide sequence at SEQ ID NO. 38862
atactcccgaaaacctcacaaaaccctcgctccccaccacccgccgccgcccgcgccgccgcctccacctgccgcgacaaagatgagtcggcaccctgaagtgaagtgggctcagaggattgacaaggtttacatcacagtacagttatctgatgcaaaggatgctaaggtcaatttggagccagatggtgtcttcacattctctggcagtgctggtacaaacttgtatgaattgaaactagatctgaatgacaaagtcaacgtggaggctagcaagataagtgtgggtgacaggtccatattctgtgtcgtagaaaaagctgaagccaaatggtggaagaagcttgttcgggatgatcaaaaggcacctcactttgtgaaagtcgattgggacaaatgggtggatgaagatgatgatggtggtgatgtcaacttggatgggatggacttctcgaattttggtggcatgggcggtatgggcggcatgggtgatatggctggtctgggcggcatgggtggtatgggtggtctgggcggcatgggtggtgtgggtggtctgggcggcatgggtggtatgggtggtctgggcagcatgggtggtatgggaatggatgagtttgaaaa

SEQ ID NO: 38862 - protein, 180 aa, Panicum virgatum
  misc_feature: Ceres CLONE 1995889
  misc_feature (5)..(79): Pfam Name: CS Pfam Description: CS domain
  misc_feature: SWISSPROT Homolog: EC 5.3.99.3 Prostaglandin-E synthase
MSRHPEVKWAQRIDKVYITVQLSDAKDAKVNLEPDGVFTFSGSAGTNLYELKLDLNDKVNVEASKISVGDRSIFCVVEKAEAKWWKKLVRDDQKAPHFVKVDWDKWVDEDDDGGDVNLDGMDFSNFGGMGGMGGMGDMAGLGGMGGMGGLGGMGGVGGLGGMGGMGGLGSMGGMGMDEFE

SEQ ID NO: 38863 - DNA, 760 bp, Panicum virgatum
  misc_feature: Ceres CLONE 1995901
  misc_feature: Encodes the peptide sequence at SEQ ID NO. 38864
cacagtataagattgccaaagaacagcactgttggcgatgtgctaaatgatatcaaatcaaaggttgagttgtcgcatcctaatgctgagctaagattacttgaggtcttctatcacaagatatacaaggtttttgcaccaagtgaaaaaatagaaaacattaatgatcagtactggacattgcgtgcagaggaggttccagaggaggagaaaaaccttggtccctttgaccgcttgattcatgtatatcattttacaaaagatactcaaaaccaaacgcaagttcagaacttcggagagccattttttatggttattcgtgaggacgaatccctatcttctataaaggaacgtatacagaaaaagcttaaggttccagatgaggatttctcaaagtggaaatttgcatacatttcacttggccgtccagactattttgaagattcagatattgtggctacaaaatttcagagaaacatgtatggagcttgggagcagtatcttggactggaacatccagacacagctcctaggaaggcacacacggttaatcagaaccggcattcatttgagagacctgtaaaaatttataactaggcaagttaggaatttgaatgatgagccactacccaataccaagcaagggctgaaatttctggcttgaaataaagtgtgccatagtcggggggcgtgttgctcaggttttcagagctgttgagctagtttcagaggaaggctttttcagtatgatcgggggcac

SEQ ID NO: 38864 - protein, 198 aa, Panicum virgatum
  misc_feature: Ceres CLONE 1995901
  misc_feature: SWISSPROT Homolog: EC 3.1.2.15 Ubiquitin thiolesterase
HSIRLPKNSTVGDVLNDIKSKVELSHPNAELRLLEVFYHKIYKVFAPSEKIENINDQYWTLRAEEVPEEEKNLGPFDRLIHVYHFTKDTQNQTQVQNFGEPFFMVIREDESLSSIKERIQKKLKVPDEDFSKWKFAYISLGRPDYFEDSDIVATKFQRNMYGAWEQYLGLEHPDTAPRKAHTVNQNRHSFERPVKIYN

SEQ ID NO: 38865 - DNA, 713 bp, Panicum virgatum
  misc_feature: Ceres CLONE 1995905
  misc_feature: Encodes the peptide sequence at SEQ ID NO. 38866
aacccctgctctgcctccgccaccgcctcctccgctccggctaggcgcctagctaccgctcctaccgccgccgccgcgctcggagccggaggagcgctcgccgccggttcccatggccgacaaggagaacgccgccgccgccccgccgcgcctcacccgcgcccaggccaagcgcgccgccgccgtcacggccgtcgccgtcgccgtcgccgccaagcgcaagcgcgtcgcgctcaccgagctgcctgcgctccccaacgccgcgcacgacgacgatgactaccgcgccaagcccgccaggaagcagcgcctcctcgagcccgagcccaagcccagggccgcgcccgcgcccaaggcggctcctcctcccgccgccgccgacgccgacggcgaggagggggacccgcagctctgcgcgccctacgcctctgacatctacttttacctccgctccatggaggcgcaggcaaagcgccgccccgcgaccgactacattgccgccgtgcagttcgacgtcacgcccaacatgcgctccatcctcgtcgactggctcgtcgaggttgccgaggagtacaagctcgtctccgacacgctctacctcaccatctcctacgtcgaccgcttcctctccgtcagggcgctcaacagacagaggctgcagctcctcggcgtctccgccatgctcatcgcctccaagtatgaggagatcagcc

SEQ ID NO: 38866 - protein, 200 aa, Panicum virgatum
  misc_feature: Ceres CLONE 1995905
  misc_feature (107)..(200): Pfam Name: Cyclin_N Pfam Description: Cyclin, N-terminal domain
  misc_feature: Useful for making plants with modulated nitrogen use efficiency
MADKENAAAAPPRLTRAQAKRAAAVTAVAVAVAAKRKRVALTELPALPNAAHDDDDYRAKPARKQRLLEPEPKPRAAPAPKAAPPPAAADADGEEGDPQLCAPYASDIYFYLRSMEAQAKRRPATDYIAAVQFDVTPNMRSILVDWLVEVAEEYKLVSDTLYLTISYVDRFLSVRALNRQRLQLLGVSAMLIASKYEEIS

SEQ ID NO: 38867 - DNA, 682 bp, Panicum virgatum
  misc_feature: Ceres CLONE 1995918
  misc_feature: Encodes the peptide sequence at SEQ ID NO. 38868
ccccccctcgcgattttctatcctcgccgctggctgcctctgccgccccctcccgctcgatcgagatctccacctctaccgagatccattgcgccgcggccgccgagcgccgctgccgagatccgctacctcagcgcggggaggcggagcccggcagcacgaccgcagaaacggagcacccgcgtcgccctcagagctgagagtagggggggggggatccaatccgccttcctccacctcgtcttcttcgccgggccggcggcaagggcgcaaccccgcgatcaatcctacaatggcggcgcccgtgtccgccctggagtccgcttggcagctcctgatcgccaacttcaccgagttccaactcgccaccgtcgtcaccttcctgctccacgagaccgccttcttcctctccggcctcccctccctccttttcgagcggttcggcctcttcgccaagtacaagatccagaagaagagcaacacctctgcttatcaaaacagatgcgtcctgcggctcattctctaccatgtctgtgtgaacttgcctgtcatgattttctcctaccctgccttcaaattcatgggccttaggagctctcttcctcttccacactggacggttgttgtatctcaagttcttttctactttgtactcgaggattttatattctactgggggcac

SEQ ID NO: 38868 - protein, 129 aa, Panicum virgatum
  misc_feature: Ceres CLONE 1995918
  misc_feature: SWISSPROT Homolog: EC 1.14.13.72 Methylsterol monooxygenase
  misc_feature: Useful for making plants with modulated cold sensitivity
  misc_feature: Useful for making plants with altered sterol content
MAAPVSALESAWQLLIANFTEFQLATVVTFLLHETAFFLSGLPSLLFERFGLFAKYKIQKKSNTSAYQNRCVLRLILYHVCVNLPVMIFSYPAFKFMGLRSSLPLPHWTVVVSQVLFYFVLEDFIFYWG

SEQ ID NO: 38869 - DNA, 651 bp, Panicum virgatum
  misc_feature: Ceres CLONE 1995942
  misc_feature: Encodes the peptide sequence at SEQ ID NO. 38870
aaaaaaaaaaaaacactcccggtaggttccggaggttcgggggctccggaaaggcaggcggatagcaagcgtatggccggccacttcttcctcaacaccggccccaaaatcccggcggtcgggctcggcacctggcaggccaacccccccgtcttcggcaaccccttctaccccgctgtcaaggcaggttataggcacttcaactgtgctcaaccatacaacaacaaaaaaaaggtcgaattgggtctcaaaaaacccctcaataagggcatattcaaccttgaggatctcttcttcacctccaacctctggaacaccaaccatgccccaaagaactttccatttgccctggacggcaccctaaaacccttgcaaacggactacttgaatctttacctcttccattggccggtaaccataaaaaaaggccctggttatggcccgcaaagcattatcccgtcaaatatcccggcaacctgggcggcaatgaaaaacctgtacaaccccggcaaggcccgccccatcggcttcaccaacttctcaagcaaaaacctggcgaacctgctcgctgtggcgcgcgtgcccccggccgtcaaccagttgaagtgccaccccgtgtggcagcaggccaagctccgcgccttctgccag

SEQ ID NO: 38870 - protein, 192 aa, Panicum virgatum
  misc_feature: Ceres CLONE 1995942
  misc_feature (7)..(192): Pfam Name: Aldo_ket_red Pfam Description: Aldo/keto reductase family
  misc_feature: SWISSPROT Homolog: EC 1.1.1.21 Aldehyde reductase
MAGHFFLNTGPKIPAVGLGTWQANPPVFGNPFYPAVKAGYRHFNCAQPYNNKKKVELGLKKPLNKGIFNLEDLFFTSNLWNTNHAPKNFPFALDGTLKPLQTDYLNLYLFHWPVTIKKGPGYGPQSIIPSNIPATWAAMKNLYNPGKARPIGFTNFSSKNLANLLAVARVPPAVNQLKCHPVWQQAKLRAFC

SEQ ID NO: 38871 - DNA, 646 bp, Panicum virgatum
  misc_feature: Ceres CLONE 1995950
  misc_feature: Encodes the peptide sequence at SEQ ID NO. 38872
acagcccgacccaactagcccacggtaatagttgcaatcgaaccctcgctccgactccgttgcctggggcctccgcctccgccgccgccgccgccgccgccgccgctacaggcgaaggtgtttttctgcacaatggatgtggagccaagccccttgattgtgtccccagctagggattggtctgagcttccactcgatgccctttccacaattttcatgaagcttgggaccattgagatcttgatgggcgcaggccttgtgtgccgctcctggttggtggctgcgaaatcaccagaactgtggcgcttcgtggatatgacaaaccatcagatggttttcccaatgaacggtgggccagagaccttgtgtgcaatggccaaagtggccatagatcgctctgatggacgaatggagtcattcagggctcagatgtttgttacaagcgaactcttggattacattgtgagcagggccaattcattgaagagcatacaactaactaattgcttgtttctttggacccacaaattgggtaggtttgcatctaaatgcccccttctggaggagatagagttctcttaccaaaaaatgctacctgaacttatcaggcatattggtagcgtgcacccaaatctgaagtgtctaa

SEQ ID NO: 38872 - protein, 171 aa, Panicum virgatum
  misc_feature: Ceres CLONE 1995950
  misc_feature (14)..(62): Pfam Name: F-box Pfam Description: F-box domain
MDVEPSPLIVSPARDWSELPLDALSTIFMKLGTIEILMGAGLVCRSWLVAAKSPELWRFVDMTNHQMVFPMNGGPETLCAMAKVAIDRSDGRMESFRAQMFVTSELLDYIVSRANSLKSIQLTNCLFLWTHKLGRFASKCPLLEEIEFSYQKMLPELIRHIGSVHPNLKCL

SEQ ID NO: 38873 - DNA, 1375 bp, Panicum virgatum
  misc_feature: Ceres CLONE 1995969
  misc_feature: Encodes the peptide sequence at SEQ ID NO. 38874
gcgcatcgcttgattcgcttgatttgggggcgttttccattttttcctcgcgacgctgcctcccccgccatcgcgccgcccccgcggcaccacgcgacgccgcctcccccgacgtcgcgtctcctccgccgacctcctcgcgacgccgcctccccgcccgtagcgccgcctcccccgccatcgcgccgcccccgcggcaccacgcgacgccgcctcccccgacgtcgcgtctcctccgccgaccgccgcattccgccgaccacgaggtcgactgcgactgcgacaagcccaaggcgcccaagccgtcgcacccgcccaagaccaaaccctcccacccgtcgcccaagcccaagaaccccaagccgcccaagggcccctcctacccgtcgccggcgatgcgcccgcccaagggccgcccctccaacccgccgatcactcgtcctcgtccgccggtcgtcggcccccccaagggccccgtcacgcgcccgccggtcgtggggccaccggtcacgcgcccgccggtcacacgtccgccggtcgtcatcagcccgccggtgacctacccaccaccgattactggccctccgacgacgacgccaccggtcacggtccccccgatcaccggcccaccggtcacggtccccccgattaccggcccgccctcgacgacgcctccggtcaccggcccgcccttgacgaaccctcccggcggtggaagctcgacgccgtgcccgccgcctcctcccgcgaccccgactccaacgccgtcgtcgccgacgtgcccggcggactcgctgaagctgggcgcgtgcgtggacctgctgggcgggctggtgcacgtcgggctcggcgaccccgtggtgaacaagtgctgcccgctgctggagggcctggtggagctggaggcggccgtgtgcctctgcaccaccatcaagctcaagctcctcaacatcaacatctacctgcccctggcgctccagctcctcatcacctgcggcaagacgccgccgcccggctacacctgcaccgtctgatcgatcaatgcaactagctagtaacccttgcacagtacgtcactacgcataatctctctgatctgcaagttcatgcaagggacatacagcatggtagcctgactctgactggatcgatctgtttggacgtgcagagcaggggttttggagtgagtttcttctgtaatttgaagagagatcaaccgacatgagaggatgtcattgtctgcttcttcctagctatggtagctgtgtttagttgtttttctgttgtggttcgatcgatctcaagttctcaaccggcctgttaagtcgtttcagactttcagttaaattggctggccctcggcagcttgattgtc

SEQ ID NO: 38874 - protein, 343 aa, Panicum virgatum
  misc_feature: Ceres CLONE 1995969
  misc_feature (260)..(341): Pfam Name: Tryp_alpha_amyl Pfam Description: Protease inhibitor/seed storage/LTP family
  misc_feature: Useful for making plants with modulated heat sensitivity
ASLDSLDLGAFSIFSSRRCLPRHRAAPAAPRDAASPDVASPPPTSSRRRLPARSAASPAIAPPPRHHATPPPPTSRLLRRPPHSADHEVDCDCDKPKAPKPSHPPKTKPSHPSPKPKNPKPPKGPSYPSPAMRPPKGRPSNPPITRPRPPVVGPPKGPVTRPPVVGPPVTRPPVTRPPVVISPPVTYPPPITGPPTTTPPVTVPPITGPPVTVPPITGPPSTTPPVTGPPLTNPPGGGSSTPCPPPPPATPTPTPSSPTCPADSLKLGACVDLLGGLVHVGLGDPVVNKCCPLLEGLVELEAAVCLCTTIKLKLLNINIYLPLALQLLITCGKTPPPGYTCTV

SEQ ID NO: 38875 - DNA, 688 bp, Panicum virgatum
  misc_feature: Ceres CLONE 1995971
  misc_feature: Encodes the peptide sequence at SEQ ID NO. 38876
actaaaaaaactgcctctccaactaggccagaattagcatgcactaagatctctctccctctctccattcctcaccggcggcatcgatgacgacgattatgcgatcttacacagccgcagtgagccggtcgtcgccggttctgccggcttcctctctagtcacagcccgtggttcatggaagcccgcagtggcggcattccgaccttgtgccggcgttaagtgccggcgaacacttaccgtgacctgcgcgctcccggagaaagaacggccgccggcgttcagcatcccgcccaccgctctgctgtgccccgtgccgccgccgggcgggaaggagcggtgggacatcaaggaggaggaggaccgcgtcacgctgtggctccaggtgcccgggctgtcggcgagcgacatcgaggtgaccaccggcgaggacgtcctggagatcaagcggaaggtcgcagcccagcagcccgcggcgcccgtggacgcgcacggcgtgggcgcgttccacatccggctgctcatgaccaaggagtatgacggggccagggtcacggccgacctcaaggccggcatgctggaggtcaccgtccccaagaaccttcaacgcgagggtgaacgcgtcgagctggggaagcctgcgccccggggaaaagagggcacgaacaccaagaaaggctcggaggacgc

SEQ ID NO: 38876 - protein, 200 aa, Panicum virgatum
  misc_feature: Ceres CLONE 1995971
  misc_feature (86)..(182): Pfam Name: HSP20 Pfam Description: Hsp20/alpha crystallin family
MTTIMRSYTAAVSRSSPVLPASSLVTARGSWKPAVAAFRPCAGVKCRRTLTVTCALPEKERPPAFSIPPTALLCPVPPPGGKERWDIKEEEDRVTLWLQVPGLSASDIEVTTGEDVLEIKRKVAAQQPAAPVDAHGVGAFHIRLLMTKEYDGARVTADLKAGMLEVTVPKNLQREGERVELGKPAPRGKEGTNTKKGSED

SEQ ID NO: 38877 - DNA, 1120 bp, Panicum virgatum
  misc_feature: Ceres CLONE 1995972
  misc_feature: Encodes the peptide sequence at SEQ ID NO. 38878
aaaagcgcaagcggcaaccgcaggcagcgccgcgcaggcgtgagaggggggagaaaaggaggaagcggccaaggggaagcgagggaggccggggcggcggcgtgcgtcagatggggaagtacatgcgcaagtgcaggggggccgcgggcgaggaggtcgccggcgtcgaggtcacgcaggtcgtcggcgtccggacgaggtcgcggaccgcggcggcgcctgcgccgccggccggcggggtcgccaaggtcgccccgaggaggaagaaggcgctggcgctgccgaacgtggcggagggggagcctgccgctggcggtgacggcggaagctgctacatcaagctgcggagccggacgctgttcaaggcgccgcctcagcagccttcggcgccgagggttccggtgccggcggaggctgctggtaccggccatggtgcggcggcgctagtggccgggctgtcgcgttgctccagcacggcgtcgtccctggacgtcgagtgtcaggacaggagccttgcctgccgctccgacgccgcggaggcaggcggggatcacaacatggaggtctcggcgagcaactcggggagcggcccggagcgcgagaggagagagacgacgccatcgagccgggcgcacggcgaggtgagcgatctggagtcggatctggcgggccagaagaacaacggccagtcgtcgcccgcgacaacgtcggctccccagctgatcacgccaccggcggacgagatcaaggccttcttcgcggcggccgagaaggcgcaggccgaacgcttcgctgccaagtacaacttcgacgtcgtccgcggcgtgcccctcgacggcggccggttcgagtggaccccggtggtcagcatctgaagcgagcgtgcagtacaaaggatcatcggaaactagaaagaggaggagaaaaagatgccctgaaaaaaataaggggaaaggagaaaccaaagaagaagcatcatagcctaaccaccattcaactgtttttcgtccatgccttactttttcctgaagtagcttgtacaagagtcgcatcgatcagtagtgtttactgtttattcagagaggttaccttgacccctatagaatcatccgctcactgc

SEQ ID NO: 38878 - protein, 254 aa, Panicum virgatum
  misc_feature: Ceres CLONE 1995972
  misc_feature (202)..(252): Pfam Name: CDI Pfam Description: Cyclin-dependent kinase inhibitor
  misc_feature: The sequence is a functional homolog of SEQ ID NO 2 in US patent 7256280
MGKYMRKCRGAAGEEVAGVEVTQVVGVRTRSRTAAAPAPPAGGVAKVAPRRKKALALPNVAEGEPAAGGDGGSCYIKLRSRTLFKAPPQQPSAPRVPVPAEAAGTGHGAAALVAGLSRCSSTASSLDVECQDRSLACRSDAAEAGGDHNMEVSASNSGSGPERERRETTPSSRAHGEVSDLESDLAGQKNNGQSSPATTSAPQLITPPADEIKAFFAAAEKAQAERFAAKYNFDVVRGVPLDGGRFEWTPVVSI

SEQ ID NO: 38879 - DNA, 1326 bp, Panicum virgatum
  misc_feature: Ceres CLONE 1995976
  misc_feature: Encodes the peptide sequence at SEQ ID NO. 38880
gagaggaggggacagagaggcagggaggtgtgtgggagtaggtgtgttgtggagtcgagcgggatggcgtccggcgcgtcgtcgtctcccccgctgccggtgctctcgctcgccgcggtcgtcgtcgtcctcctcctcctcgcggcgcgcggcggggccacgccgccgcacccgctccgcggcgtgcgcccgctcgccttcgacgaggggtacgcccagatcttcggcagcagcaacctcgcgctcctccgcgacggccgccgcgtccgcctcgccctcgacgagtccaccggcgccgggttcgcgtcgcaggacctgttcctccacggcttcttcagcgccgccatcaagctgcccgccgactacgccgcgggcgtcgtcgtcgcgttctacctgtcgaacggcgacgtgtacgagaagacccacgacgagctggacttcgagttcctgggcaacgtgcgggggcgcgagtggcgggtgcagaccaacgtctacggcaacggcagcacccacgccggccgggaggagcgctacgacctccccttcgaccccaccgacgacttccaccactactccatcctctggaccagccaacgcatcatattctacgtggacgagaccccgatccgggaggtggtgcggacggcggccatgggcgcggcgttcccgtccaagcccatgtctttgtacgccaccatctgggacggctccacctgggccacgctgggcggccggtaccgcgtcaactaccggtacgcgccgtttgtggccgagttcgccgacctcgtcatccggggctgcgccggcgaccccgccgagcgcgacccccactcggcggccgcggcggcgtgcgaggcgcgcgccgggctggaggccctcgccgtgcccgcggagcggcgcgcggccatggcggcgttccggcgcgcccacacctcctactcctactgccacgaccggcggcggtaccccgtggccctggcggagtgcggcgcggcggcgctcctcccgggccgcatgttcggccccgacggcatgaggcaacacggccggcgcgcccgccgcggcggtcgccgcgtcggcgcccaggacgacgccatgtgatggatcgatcgatctcccggctcaatctccgattcttaaggctggctgtataaaggcggagctgggcaggcggcgggcgggcgggcgtgattgcttgcggtgggattgggattggagcgagtcgtcttcctcggcttgcgttgtggttgtacggtacccccggcctgctctctgcccccattcgccattagagtagctctcgtgtttattgccgcgctggaccat

SEQ ID NO: 38880 - protein, 345 aa, Panicum virgatum
  misc_feature: Ceres CLONE 1995976
  misc_feature (46)..(231): Pfam Name: Glyco_hydro_16 Pfam Description: Glycosyl hydrolases family 16
  misc_feature (263)..(308): Pfam Name: XET_C Pfam Description: Xyloglucan endo-transglycosylase (XET) C-terminus
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MASGASSSPPLPVLSLAAVVVVLLLLAARGGATPPHPLRGVRPLAFDEGYAQIFGSSNLALLRDGRRVRLALDESTGAGFASQDLFLHGFFSAAIKLPADYAAGVVVAFYLSNGDVYEKTHDELDFEFLGNVRGREWRVQTNVYGNGSTHAGREERYDLPFDPTDDFHHYSILWTSQRIIFYVDETPIREVVRTAAMGAAFPSKPMSLYATIWDGSTWATLGGRYRVNYRYAPFVAEFADLVIRGCAGDPAERDPHSAAAAACEARAGLEALAVPAERRAAMAAFRRAHTSYSYCHDRRRYPVALAECGAAALLPGRMFGPDGMRQHGRRARRGGRRVGAQDDAM

SEQ ID NO: 38881 - DNA, 1330 bp, Panicum virgatum
  misc_feature: Ceres CLONE 1995980
  misc_feature: Encodes the peptide sequence at SEQ ID NO. 38882
aacccctcgcgcgcggccaccaggaggcggaaggaatcggaggtggtccggcggcctctttctcggagcgggtttgacacatttggagctgacctttctgacatctaaagatgagtgcaggacacggcgacgctggggcttcagcaatgatgacaaagctgaaggatttattgcacagaagtgaaaatcgcatttgcgctgactgcagtgcgcctgatcccaaatgggcgtcagctaacattggggtattcatctgtgtaaagtgttctggcgtccacagaagtcttggtacacatatttcaaaggttctgtcagtaacactagataagtggactgaaaatgaagttgaatcaatgatagaagttggtgggaattctaatgccaatgcaatatatgaggcttttctgccagagggctaccagaagccacatccagattctagcccggaagagcgagaaaaattcatcaggtcaaaatatgagctacaggaatttctgaagccaagcctgcggattgtctcgcatcagactagtgactccggaaaacatgcaggcagtgcttctcattctgatggttccaagagtgaaataggcatgatcgaattcatcggaatattgaatgtcaaggtgataggaggcaccaacctggccatcagagatatgtcaagcagtgacccatatgtcgtcctaacgcttgggcgccaaaaagcccaaacttcagtaatcaaaggcaacctaaatcctgtctggaatgaagaactgaagctctctgttcctcggcaatatggacctctgaagctgcaagtgttcgatcatgacatggtgtccaaggacgacctcatgggggaggccgagatcgacctgcagacgatgatcaacgccgctgccgcgttcggtgatccagagctgctgggcgacatacagatcggccggtggctcaagtccgacgacaatgctcttgtcagggacaatgccgtggtggtcgccggcggcaaggtgaagcagggggtggcgctgaagctgcaacacaccgagtccggggagctggagctggaaatggagtggatgccgctcaacatgtagaacttgccattttattttcttaaataaaattatctggcatattggcagatgatgaatgttgttgtgaaaaaaagataaaacgttgttgtactcagaggattgtactcagcagtgttcgatcagtcacataaacgctgtactcagatggagatgattccacatgctttatggccatcccactgctgagtttgatcagtctgtcacagtggttccgcaagttcttggaaaacaaagctgctcttcttcgc

SEQ ID NO: 38882 - protein, 323 aa, Panicum virgatum
  misc_feature: Ceres CLONE 1995980
  misc_feature (15)..(136): Pfam Name: ArfGap Pfam Description: Putative GTPase activating protein for Arf
  misc_feature (169)..(248): Pfam Name: C2 Pfam Description: C2 domain
  misc_feature: SWISSPROT Homolog: EC 3.1.1.4 Phospholipase A(2)
MSAGHGDAGASAMMTKLKDLLHRSENRICADCSAPDPKWASANIGVFICVKCSGVHRSLGTHISKVLSVTLDKWTENEVESMIEVGGNSNANAIYEAFLPEGYQKPHPDSSPEEREKFIRSKYELQEFLKPSLRIVSHQTSDSGKHAGSASHSDGSKSEIGMIEFIGILNVKVIGGTNLAIRDMSSSDPYVVLTLGRQKAQTSVIKGNLNPVWNEELKLSVPRQYGPLKLQVFDHDMVSKDDLMGEAEIDLQTMINAAAAFGDPELLGDIQIGRWLKSDDNALVRDNAVVVAGGKVKQGVALKLQHTESGELELEMEWMPLNM

SEQ ID NO: 38883 - DNA, 716 bp, Panicum virgatum
  misc_feature: Ceres CLONE 1995990
  misc_feature: Encodes the peptide sequence at SEQ ID NO. 38884
attcgcgagctacacaaccaggaaccggcccgagacagacgccacaccacttgcgtaccaggctttcaaaatccggtcatccaccgggacccggcagagaggcgtgcaaggttccttcctcgccggggattaaattagccgccggcggagctcgatcgatccagcttccgcggagagccggcagctcttcttcttggtcccgattctcgcttgcgacttttgtggcgcgccggtgaggaagagagagcgagggcgatcgagcaaacatggcggcggccacttccgcttctaccatgtccctgctcccgatctcccagctgaagcagcagcaccacggcgccggcgccgtggtcgtgttccggcggcggccccgggacgcgcggcggaggcgatacgtcgtgccgacggcgaggctgttcgggccggcgatcttcgaggcgtcgaagctgaaggtgctgttcctgggcttggacgaggagagcgggaggcagcagggccagggggtgctgccgcggacgtacacgctgacgcacagcgacgtgacggcgagcctgacgctggccgtgtcccacaccatcaaccgcgcgcagctgcaggggtggtacaaccggctgcagcgcgacgaggtggtggcggagtggaacaaggtgcgcggccggatgtcgctgcacgtccactgccacatctccggtggccacttcctgctcgacctcatc

SEQ ID NO: 38884 - protein, 149 aa, Panicum virgatum
  misc_feature: Ceres CLONE 1995990
  misc_feature: Useful for making plants with modulated time to senescence
  misc_feature: Useful for making plants with modulated abscission
MAAATSASTMSLLPISQLKQQHHGAGAVVVFRRRPRDARRRRYVVPTARLFGPAIFEASKLKVLFLGLDEESGRQQGQGVLPRTYTLTHSDVTASLTLAVSHTINRAQLQGWYNRLQRDEVVAEWNKVRGRMSLHVHCHISGGHFLLDL

SEQ ID NO: 38885 - DNA, 1328 bp, Panicum virgatum
  misc_feature: Ceres CLONE 1996023
  misc_feature: Encodes the peptide sequence at SEQ ID NO. 38886
gccagaagcgctgcgctgcgctgcctgcctttcgcttttccttccgctgagcgcttcccctccccctccgatctctccaccaccgccaccacccgagccggcgacccggcggcggccaccgcgcgcgggtcctcgtcgacggccgctcgcaggcgcgcggcgcggtatcgtctccctccctccagcttctccgtgcggggactcggggtttcgtcggcaggttcagttagtggtccgttgaagtgaagctgtgttgctatcatcaactgtcaagctacggcaatggcttacgagattagtgagatcaaaaagattggcattggtctggtgggatttagcatcctattctcgttccttggtgttatccttttcttcgatcggggcttgttggctctgggtaatattttctttttaactggagtgggcttattacttggctggcaatctatgtggcaacttttcatgaagaaggcaaaccttaagggatcggtacctttcttcattggtctgtttcttctgtttgtccgttggcctgttgctggtataatcatggaactatatggatcttttgtgctcttcagtggttatggccccccccatccaagccttcctatatcaaatacctatcattggttggattctgcaatacccattccagttgttcgctcagttgaggcgtaagcgggcttgaaaccttctgcaactgccaagatactctttgactcatcatggggacaagttgtatgctgttgtgatgttgataaaagaatcacctggacccttcactattgcattgaaatgatctttcaaatcttgtgtgcatatgcatactttgcggattctaatattcagtcgttctgagtagtttattgttcatatttagacaaagtagaacttcaaaaggtgctggatggtggatgctcggttagttgaaacaggaggacctcattgccttccatcatcccaacaacaaactgtggggtcagagtgatcacaccagatttatttctgattctggatgcaacttgccacattacttgccagctgcaagaaacatgtgaagaaacactacagtcagaagtcctgcatggagcttgatagctcacctgatgactaatatgtaggatctgttttcttttcgtccaatgaatggccttcgctggttgaaatgcccgtggtatttgaatttagttgtgagatgtcggtttctatatttgaagtctacatatggtgacgtgtatggttctttcggctgaagatacaccttccttctgttttattattgtgatgctgttgatgactggaatagtgccggtcatgtgattcgc

SEQ ID NO: 38886 - protein, 132 aa, Panicum virgatum
  misc_feature: Ceres CLONE 1996023
  misc_feature (29)..(131): Pfam Name: Got1 Pfam Description: Got1-like family
MAYEISEIKKIGIGLVGFSILFSFLGVILFFDRGLLALGNIFFLTGVGLLLGWQSMWQLFMKKANLKGSVPFFIGLFLLFVRWPVAGIIMELYGSFVLFSGYGPPHPSLPISNTYHWLDSAIPIPVVRSVEA

SEQ ID NO: 38887 - DNA, 711 bp, Panicum virgatum
  misc_feature: Ceres CLONE 1996046
  misc_feature: Encodes the peptide sequence at SEQ ID NO. 38888
atcattcactatccattcgaggtcctcaaactgcgagggcactgccaccatgtctgccatggcaagcttggcacagcagttcatgcttgagctgaggactccacgatcatggcttgtgctacttgttcctctcttcctcttgctcgtatgctactcgctgtccacgttcagtgccaagagagggaggccgaggcagcaggcatcagataaccacctgccgccttcccccccggcgctgcccgtcctcgggcacctccacctcgtcggctcgctcccgcacgtctccctcaggaacctcgccaggaagcacggctacgacgacctcatgctgctccgactcggcgccatgccggtcctcgtcgtgtcgtcgccgagggccgccgaggcggtgctgcgcacgcacgacctcgtgttcgcgtcccggccgcgctctctggtcgccgagatcgtcctctacggcccgtccgacatcggcttcacgccgtacggcgagtactggcgtcaggcgaggaagctcgtcaccacgcacatgctcaccgtcaagagggtgcagtcgttacgcctttcccgcgaggaggaggtgagttttgtgacggccaagatcggcgaagcggcggcggctggtgcggcggtggacatgagcgacctgctcggctcgtacatcaacgacctggcctgccgcgccgtgatgggcaagtccttccggagcca

SEQ ID NO: 38888 - protein, 220 aa, Panicum virgatum
  misc_feature: Ceres CLONE 1996046
  misc_feature: SWISSPROT Homolog: EC 1.14.13.68 4-hydroxyphenylacetaldehyde oxime monooxygenase
MSAMASLAQQFMLELRTPRSWLVLLVPLFLLLVCYSLSTFSAKRGRPRQQASDNHLPPSPPALPVLGHLHLVGSLPHVSLRNLARKHGYDDLMLLRLGAMPVLVVSSPRAAEAVLRTHDLVFASRPRSLVAEIVLYGPSDIGFTPYGEYWRQARKLVTTHMLTVKRVQSLRLSREEEVSFVTAKIGEAAAAGAAVDMSDLLGSYINDLACRAVMGKSFRS

SEQ ID NO: 38889 - DNA, 708 bp, Panicum virgatum
  misc_feature: Ceres CLONE 1996055
  misc_feature: Encodes the peptide sequence at SEQ ID NO. 38890
atgcgtctattcttgttggactgactcatccaacagctagcgtagcgaggcgagcagagcagccaagcatggagtccgaaggcgccggcgaggtgcggcactgggccgcagacgtcaacggcatctccctccacgtcgccgagcgtggcccctccaccgggccggcagtcctcctcatccacggcttcccggagctgtggctctcctggcgccaccagatggccgcgctcgccgcccgcggcttccgcgcgctggcccccgacctccgcggctacggcgactcctctgttcccgccgacccagccgcctactccatcttccacatcgtcggcgacttggtcgccctcctcgaccacctgcgcctcccaaaggtgttggtcgttgggcacgattggggtgcgcatgtggcgtggcacctctgcttgttccggccggacagggtgcgcgccgccgtcatcctgggcattccctactttccccgcggccctcgcccgatgaccgagtcctttgcaaagctcggcgacggcttttacatcaatcagtttcaggagcctggaagagccgaaagggcatttggtcgctatgacgttgcaactgttctaaaaaagttctacgcccttgatatcgatgaactcattgctcctcctggagtagagatcatagactttcttcaggcaccttcgtcaccacttccctggatgacagacg

SEQ ID NO: 38890 - protein, 213 aa, Panicum virgatum
  misc_feature: Ceres CLONE 1996055
  misc_feature: SWISSPROT Homolog: EC 3.3.2.10 Soluble epoxide hydrolase
MESEGAGEVRHWAADVNGISLHVAERGPSTGPAVLLIHGFPELWLSWRHQMAALAARGFRALAPDLRGYGDSSVPADPAAYSIFHIVGDLVALLDHLRLPKVLVVGHDWGAHVAWHLCLFRPDRVRAAVILGIPYFPRGPRPMTESFAKLGDGFYINQFQEPGRAERAFGRYDVATVLKKFYALDIDELIAPPGVEIIDFLQAPSSPLPWMTD

SEQ ID NO: 38891 - DNA, 714 bp, Panicum virgatum
  misc_feature: Ceres CLONE 1996062
  misc_feature: Encodes the peptide sequence at SEQ ID NO. 38892
tattcggagatacaacaagcatcctgaaagacccaatgccaaatatgcgaagggcctgttctcaaaggtctcctggggtactagagaaattaaatgttgttcttgcccgtacaccaatatatgtctcctccgcttcaaatataattgatgatggggcacggctgctgttaccccagattggatatgaaagtgatattgttgttgcagtgtacgatgatgaacccaccagtattgtatcgtatgccatgacatcagaagagtatgtaagacaagtcacacgcagattgaattccaatttgagtttttctcatctgtcaaatagtactgagttcggcagccatggacttgaggggtccccaccctcacaagaagaacatttggattctaagggtactcattttaagttctcctttgatgatgaatctccgatttctccagataaaacaaagttctctgtgatttgctattttgaaaggcattttgctgcgctcagaaagaaatgctgtcctaaggatattgattacatacgttctctaagtcgctgcaagagatggaatgcacaaggtggaaaaagcaatgtttactttgcaaagacgatggatgagaggttcataatcaaacaagttaccaggacagagctggaatcttttgtagaatttgctcctcagtacttcaagtatttgatggaatccttgacttctggtagcccaactt

SEQ ID NO: 38892 - protein, 237 aa, Panicum virgatum
  misc_feature: Ceres CLONE 1996062
  misc_feature: SWISSPROT Homolog: EC 2.7.1.150 1-phosphatidylinositol-3-phosphate 5-kinase
FGDTTSILKDPMPNMRRACSQRSPGVLEKLNVVLARTPIYVSSASNIIDDGARLLLPQIGYESDIVVAVYDDEPTSIVSYAMTSEEYVRQVTRRLNSNLSFSHLSNSTEFGSHGLEGSPPSQEEHLDSKGTHFKFSFDDESPISPDKTKFSVICYFERHFAALRKKCCPKDIDYIRSLSRCKRWNAQGGKSNVYFAKTMDERFIIKQVTRTELESFVEFAPQYFKYLMESLTSGSPT

SEQ ID NO: 38893 - DNA, 678 bp, Panicum virgatum
  misc_feature: Ceres CLONE 1996083
  misc_feature: Encodes the peptide sequence at SEQ ID NO. 38894
acgcacccgagagagcgagcagagacacaagagcggccgcgcggcggcatcccgatctcgccaccccccccccacccccccgatgcgatcttgccaaaccctaatcccccgccccgccacgcggctcgcgccggagccctagccccgaatgcggcggtgacgcgcgcggggtagtgtcgcccgcgagcgagcgggcgcgcggccagcccatcctgcccgccgcaatgggcgccgccgacaagtggctgctcccgctcgtctccgtctccttcgtctcgctcctgctcttcctctccgcgctctcgggcttctccgcctcctcctcgctcttcgcgcgcctcccgcctccctcctacgtgcgccggggcgccgccgcgccgccctccttcgcgtacctgctggccggcggccgcggggacggcaggaagctcctgcggctgctcctcgcggtctaccaccccaggaaccgctacctgctccacctctccgccgacgcgccggcctccgagcgcgccgagctcgccgcggccgtcgcgcgcgccgcccccgccgtgcgcgccttcgggaacgtcgacgtcgtcggcaggcccaccgccggcacgcccatggggtcctccggcctcgccggcacgctccgcgccgccgccgcgatgctccggctggatgcggagtgggact

SEQ ID NO: 38894 - protein, 151 aa, Panicum virgatum
  misc_feature: Ceres CLONE 1996083
  misc_feature: Useful for making plants with altered carbohydrate content
MGAADKWLLPLVSVSFVSLLLFLSALSGFSASSSLFARLPPPSYVRRGAAAPPSFAYLLAGGRGDGRKLLRLLLAVYHPRNRYLLHLSADAPASERAELAAAVARAAPAVRAFGNVDVVGRPTAGTPMGSSGLAGTLRAAAAMLRLDAEWD

SEQ ID NO: 38895 - DNA, 676 bp, Panicum virgatum
  misc_feature: Ceres CLONE 1996099
  misc_feature: Encodes the peptide sequence at SEQ ID NO. 38896
tctttttgcctgcaacgctctacttctttggtacactgctttttcagttgaccggcaacgtctgacaatagccacaggactgaaagagtacattctcttttcatttgcatcattcgcattggtggagccttttggacttgcaccttacatacttaaaaggaggaaatctcttgtgtcagtgtttgaaattattgaccgtgagccaaagattgatcctgatgataccactggcttgaaaccacccaatgtctatggaagtattgaattcaagaatgttgatttctcttatcctgctcgccctgaaattcttgtgctgagcaattttaaccttaaagttagtggtgggcaaacagttgcagtagtaggggtctctggatcaggaaaaagcactattatttctttgatcgagagattctatgacccggtttctggccaagttctactggatggtcgagatctgaagtcatttaacctgagatggttgcgaagccacatgggcctgattcagcaagatccagttattttctcgacgacaataagagaaaacattatttatgcaaggcacaatgcaacagaggctgagatgaaggaagctgcaaggatagcaaatgctcatcatttcattagcagcttgccacacggctatgatactcatgtgggggatgagaaggggttg

SEQ ID NO: 38896 - protein, 224 aa, Panicum virgatum
  misc_feature: Ceres CLONE 1996099
  misc_feature (115)..(224): Pfam Name: ABC_tran Pfam Description: ABC transporter
  misc_feature: SWISSPROT Homolog: EC 3.6.3.44 Xenobiotic-transporting ATPase
  misc_feature: The sequence is a functional homolog of SEQ ID NO 3 in US patent 7041874
LFACNALLLWYTAFSVDRQRLTIATGLKEYILFSFASFALVEPFGLAPYILKRRKSLVSVFEIIDREPKIDPDDTTGLKPPNVYGSIEFKNVDFSYPARPEILVLSNFNLKVSGGQTVAVVGVSGSGKSTIISLIERFYDPVSGQVLLDGRDLKSFNLRWLRSHMGLIQQDPVIFSTTIRENIIYARHNATEAEMKEAARIANAHHFISSLPHGYDTHVGDEKG

SEQ ID NO: 38897 - DNA, 703 bp, Panicum virgatum
  misc_feature: Ceres CLONE 1996102
  misc_feature: Encodes the peptide sequence at SEQ ID NO. 38898
cccccacttcttctccactttcgcaatcgcacgttcctccggctttcccgtgtcccccagagcagcgcgagggtttcgaacatggcggagcagccgcaagcggaaggcggcgcgagccccaagcacgataccctgatggagaagctcgccgacaagctccacgtcggcggcaaggactcctcctcctcgtcctcggactccgacaacgacgagcggccgcgcccctcggcgccgcccgcgcccgcctccgaggtcaagccctccttctccgactccgcagccacggcggccgccgaggccaaggccaaggtgttccgcctcttcggccgcgagcagccgatccacaaggccctcggtggaggcaaacctgctgatgtgttcctgtggaggaacaggaacatctctgctggagtgcttggtggtgccactgcaatctggatcctctttgaattgcttggctaccatcttctgaccttcgtttgccatggtctcatattctctttgggtgttctgtttctctggtctaacgcctcctcgtacatcaacaaatcgcccccacgggtcccagaggtgatcattcctgaagatctggttgtcaacattgcactatctactcgttatgagatcaacagggccttcgccaatcttcgccagattgctcttggccgggacataaagaagttccttatgggtgattgctggg

SEQ ID NO: 38898 - protein, 207 aa, Panicum virgatum
  misc_feature: Ceres CLONE 1996102
  misc_feature (96)..(205): Pfam Name: Reticulon Pfam Description: Reticulon
MAEQPQAEGGASPKHDTLMEKLADKLHVGGKDSSSSSSDSDNDERPRPSAPPAPASEVKPSFSDSAATAAAEAKAKVFRLFGREQPIHKALGGGKPADVFLWRNRNISAGVLGGATAIWILFELLGYHLLTFVCHGLIFSLGVLFLWSNASSYINKSPPRVPEVIIPEDLVVNIALSTRYEINRAFANLRQIALGRDIKKFLMGDCW

SEQ ID NO: 38899 - DNA, 694 bp, Panicum virgatum
  misc_feature: Ceres CLONE 1996105
  misc_feature: Encodes the peptide sequence at SEQ ID NO. 38900
attcacaccggcgagcacagcgaaacgcgggagcagagagagagagagagagagagagagagagagagagagagagagacccgccccctcctccctccgtccggttcccgatggcggctcgcgtcgcggccctcgccgcgctcctcgccctcgccgccgccaccgcgcgggcgtccaacgacgagggcgacgcgctctacgcgctgcggcagcggttcagggaccccaacggcgtgctgcagagctgggaccccacgctcgtcaacccctgcacctggttccacgtcacctgcaaccaggccagccgcgtcgaacgcctggacttggggaactccaatatctccggctccctcggccctgagctcgggcgccttgtgaacctcaaatacctggagctgtacaggaacaatttcgatggcgagatcccaaaggaattgggtaagctgaagaatctgatcagcttggatttgtacgccaacaagctcaccggagaaatccccaagtcactttccaagctcaactcactcagattcatgcgcttgaacaacaacaagcttaccggatcaattccaagggagcttgccaagctttccaacctcaaagtcattgacctgtctaacaatgatctctgtggaaccattcctgttgatggacctttctcaaccttccctcttagaagctttgagaacaacag

SEQ ID NO: 38900 - protein, 194 aa, Panicum virgatum
  misc_feature: Ceres CLONE 1996105
  misc_feature (22)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MAARVAALAALLALAAATARASNDEGDALYALRQRFRDPNGVLQSWDPTLVNPCTWFHVTCNQASRVERLDLGNSNISGSLGPELGRLVNLKYLELYRNNFDGEIPKELGKLKNLISLDLYANKLTGEIPKSLSKLNSLRFMRLNNNKLTGSIPRELAKLSNLKVIDLSNNDLCGTIPVDGPFSTFPLRSFENN

SEQ ID NO: 38901 - DNA, 730 bp, Panicum virgatum
  misc_feature: Ceres CLONE 1996111
  misc_feature: Encodes the peptide sequence at SEQ ID NO. 38902
aatcatgcatgagcactctctcacacactactacctccctatcttataacgcgatcgatcgaccctgattagaggtagccaagtgatcatcgtatcactcgagggaggagttaaagaaaaattaaaggaaggtgcggctccgttgaagtggccggccggccggtgagctagctagggagcgagcgagcatgggtaccatcgggttcccggtgacgaggaggagcaggtcgctggtggcgccgtcgtcggcgacgccgcaggagacgctgcggctgtcggtgatcgaccgcgtggcggggctgcggcacctggtgcggtcgctgcacgtgttcgacggccggcgcggcggggaggcggtggtgaataataataagacgccggacgtcaaccccctcgacatgccgctcatgatgcaggtgaccgagttcgcgtgcggcggcttcgtggtgggcctcatctccgtgcacaccatcgccgacggcctgggcgccgggcagttcatcaacgcggtggcggactacgcgcgcggcctccccaggccccgcgtgtcccccgtctgggcgcgcgacctcatcccggcgccgtccaggatcgtgtcgccgccgccgcgcttcgagcttctggacctccgctacttcaccgtggacctgagcccggagcacatcgccaaggtcaagtccagcttcttcgaggcgacggggcagcgctgctcggcgttcgacgtgtgcgt

SEQ ID NO: 38902 - protein, 180 aa, Panicum virgatum
  misc_feature: Ceres CLONE 1996111
  misc_feature: SWISSPROT Homolog: EC 2.3.1.167 10-deacetylbaccatin III 10-O-acetyltransferase
MGTIGFPVTRRSRSLVAPSSATPQETLRLSVIDRVAGLRHLVRSLHVFDGRRGGEAVVNNNKTPDVNPLDMPLMMQVTEFACGGFVVGLISVHTIADGLGAGQFINAVADYARGLPRPRVSPVWARDLIPAPSRIVSPPPRFELLDLRYFTVDLSPEHIAKVKSSFFEATGQRCSAFDVC

SEQ ID NO: 38903 - DNA, 677 bp, Panicum virgatum
  misc_feature: Ceres CLONE 1996111-R
  misc_feature: Encodes the peptide sequence at SEQ ID NO. 38904
cccggcgggttcttacggcaactgcttctacacggtgagggcgacgcggccgtgcggcgaggtggcgggcgccggcgtggtggaggtggtgcgcgccgtccgggacgccaaggcgcggctggcggcggacttcgcgcggtgggcggcgggcgggttcgagcgggacccctacgagctcaccttcagctacgactcgctcttcgtctcggactggacgcggctggggttcctggaggcggactacgggtggggcgcgccggcgcacgtcgtgcccttctcctaccaccccttcatggccgtcgccgtcatcggcgcgccgccggcgcccaagctcggcgcgcgcgtcatgaccatgtgcgtcacggagaagcacctgcccgagttccaggaccagatgaacgccttcgccgccgggaaccaccagtgacgacgacgacgtgcgccatccccattatagatcgatcgatcgatcgatcgtctagcttgctatgcctctctctctcaagaactgcatgctgagtggatttatttgcttgctgcgtgtaatttgtagtatttcaaactcgccacaactagcgttgcctgccagcaggctctgcccgaaaatggaagcgtctgtaaatcatcgcggatgaaataaaaaccgagatgcacgattaatttgtgcatggctagcc

SEQ ID NO: 38904 - protein, 141 aa, Panicum virgatum
  misc_feature: Ceres CLONE 1996111-R
  misc_feature: SWISSPROT Homolog: EC 2.3.1.162 Taxadien-5-alpha-ol O-acetyltransferase
PAGSYGNCFYTVRATRPCGEVAGAGVVEVVRAVRDAKARLAADFARWAAGGFERDPYELTFSYDSLFVSDWTRLGFLEADYGWGAPAHVVPFSYHPFMAVAVIGAPPAPKLGARVMTMCVTEKHLPEFQDQMNAFAAGNHQ

SEQ ID NO: 38905 - DNA, 1630 bp, Panicum virgatum
  misc_feature: Ceres CLONE 1996115
  misc_feature: Encodes the peptide sequence at SEQ ID NO. 38906
cttttccgccctccaccctcgcgagcccctccaaccccacacgacccacctcctcggcggctgcggcggctgcggtggcgatgcagatggcggcggccaccaccgactcccaggcggccgtgccgcctcaccaccctcacgcgcacccccatgcgccgccacagcacgcgcctccgcaccaccacatgccgcagccgcggtgggtcgtcataccgtacccgccgccgccgcccatggaggccgtgccgccgccgccgccgcagtwcgccaagcacttcgccgctgggccgcccccgccgccacaagctgcggcagggcgccgcacgccgaccccgcccgcggccggatccggcgggaacgggtgcgaggagaataagacgatttgggttggcgacctccagtactggatggacgagaactacctacacagctgcttcgggcccagcggcgaggtagtgacaataaaagttatccggaataggcaaactggacaatcggaggggtatggatttgtggagtttttttctcacgcatctgcagaaaaagctcttcagaattttactggtcatgtgatgcctaacaccgatagagcatttaagttaaactgggcatcatatagtatgggtgaaaagcgatctgaagtagcttctgatcactcgatatttgttggtgatctagctgctgatgttaccgatgaaatgctgatggagctttttgctagcaagtaccgatcggtgaagggagctaaagttattattgatgcaaacacaagccgctctaggggctatggatttgttaggtttggagatgataatgacaaatctcacgcaatgtctgaaatgaatggtgtatattgctctactaggccaattcgcattggacctgctactcccagaagatcttcaggtgattctggctcctcgactcctggtcattctgatggcgattcttctaacagaacggtatatattggtgggcttgacccaaatgttagtgaggatgaacttaggaaagcctttgctaaatatggcgatcttgcctcagtaaaaattcctctaggaaagcagtgtggctttgttcaatttgttagcagaactgatgctgaagaagcattacaaggattgaatggatcagtcattggaaagcaggcagttcgcctttcatggggccgtagcccatcacataagcagtctaggggtgactccggcaacaggaggaacatgtactatggcacaccattctacggaggatacggctacgcctccccggtgccgcacccaaacatgtatgcccctgcatatggtgcgtacccgttctatggcggcaacgagcagttggtgagctagatatgagctagagagcctctctcggttccgtcccctccgacgggaaacaaggttttggtccggtgagcgtagtagcgtcaggtgagaaggaggtatagccttataggttgtcctaaaaagtgggcgagatatgttgttgaatggatggtatggtgcctgtagttgttgtgtgcgcgcgtcgcaggaactggatggaactcgtggcttgtagtacaccagcgagtcgtgtcggtattctttcaagaaattttgactttgtaataaattaaactattgtttgtgcg

SEQ ID NO: 38906 - protein, 421 aa, Panicum virgatum
  misc_feature: Ceres CLONE 1996115
  misc_feature (295)..(360): Pfam Name: RRM_1 Pfam Description: RNA recognition motif. (a.k.a. RRM, RBD, or RNP domain)
  misc_feature (194)..(266): Pfam Name: RRM_1 Pfam Description: RNA recognition motif. (a.k.a. RRM, RBD, or RNP domain)
  misc_feature (101)..(172): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature (62)..(62): Xaa is any aa, unknown, or other
MQMAAATTDSQAAVPPHHPHAHPHAPPQHAPPHHHMPQPRWVVIPYPPPPPMEAVPPPPPQXAKHFAAGPPPPPQAAAGRRTPTPPAAGSGGNGCEENKTIWVGDLQYWMDENYLHSCFGPSGEVVTIKVIRNRQTGQSEGYGFVEFFSHASAEKALQNFTGHVMPNTDRAFKLNWASYSMGEKRSEVASDHSIFVGDLAADVTDEMLMELFASKYRSVKGAKVIIDANTSRSRGYGFVRFGDDNDKSHAMSEMNGVYCSTRPIRIGPATPRRSSGDSGSSTPGHSDGDSSNRTVYIGGLDPNVSEDELRKAFAKYGDLASVKIPLGKQCGFVQFVSRTDAEEALQGLNGSVIGKQAVRLSWGRSPSHKQSRGDSGNRRNMYYGTPFYGGYGYASPVPHPNMYAPAYGAYPFYGGNEQLVS

SEQ ID NO: 38907 - DNA, 1939 bp, Panicum virgatum
  misc_feature: Ceres CLONE 1996117
  misc_feature: Encodes the peptide sequence at SEQ ID NO. 38908
aagtcgaagaacacagcaagaaaatgacgacgtcggccaagaggacggcgccatgacaggctctcggaggcggaggccgccttgaaccgcgccgtcgcggcgagctgggtggggaggtatttcaagctggacgcccgcaagagctccttcaccaaggagctccgcgccggcgccgccacgttcctcaccatggcctacatcatctccgtcaacgcggcgatcctcaccgactccggcgggccgtgcacagtgcgggattgcacgccggtggcgaactcgacggcagtgcccgggccggagtgcacggccgggccgagcccgaaccccgggtacgagcagtgcctggcgcgcaccaagagcgacctgatcgtggccacggcggtggccgccatggccggctccttcgccatgggcgtgttcgccaacctcccgctcgcgctggcccccggcatgggcgccaacgcctacttcgcctacaacatggtcgggttccacggctcgggttccatcccctacggcacggcgctcgccgtggtgatgctggagggcgtcgtcttcctcgcgctgtcggccgtcggcctccggtccaggctggcgcggctgatcccgcggaacatccggctcgcctcggccgtcggcatcggcctgttcctggccttcactggcctccaggcgcaccagggcgtcgggctcgtcggcgccagcccatcgacgctggtcacgctcgccgcttgctccgaggtcgacccggccaccggcgcgtgcctcggcggcaccatgcgcagcccgacgttctggctcggcgccgccgggttcctcgtcacggcgacgtgcctggcccggaacgtgaagggggccatgatctacggcatcgtggtcgtcacggcagtgtcgtggatccgcggcactatcgtgacggtgttcccggacacggcggccggcgacgccgccttcgcctacttcaggaaggtggtcggcttccacatgatcagcaccaccgcggggaagatcagcttcgccggcttccgccacggcaacgtctgggtggccctggtgacgctcctctacgtggacgtgctggacacgacggggacaatgtactccatggctgagtacggcgggttcgccgacgaggccaccggcgggttcgagggtgagtaccgggcgttcctggtggacgccgggtcgacggtgctcagcgcggggctcgggagctccaccgtgaccacctacatcgagtcggcggcggggatccgggagggcggccggacggggctgaccgccgtcaccgtggccgccggcttcctggcgtcgctcttcttcgggccgctgctgacgagcgtgccgccgtgggcggtgggcccgtcgctggtgctggtgggcgcgatgatgatgcgggtggccggggagatcgagtggggcgacatgaaggagggcgtgccggcgttcgtgaccatggcgctcatgccgctgtccttctccatcgcctacggcatcatcgccgggctgggcgtgtacgtcgcgctgcactggtatgactgggcgcgccacgggttgggcaaggtgaggggcgtgctggacgagcggcggaaccaggtggccgccgccgcgggcgaggtcgtcggcccggcggcggcggcggagcaggacgacgtcgtctgagctccgtttgttgcattgatgcgcgcaagatcgtggaaggtcgcaagctctttaattagtaggttgattagttgttttaattagtacggtggatcacttaattttggggagagctgagctgagctgagctgagctgagcgttgtccttagtattatggtggttactggattagggcaaaggagtgggaacggggcctgctgggagattcttgatgtgtgaggaggtgtttgtactttgaccatcattggaggcagcgttctcattgattcccctccc

SEQ ID NO: 38908 - protein, 490 aa, Panicum virgatum
  misc_feature: Ceres CLONE 1996117
  misc_feature (41)..(438): Pfam Name: Xan_ur_permease Pfam Description: Permease family
MAYIISVNAAILTDSGGPCTVRDCTPVANSTAVPGPECTAGPSPNPGYEQCLARTKSDLIVATAVAAMAGSFAMGVFANLPLALAPGMGANAYFAYNMVGFHGSGSIPYGTALAVVMLEGVVFLALSAVGLRSRLARLIPRNIRLASAVGIGLFLAFTGLQAHQGVGLVGASPSTLVTLAACSEVDPATGACLGGTMRSPTFWLGAAGFLVTATCLARNVKGAMIYGIVVVTAVSWIRGTIVTVFPDTAAGDAAFAYFRKVVGFHMISTTAGKISFAGFRHGNVWVALVTLLYVDVLDTTGTMYSMAEYGGFADEATGGFEGEYRAFLVDAGSTVLSAGLGSSTVTTYIESAAGIREGGRTGLTAVTVAAGFLASLFFGPLLTSVPPWAVGPSLVLVGAMMMRVAGEIEWGDMKEGVPAFVTMALMPLSFSIAYGIIAGLGVYVALHWYDWARHGLGKVRGVLDERRNQVAAAAGEVVGPAAAAEQDDVV

SEQ ID NO: 38909 - DNA, 685 bp, Panicum virgatum
  misc_feature: Ceres CLONE 1996138
  misc_feature: Encodes the peptide sequence at SEQ ID NO. 38910
aaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatcgcggcgacggaggcggttcgccgcccccgacgtcgcgagaagtccattgaaccttatcatttagaggaaggagaagtcgtaacaaggtttccgtaggtgaacctgcggaaggatcattgtcggttctcttctcttgttgctggtctcaggagcattgttactaagttgaggaaggatgagcaaaggcccagttccgttcgtcaacatcgggaagagagcaaaagatctattgtacaaggactacaactttgaccaaaagttttctttgtcgacgtctagtaactctggtttgaatcttacagccactggtgtgaagatcaatgaagacttcattggtgatatacggacacaacataaaagtggtagaaccactgttgatgtcatagtcgatagtgattctaaagtctcaaccacagtcactgttgatgaagcgcttactggtttgaagacttcattcagcttcaaggttcctgatcacaagtctgggaagcttgatctgcaatacacccacaatcgctttgcatt

SEQ ID NO: 38910 - protein, 116 aa, Panicum virgatum
  misc_feature: Ceres CLONE 1996138
  misc_feature: Useful for making plants with modulated drought sensitivity
MSKGPVPFVNIGKRAKDLLYKDYNFDQKFSLSTSSNSGLNLTATGVKINEDFIGDIRTQHKSGRTTVDVIVDSDSKVSTTVTVDEALTGLKTSFSFKVPDHKSGKLDLQYTHNRFA

SEQ ID NO: 38911 - DNA, 1406 bp, Panicum virgatum
  misc_feature: Ceres CLONE 1996141
  misc_feature: Encodes the peptide sequence at SEQ ID NO. 38912
agtactagccctgcgccgcagcaatggtggtggcatcccccgccgcataaatcccaccactcccgcttctcggcgtgttctcctcggctgggcttccttcccctccaaccgcgcgggcgcggcgccgccgtggagatggcgaccggggagtgggagctgcgggaggaggacgagtacgagttcgacctcgagaacccgttcaccagccccgccgacgagccgatcgccagcctcctcgacgccgagggccaccacgcgccctccgtctccgccgcggcctccgccgtccgccgcgacgccaccggattcatctccaaggtgcggttcggcggggagctcgccgtgcacccgcgcgtcgcctacctcgcgctcaactacgtggatcgcttcctctccaagcgccaactgcccagcgagcagcagccgtgggcgccgcggctgctcgccatcagctgcctctccctcgccgccaagatgcagcgcgtcgcagccgtctccatcgccgacatccagagggatgaggagttcatgttcgacgaggcgtccgtgcggcgcatggagcgcatggtgctgggcgcgctggagtggcgcacgcgctccgtcacgccgctcgccttcctcggcttcttcctctccgcgtgctacccggcgccctgtcacccgacacaggtcgctgccgtcaaagcgcgcgccgtcgacctcctcgtccgcgcccagcccgaggtcaagatggcggagttctcgccctctgtatcggccgcggcggcggtgctcgccgctgccggggaggtcgccgccgagaacctccaggcgttccaagccggcgtcgccgcctgcccctttgtaaatagcgacaagctgcgagagtgcggcgaggtgctggcggcggcgtgcggcgtcgggccggtgcgcggcgcggcgagcgcggacactccggtgacggtgctcggtcaccaccgcagcgccgcgtccgagagcgactggaccgtcggatcggcggccaacggcggcggtggcgaggcgaagaagcgctgcatgggcccaccgtcgcattgggggtaggcggatgaccgagtcaagcgaggggcttgtcaccgctggatggaggagttggaaatttactctttccaatttttttcaccctttttcttttcaattattttcttctactttaatcctctcgaggtaaagtggtggggatggatagaattcgtggaatcgtggtggtggtgcatgtcatttagtagctcctttttgctagtttatcttttttagggggagcctagttatggtaatttttgcggcagtactttagaaggtgaggatggtggatgaacatattgtgctgggaggggcgaaatggtgtgaaatggcagaaaataaaaccaaaaggcatgttgctggtc

SEQ ID NO: 38912 - protein, 308 aa, Panicum virgatum
  misc_feature: Ceres CLONE 1996141
  misc_feature (28)..(154): Pfam Name: Cyclin_N Pfam Description: Cyclin, N-terminal domain
MATGEWELREEDEYEFDLENPFTSPADEPIASLLDAEGHHAPSVSAAASAVRRDATGFISKVRFGGELAVHPRVAYLALNYVDRFLSKRQLPSEQQPWAPRLLAISCLSLAAKMQRVAAVSIADIQRDEEFMFDEASVRRMERMVLGALEWRTRSVTPLAFLGFFLSACYPAPCHPTQVAAVKARAVDLLVRAQPEVKMAEFSPSVSAAAAVLAAAGEVAAENLQAFQAGVAACPFVNSDKLRECGEVLAAACGVGPVRGAASADTPVTVLGHHRSAASESDWTVGSAANGGGGEAKKRCMGPPSHWG

SEQ ID NO: 38913 - DNA, 696 bp, Panicum virgatum
  misc_feature: Ceres CLONE 1996147
  misc_feature: Encodes the peptide sequence at SEQ ID NO. 38914
aggcactgccgcggcgggcatgccaagctgggaggcgcagtgaagtaaccaggtggtgctggtttgtgaggaggaggaggtgcggccggcgggggaggaaggaagcaaggaagtcggccagggggagagatgagtgcggcggcggcggcggcggcgagctcggtcgccaagttcatcaagtgcgtcaccgtcggggacggcgccgtggggaagacctgcatgctcatctgctacacctgcaacaagttccccacggattacatccccactgtattcgacaacttcagtgccaatgtctcggtggatgggagcatcgtcaacttgggcctctgggacacggcaggtcaggaggattacagcagattgaggcctcttagctacaggggtgcggatgtgttcatcctctccttctctctggtcagcagggcaagctatgagaatgtcttgaagaagtggatgccagagcttcgccgattttcacctaccattcctgtagttcttgttggaaccaaactagatctccgtgaagacagatcttatcttgctgaccatcctgccgcttctatcatcactactgaacagggagaggaactcagaaagcagataggtgctgtggcctatatagaatgcagctcaaagacacagcggaacataaaagctgtgttcgacactgcgattaaagtagtgcttcaacca

SEQ ID NO: 38914 - protein, 188 aa, Panicum virgatum
  misc_feature: Ceres CLONE 1996147
  misc_feature (17)..(188): Pfam Name: Ras Pfam Description: Ras family
  misc_feature (17)..(130): Pfam Name: Miro Pfam Description: Miro-like protein
  misc_feature: Useful for making plants with modulated nitrogen use efficiency
MSAAAAAAASSVAKFIKCVTVGDGAVGKTCMLICYTCNKFPTDYIPTVFDNFSANVSVDGSIVNLGLWDTAGQEDYSRLRPLSYRGADVFILSFSLVSRASYENVLKKWMPELRRFSPTIPVVLVGTKLDLREDRSYLADHPAASIITTEQGEELRKQIGAVAYIECSSKTQRNIKAVFDTAIKVVLQ

SEQ ID NO: 38915 - DNA, 713 bp, Panicum virgatum
  misc_feature: Ceres CLONE 1996148
  misc_feature: Encodes the peptide sequence at SEQ ID NO. 38916
cccaaccccgccggatcctccctacccgctcacaaaaccctagcccaacaccgcccggccgccgccgccgatggcgaagcctcggcgcggccgctccgcctcgcgctcttcctcgggctcctcctcccgctcgccgtcccgctccgtctcctccggctccgtctcgtcccgctcccggtcgcgctcccgctccttctcgtcctcctcctcccagtctcggagccgctcccctcccccacataagcgcagctcatcgggagcaaggaaaggtcaatcaccttcaccacctcctaaaaaaggttcaccctcaaagaaagtccgttcaccatcaccaccgcctaaaaaggcttcaccccctaggaaagcatctcctcctgctgagtctgctgttctctgcattgatcatttatcaaggaatgttaatgagtctcatttgaaagagatttttggaaactttggcgaagtggttaatgtggagctatcaatggatcgattggtcaatcttcctcgcgggtatggttatgttgaattcaagaagagagctgatgccgagaaagctcttctttacatggatggtggtcaaattgatggaaatgttgttaagttgagatttacacttcaaccacgccaaagggctgcatcacctacaaaggttcctccccctccaaaaagagatgctcctccaaatgacaaaggtgctaacagtgctgaaa

SEQ ID NO: 38916 - protein, 214 aa, Panicum virgatum
  misc_feature: Ceres CLONE 1996148
  misc_feature (108)..(179): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAKPRRGRSASRSSSGSSSRSPSRSVSSGSVSSRSRSRSRSFSSSSSQSRSRSPPPHKRSSSGARKGQSPSPPPKKGSPSKKVRSPSPPPKKASPPRKASPPAESAVLCIDHLSRNVNESHLKEIFGNFGEVVNVELSMDRLVNLPRGYGYVEFKKRADAEKALLYMDGGQIDGNVVKLRFTLQPRQRAASPTKVPPPPKRDAPPNDKGANSAE

SEQ ID NO: 38917 - DNA, 1285 bp, Panicum virgatum
  misc_feature: Ceres CLONE 1996158
  misc_feature: Encodes the peptide sequence at SEQ ID NO. 38918
aaaaaaaaaaaaaaaaagactcgccgagtacactgtacacacgacacgacgcgacgccaatcgcaagccaaaccctacccccagccgcgaccccgaccccccccacctcaccggcgatgagctcctcctccaacggcgggaagaagccggcgaccggcggcggccgcgggggtcccaccatccgcacgctcgccgacatcaaccgcgggcccgcaggcttccccggccccgggggcagcggcagcgactccgacgagccccaggagtactacaccggcggcgagaagagtgggatgcttgttcaagatccgactaaaaggaatgatgtggacgcaatctttgaacaagccaggcagacgggtgctatccaagcaccaccccctttccttgataaccagtcctccagctcgaggagctttacagggaccggccgactgctttcaggggagacagcaccatctgctgcgcctgcggatgcgtctgcatctcaggaaccagttcacatactccacgtcatacacttgtggaacaatggtttcagtgtagatgacggtccactgagagcctatgatgatcctgaaaatgcagaattcattgagagccttaagatgtcccgatgcccccaggaactggagcctgctgacagaagcacaccagttcatgtgaatgttatgaaaagacttgaagattaccgggaaccgataaggccccgatcggctttccagggtgttggaagaacccttggaggtggaccttctacagatgagagttcagcacctgcacctgcacctgcacctgcacctgctcctgctcctgcttcagcggcccctgctgcttcgaggtcaaccagctttgttgtggatgactcccagccatttacatccatacagctgaggctggctgatggcactcgcatggtcgcccggttcaacatgcaccacactgtgggcgacatcagatccttcattgatgcatcccggcctggagctgcaaggccgtatcagctgcagactggcttcccacccaagcagctgaccgatccaacccagactgttgagcaagctggcctggcgaactctgttatcatgcagaagatctaatgcttcaccgagctgggaacccagatgcataatgcgtctttcgaaacttggtaccgtcgaggagttggtaactggcctattgccttgtcagcccctttgacaacctatcagactttataagttgtcggtgaacatgtatacattcctatttacagcaactactgaagtgccacattgacgttttc

SEQ ID NO: 38918 - protein, 327 aa, Panicum virgatum
  misc_feature: Ceres CLONE 1996158
  misc_feature (134)..(207): Pfam Name: SEP Pfam Description: SEP domain
  misc_feature (249)..(327): Pfam Name: UBX Pfam Description: UBX domain
MSSSSNGGKKPATGGGRGGPTIRTLADINRGPAGFPGPGGSGSDSDEPQEYYTGGEKSGMLVQDPTKRNDVDAIFEQARQTGAIQAPPPFLDNQSSSSRSFTGTGRLLSGETAPSAAPADASASQEPVHILHVIHLWNNGFSVDDGPLRAYDDPENAEFIESLKMSRCPQELEPADRSTPVHVNVMKRLEDYREPIRPRSAFQGVGRTLGGGPSTDESSAPAPAPAPAPAPAPASAAPAASRSTSFVVDDSQPFTSIQLRLADGTRMVARFNMHHTVGDIRSFIDASRPGAARPYQLQTGFPPKQLTDPTQTVEQAGLANSVIMQKI

SEQ ID NO: 38919 - DNA, 1427 bp, Panicum virgatum
  misc_feature: Ceres CLONE 1996159
  misc_feature: Encodes the peptide sequence at SEQ ID NO. 38920
ggcggcatgaggaggagcgattagcggagcctcggagggaaggagacaagtttcttcgctcgctaacagatggaaatgacctagtgagagtgagccgatcctcatccaccatggcggctccggcgtgcagcacctccgtgtccgacgactccgactcctctcagtgcagcgaggcaagcatatgggattctcaagagttacgtaggcaggctgaatgtctggagctggaggagctggcagcaatctcagtcaatactactttgcttccaactctcaatcatttgcttctcgaggtttatgccattctgcgtccaaagccacttgactatgaccagcgcaacaccttggttgatgtcttcagggagattactaaacaaatatttggtagcaacgatgggtttccagttgtggagccatttggatcattcacgatggatttatttactcctcgtggtgacctggacctctctgtcaatttcaatgctaatactgatgatcgatacactcgcaaggaaaagatctctgtgatcaggaaattttccaaagttctatattctcatcagaggaatggaatttgctgtggggttttacctattgtaagtgctagggtgcctattctgaaggttattgattgtggcacagggattgaatgtgatatttcggttgaaaataaagatggcatgacaaggtcaatgatcttcaaatatgtttccatgattgatgaaaggtttcagatactaagttacctgacccgacatcctccaatattgcctgcattctctgccttgttaaaagatggtttagattgtgcaagcgttgagaggaacattttaccgttcaaggggtttgggagcagaaatacagaatctgtggctgaactgtttgtgtcattgataagtaaactgttgtcagcagagagtttatgggagcatgggctgtgtgctagcaattttgaagcgtcatggatctccaagacctggaagaaaggagtcggcaatttaagtgttgaagatttcttggacaggtcacaaaattttgcaaggtcggtggggaaggtgcagatgcagaagatctgcagatgccttagacaatgtgctttgaatttgttggatttcatgagggggaaactggacacaccaaagctgaagacccttttgtttgggcggcttagtccagatgaggtagtcagcaaacctcgtttgaagcacggcaagaggaagaggaagtcggaactttgccagcagggaagatatgcattccaaaagagagcaaagcgtggtggtaatgctacaactagtagagattcgttacccgctcctgcttctaacaaggtctttcctttggtacatgatcgaggcaccggtattcatcggtttgtgcccattattccatggcctcgtatcatcccttctggttttggctatggg

SEQ ID NO: 38920 - protein, 438 aa, Panicum virgatum
  misc_feature: Ceres CLONE 1996159
  misc_feature: SWISSPROT Homolog: EC 2.7.7.19 Polynucleotide adenylyltransferase
MAAPACSTSVSDDSDSSQCSEASIWDSQELRRQAECLELEELAAISVNTTLLPTLNHLLLEVYAILRPKPLDYDQRNTLVDVFREITKQIFGSNDGFPVVEPFGSFTMDLFTPRGDLDLSVNFNANTDDRYTRKEKISVIRKFSKVLYSHQRNGICCGVLPIVSARVPILKVIDCGTGIECDISVENKDGMTRSMIFKYVSMIDERFQILSYLTRHPPILPAFSALLKDGLDCASVERNILPFKGFGSRNTESVAELFVSLISKLLSAESLWEHGLCASNFEASWISKTWKKGVGNLSVEDFLDRSQNFARSVGKVQMQKICRCLRQCALNLLDFMRGKLDTPKLKTLLFGRLSPDEVVSKPRLKHGKRKRKSELCQQGRYAFQKRAKRGGNATTSRDSLPAPASNKVFPLVHDRGTGIHRFVPIIPWPRIIPSGFGY

SEQ ID NO: 38921 - DNA, 487 bp, Panicum virgatum
  misc_feature: Ceres CLONE 1996159-R
ctggtccaatgggattttgaggtgatgacagctactaccgggctgcaagtagagcttggtttgtgctgtagttgtatgttgtcgctgtactggttttgaaccaattgtaatcgccgccatagactgcaacgccgtttgaacgcacgcgatttgtgtaggtctgcctctgcggcctgctgcctggaaatatgactgatgactttgaatgtggtatatgtggaatgcaatcgacgtggtctttgcacatgcgcctctgcggcctgctgcctggaaatatgactgatgactttgaatgtggtatatgtggaatgcaatcgacgtggtctttgcacatgcgcctctgcggcctgctgcctggaaatatgactgatgactttgaatgtggtatatgtggaatgcaatcgacgtggtctttgcacgtgcttgtgggtagggatgtaaatggtacggatattttccgactgtatttgaattcgatctggtctgg

SEQ ID NO: 38922 - DNA, 1657 bp, Panicum virgatum
  misc_feature: Ceres CLONE 1996186
  misc_feature: Encodes the peptide sequence at SEQ ID NO. 38923
tgccttttgcagttgtccattaaggaagaatagaatgttaaagaatggactgtttaggaacgcaggaaccccattcaactggtatatctacaggacttttggaagatcatcattatcaaaagactacgttggaccaaacatcaagggaaaaccagcaaaatggacgttccagtaatgaagcatcaaaacataatattggaatctctgaagtccatttctcatgggatgattctagtgcagcgatgaccaatttacatccactcttaccatgtgattatggatcattggttcatacactggcaccttgctgctcagactctgaaactgtgttctcatctaattggaaacagaataatcctcagtcaaaagaaatgtatcacagtggtgaagcaacagatgacaactctgagtttcttcagctaatttttagtgacacttacgaagggaacagttcaagtgaactgcaaatttgggatgttttggacctgtatttccctgaaagcattgctgctgttcaattcaatactctgatgggttttggaaatgatgattgtactccttataatgagtgtgtggatgctgctgatatggtagagatgagcatttctcccccatctccagacagggacgcagatgatgctaattgcagggttccagttgattacactagcttttatcttcaaaataaaccaccagattcagataatgagtgcagctctgcctcttgcatcgtgacaggatatgaatgtactgataatcaagagctacctataggtcttctgaatttaatggacattggatcaccaggcgattcagatgacttatccagaccattattgaccacaaaaaacatcatgcttgtgctggatctggatgaaacccttgtccattcaaagttacaaccctgtgataattttgacttcacccttcaagttttctttaatatggaagatcatactatatatgtgaggcggagacctcacctcgagatgttccttcaccgtgttgctcagatgtttgaggttgtcattttcacagctagtgaaagtgtttatgctgaacctctattagataaactcgacccagaccggaaactgatttcacgccgtttttaccgtgaatcttgtaccttttccaatggtagctacacgaaggacctaacaattttcggagttgacttggcaaaagttgtgatagttgacaatactccacaggtcttccaactgcaggtcaacaatgggatacccataaagagctggtttgatgacccggcagatgttgagttgatggaactgcttcaattccttgcgaccctcgtcgacgcaaaggatgttcgaccaatcatctcgaagaacttcaacaacaaacctgaactggtaggatcagatcagataaagtaaaagtttgctccctgttcgtttgagaacctccatttctgcatccaggtcattctggggttcaggcaattcttgagtaattaggtatagaatctacacacagcgttcatgaatcatgatatgttgttagtagttacagataggatgggaaaagccatagtcactgccatggcattgcatggttccttagtttcatgtattgcagagctacagaaactaaattacgagacattaccttgtgaatcaaattttgattgctc

SEQ ID NO: 38923 - protein, 451 aa, Panicum virgatum
  misc_feature: Ceres CLONE 1996186
  misc_feature (261)..(436): Pfam Name: NIF Pfam Description: NLI interacting factor-like phosphatase
  misc_feature: SWISSPROT Homolog: EC 3.1.3.16 Phosphoprotein phosphatase
MDCLGTQEPHSTGISTGLLEDHHYQKTTLDQTSRENQQNGRSSNEASKHNIGISEVHFSWDDSSAAMTNLHPLLPCDYGSLVHTLAPCCSDSETVFSSNWKQNNPQSKEMYHSGEATDDNSEFLQLIFSDTYEGNSSSELQIWDVLDLYFPESIAAVQFNTLMGFGNDDCTPYNECVDAADMVEMSISPPSPDRDADDANCRVPVDYTSFYLQNKPPDSDNECSSASCIVTGYECTDNQELPIGLLNLMDIGSPGDSDDLSRPLLTTKNIMLVLDLDETLVHSKLQPCDNFDFTLQVFFNMEDHTIYVRRRPHLEMFLHRVAQMFEVVIFTASESVYAEPLLDKLDPDRKLISRRFYRESCTFSNGSYTKDLTIFGVDLAKVVIVDNTPQVFQLQVNNGIPIKSWFDDPADVELMELLQFLATLVDAKDVRPIISKNFNNKPELVGSDQIK

SEQ ID NO: 38924 - DNA, 1338 bp, Panicum virgatum
  misc_feature: Ceres CLONE 1996198
  misc_feature: Encodes the peptide sequence at SEQ ID NO. 38925
cggtccccccaccaggccaccactcacgcccgccgcctccagcgcccgcgcagagcagcagcagcagccaccgcagcgccgtgatatggtgtcgaggacgcccacgaagccgccgccgtcgcccaggctcggcgccggggcggccaatgtcacaccgccgaagccgtcgccgtcgcccgtggcgcggcgccgccactcgctccgccgccgcctgccctacgccaccaccaagcgccgcgggagcccgctcaagtccctcgcgtccgcgcccgccgccgtcgccgcgaccttcgaccgctccctccgctcctgccgccgccgcctcctcaagctcttcgcccgcctcgccgtcctcggctccccgcgcaagcgccgcgccgccgccgcggggttccagcgcctccgctccgcctcgcctcccgccacaccccctccgggccctcccccgccctcgcagaaccccgccgcggcccgcgcgcagcccgccgcgctcccgccgccgccgtcgccggggaggcggacgctgttcctcgacctcgacgagacgctcatccactcccagaccgacccgccgcccgcgcagttcgacttcaccgtgcgccccgtcatcggcggccgggccgtcaccttctacgtcgccaagcgcccgggcgtcgaggccttcctccgcgcggcggcggagtgcttcgaggtcgtcgtcttcaccgcggggctccaggagtacgcctccctcgtgctcgactgcctcgaccccgacggcgaggtgttcgcgcaccgcctctaccgcggcgcgtgccgcgacgccggggacgggaggttcgtcaaggatctcgccgccacaggccgggcgctggaccgcgcggtcatcgtcgatgataaccccaatgcctacgccctgcagccggagaacgccattcctgtggcgccgtttgtggacgatgataacgaccaggagctcaagagggtgatggcgttcttggacgtcgctgcggcgtacgaagacacaagggaggccatcagatattaccaggatctcgtcacgccaagctgagccgccggcttgcaccgtggagaaggtgccccttttgcgtgccgtgcctatcagttcttgaagcggtttcaggttgaaagattgctcctttctctcagataggtggttagttgagtcttgagtggagtagagcagagagatttcagcaaaacaggagatgtgggtagacaggtagagcttcaaattttcaggatcttcctgaatttggatgcgagtatattatgtagtgggaatcggaaaccaaactgaaatggaaattacacaatgctgggaaactttgtaagttc

SEQ ID NO: 38925 - protein, 321 aa, Panicum virgatum
  misc_feature: Ceres CLONE 1996198
  misc_feature (139)..(313): Pfam Name: NIF Pfam Description: NLI interacting factor-like phosphatase
  misc_feature: SWISSPROT Homolog: EC 3.1.3.16 Phosphoprotein phosphatase
MVSRTPTKPPPSPRLGAGAANVTPPKPSPSPVARRRHSLRRRLPYATTKRRGSPLKSLASAPAAVAATFDRSLRSCRRRLLKLFARLAVLGSPRKRRAAAAGFQRLRSASPPATPPPGPPPPSQNPAAARAQPAALPPPPSPGRRTLFLDLDETLIHSQTDPPPAQFDFTVRPVIGGRAVTFYVAKRPGVEAFLRAAAECFEVVVFTAGLQEYASLVLDCLDPDGEVFAHRLYRGACRDAGDGRFVKDLAATGRALDRAVIVDDNPNAYALQPENAIPVAPFVDDDNDQELKRVMAFLDVAAAYEDTREAIRYYQDLVTPS

SEQ ID NO: 38926 - DNA, 698 bp, Panicum virgatum
  misc_feature: Ceres CLONE 1996204
  misc_feature: Encodes the peptide sequence at SEQ ID NO. 38927
atcatcacccgccgccgccgccgccgccgccgacatagccgaagcaccagcgcttgagcgtagttcaggagcgaggattggagtgatgtccgctgaggaggctgccgctgccgcgaccgaggtccccgagaccgaggtcgagtccgaggccccggccgccgaggaggcggaggccaagcccgccaaggccaagaaggcgcccaaggagaagaaggcgcccaaggagaagaaggcccccaaggagaagaaggcccccaaggagaagaaggagaagaagcccgccgcggcgaggaagacggccgcccacccgccgtacgccgagatgatctcggaggcgatcgcggcgctcaaggagaggaccgggtcgagctcggtggccatcggcaagtacgtggaggagaagcacggcgcgaagctgccgcccaacttccgcaagctgctggccgggcagctcaagaagctcgccgccgcggggaagctgacccgcgtcaagaactcgttcaagctgccggccgccgccgacgccaagcccaaggcggccaagcccgccgccgcggccaagccgaagccagccaaggccgccaagcccgcggtcaagcccaaggcgtccccgaaggccaaggccaagatcgccgccaagaccaagacggccgccgcctcccccaagccccaggccaaggccgcccccgccgcggcgc

SEQ ID NO: 38927 - protein, 204 aa, Panicum virgatum
  misc_feature: Ceres CLONE 1996204
  misc_feature (73)..(143): Pfam Name: Linker_histone Pfam Description: linker histone H1 and H5 family
MSAEEAAAAATEVPETEVESEAPAAEEAEAKPAKAKKAPKEKKAPKEKKAPKEKKAPKEKKEKKPAAARKTAAHPPYAEMISEAIAALKERTGSSSVAIGKYVEEKHGAKLPPNFRKLLAGQLKKLAAAGKLTRVKNSFKLPAAADAKPKAAKPAAAAKPKPAKAAKPAVKPKASPKAKAKIAAKTKTAAASPKPQAKAAPAAA

SEQ ID NO: 38928 - DNA, 671 bp, Panicum virgatum
  misc_feature: Ceres CLONE 1996205
  misc_feature: Encodes the peptide sequence at SEQ ID NO. 38929
acttccgttcacccccccccccccccccctcgccgccggcgccgtcgcgtcctcctccgccagtcatggccgccgcgggtcccgggctctacaccgagatcgggaagaaggccagagatctcctctacaaggactaccacacggaccagaagttcacgctcaccacctacgcctccaacggagctgccattactgctgcaagtactaggaaaaatgaatctatcttcagtgaaatccagagccagctgaagcatgaaaatgtgacagtggatgtgaaagcaacttcagaatcaactgtgacgactacatttacaattcatgagctgggcacaccaggtctgaaggcaattttatgcattcctttcccgtaccagaaatcagcaaaggctgaactccagtacttgcaccaccatgctggtgttgctgctagcgttggcctgaatgcaaaccctgttattaacttttctggtgtattcgggactaaaaccatcgctgttggtgctgacgcctcatttgacacttcatctggggacttcaccaaatacgatggtggactgagctacactactagtgactttgttgctgcagccactctgaacaacaagggagacagccttgctgcttcctactaccacttggtgaattcaaccacagctgttggaggagagctg

SEQ ID NO: 38929 - protein, 201 aa, Panicum virgatum
  misc_feature: Ceres CLONE 1996205
  misc_feature (5)..(199): Pfam Name: Porin_3 Pfam Description: Eukaryotic porin
  misc_feature: Useful for making plants with modulated drought sensitivity
MAAAGPGLYTEIGKKARDLLYKDYHTDQKFTLTTYASNGAAITAASTRKNESIFSEIQSQLKHENVTVDVKATSESTVTTTFTIHELGTPGLKAILCIPFPYQKSAKAELQYLHHHAGVAASVGLNANPVINFSGVFGTKTIAVGADASFDTSSGDFTKYDGGLSYTTSDFVAAATLNNKGDSLAASYYHLVNSTTAVGGE

SEQ ID NO: 38930 - DNA, 729 bp, Panicum virgatum
  misc_feature: Ceres CLONE 1996223
  misc_feature: Encodes the peptide sequence at SEQ ID NO. 38931
aaggaaagaccgaagagtcggaaccagtacacaccgagctttcttctcccctgccctcgctgctgcggcgaattttcttgccctgcaccggccaccgtggctagcctgcgccaccgtcgcccttccgccctcctccgggaagctgaaagatcttggataattttgaacatgtcatgtctggcatgttgtggcggcgaagacactcaaagagcacctgatagtggaggtccataccctggtggctacccagcaaggaatgatgcttatcgcactgctgatccaactcccagaggtgttcaacctgtgaaagtgcagccaattgctgtccccactattcctgttgaagaaatccgggaggtcacacagggttttggtgatgaagctttggttggtgagggttcttttggcagagtgtattatggtatactgaataatggcagaagtgcggcgatcaaaaagttagattcaagtaaacagccagaacaagaatttttggcacaggtttccatggtgtcaagacttaagcatgacaatgtcgtggagttgcttggttactgtgttgatggaaacacccgtatccttgcttatgaatttgctactatgggttctcttcatgatatgcttcacggccggaaaggtgtgaaaggagctcagccaggtccagtcctgtcttggacacaacgagtgaaaattgctgttggagcagcaaaaggccttgagtatcttcat

SEQ ID NO: 38931 - protein, 186 aa, Panicum virgatum
  misc_feature: Ceres CLONE 1996223
  misc_feature (58)..(186): Pfam Name: Pkinase_Tyr Pfam Description: Protein tyrosine kinase
  misc_feature: SWISSPROT Homolog: EC 2.7.11.1 Non-specific serine/threonine protein kinase
MSCLACCGGEDTQRAPDSGGPYPGGYPARNDAYRTADPTPRGVQPVKVQPIAVPTIPVEEIREVTQGFGDEALVGEGSFGRVYYGILNNGRSAAIKKLDSSKQPEQEFLAQVSMVSRLKHDNVVELLGYCVDGNTRILAYEFATMGSLHDMLHGRKGVKGAQPGPVLSWTQRVKIAVGAAKGLEYL

SEQ ID NO: 38932 - DNA, 1524 bp, Panicum virgatum
  misc_feature: Ceres CLONE 1996227
  misc_feature: Encodes the peptide sequence at SEQ ID NO. 38933
gggcagtttcgactttcgacttcttccagagttcgggcggcgaggttggaagggtggggaggaggcgtgagcgcgaggaaagtggggatggagaggcttccgatctcgattaccccggttgccgaatcgagaatctaattcggttccactcaaagcctcagatcggattccaacaccccaaattggcccccctgctttccccaaatcgatcgtctttggggattttgttttttttgggcgatttttttgggggcaccgatcggatcgggctgagttgagttgatcggggagcgatgcgaatcgaggagcttccgggcgattccggaggagggggcgggggagatgttggggaggagcttccgcagctgggtcgcggggattgcggcgccgcggtgggggagggtggggtggtgatgcgggtggccgtcgacgcgaagcgcgcggcagtgggcgtcggcgcgcggatgctgttctacccgacgctctgctacaacgtcgtgaggaatcggctcgagtcgcacttccactggtgggatcaggtcgacgagcatgttctgctaggtgctgttccattccctagcgatgttccccgtctaaaggagcttggagtttgtggtgtggtgacactgaatgagtcatatgagaggcttgttcccagatcgctatacgaggctcatggaattgaaaacctggtgctaccaacaagggattacctttatgcaccttcttttgtgaacctttgtgaagctgctgatttcatccacagaaatgctttatctgggaagttgacttatgtccactgcaaagctggtcgtggacgtagcactacggttgttatttgctacttggtgcaatataaaaatatgactcctgcagaagcttatgaacatgtccgcttgcgtcggcctagggtgttattagcttctgcacagtggcaagctgtgcaagaattctaccaacttagagtgaagaaaactgggaagtctatttgcctcgacaatcctatcatcaagccaccgttgttccttgcgtytcgcaaccttgttgcatttgatgacagcgcatttgtgatggtctcagaatcagacctagaagggtataatgcggatacgttggcgcttaatatgggcagtggattgtgggagataagcttaatataccgtgtgcagtttgctagcaaggcagcttttgctggtttttcatacctgtggcttcgatgtcgcgcctgcaaggaggctctacctgagaacgtggggagagagacttgctctcttgaggcagaacagatgacaactgggcatccctgtctactgcaaggtgtcgtggttaacccatgattgtctgagttctcttgtgtttttgcattgctcgtgtgcatattaaagagaaggacgtgcaatgtgggtcggtaactcgtgtctgcagcaaccaaagagtgaagttgctcgggtttgtatatatatcatgtaataagttgactgctacatgtatattatgttaaatgaaaggcgtctcaacttgctg

SEQ ID NO: 38933 - protein, 347 aa, Panicum virgatum
  misc_feature: Ceres CLONE 1996227
  misc_feature (82)..(223): Pfam Name: DSPc Pfam Description: Dual specificity phosphatase, catalytic domain
  misc_feature: SWISSPROT Homolog: EC 3.1.3.48 Protein-tyrosine-phosphatase
  misc_feature (247)..(247): Xaa is any aa, unknown, or other
MRIEELPGDSGGGGGGDVGEELPQLGRGDCGAAVGEGGVVMRVAVDAKRAAVGVGARMLFYPTLCYNVVRNRLESHFHWWDQVDEHVLLGAVPFPSDVPRLKELGVCGVVTLNESYERLVPRSLYEAHGIENLVLPTRDYLYAPSFVNLCEAADFIHRNALSGKLTYVHCKAGRGRSTTVVICYLVQYKNMTPAEAYEHVRLRRPRVLLASAQWQAVQEFYQLRVKKTGKSICLDNPIIKPPLFLAXRNLVAFDDSAFVMVSESDLEGYNADTLALNMGSGLWEISLIYRVQFASKAAFAGFSYLWLRCRACKEALPENVGRETCSLEAEQMTTGHPCLLQGVVVNP

SEQ ID NO: 38934 - DNA, 675 bp, Panicum virgatum
  misc_feature: Ceres CLONE 1996238
  misc_feature: Encodes the peptide sequence at SEQ ID NO. 38935
ccctttcccttctcgaaggccgaagcttctcgaccgcctccacctcctcctcccctcctcacatggccggcgacgcgaaggccgaggcggcgcaggcgaggccggagtcctcgcaggaggaggaggaggactggaaggaggccgagggggacgtcgccgaggtcgaccgcgccgcccccaatgtcgccggcgaggggcaggtgcccacggaccgcccgatccgggtctatgccgacggcatctacgacctcttccacttcggccacgccaagtcgctcgagcaggccaagaagctgtttccaaacacatatctacttgtcggatgctgcaatgatgagttgacgcacaaatacaaaggaagaactgtaatgactgaggatgagcgctatgagtcacttcgtcattgcaagtgggttgatgaagtcattcctgatgctccatgggtggtgtcagaagaattcttggataagcataacattgattttgttgctcatgattctctgccgtatgctgatgctagtggagctggtaaagatgtttatgaacatgtaaaaaaacttggtaagtttaaggagacccagcgcactgatggaatatcaacgtcggatattataatgcggattgttaaagattataatgagtatgttatgcggaatctggccaggggctacacta

SEQ ID NO: 38935 - protein, 204 aa, Panicum virgatum
  misc_feature: Ceres CLONE 1996238
  misc_feature (56)..(186): Pfam Name: CTP_transf_2 Pfam Description: Cytidylyltransferase
  misc_feature: SWISSPROT Homolog: EC 2.7.7.15 Choline-phosphate cytidylyltransferase
MAGDAKAEAAQARPESSQEEEEDWKEAEGDVAEVDRAAPNVAGEGQVPTDRPIRVYADGIYDLFHFGHAKSLEQAKKLFPNTYLLVGCCNDELTHKYKGRTVMTEDERYESLRHCKWVDEVIPDAPWVVSEEFLDKHNIDFVAHDSLPYADASGAGKDVYEHVKKLGKFKETQRTDGISTSDIIMRIVKDYNEYVMRNLARGYT

SEQ ID NO: 38936 - DNA, 694 bp, Panicum virgatum
  misc_feature: Ceres CLONE 1996248
  misc_feature: Encodes the peptide sequence at SEQ ID NO. 38937
gaaatctcaaatccatccatcccacaacccccccaccccgctccacgcctccactccactccactccatccccatcccccgatcctcgagcggcggcggccggcgatggcggcgagcaacatcggcatgatggacggcgcctacttcgtcgggcgcaacgagatcctcgcgtggatcaacaccacgctgcagctcggcctctccaaggtggaggaggcggcgtcgggcgcggttgcatgccagctgatggatgcggcgcacccgggggcggtgccgatgtacaaggtcaacttcgacgccaagacggagtacgacatgatccagaactacaaggtcctgcaggacgtgttcaacaagctcaagatcaccaagcacatagaggtgaacaaactcgtcaaaggaagaccccttgacaatttggagtttatgcagtggatgaaaagatactgcgattctgtcaatggtggcttcatgaccagctacaatgcttctgagagaagggaaagcagcaaaggtggaaaagaaaccaacagaagaacatcagtgccctctcacacgccggccaagtctacatctacaggacacaaggctcaatcttcatcacatggcgctaagcggggaagtgggcaagctgcgaatgcgccacaacgcagtgctaaaccatcaccagccaactctgggtggaccagcttat

SEQ ID NO: 38937 - protein, 196 aa, Panicum virgatum
  misc_feature: Ceres CLONE 1996248
  misc_feature (15)..(116): Pfam Name: CH Pfam Description: Calponin homology (CH) domain
MAASNIGMMDGAYFVGRNEILAWINTTLQLGLSKVEEAASGAVACQLMDAAHPGAVPMYKVNFDAKTEYDMIQNYKVLQDVFNKLKITKHIEVNKLVKGRPLDNLEFMQWMKRYCDSVNGGFMTSYNASERRESSKGGKETNRRTSVPSHTPAKSTSTGHKAQSSSHGAKRGSGQAANAPQRSAKPSPANSGWTSL

SEQ ID NO: 38938 - DNA, 727 bp, Panicum virgatum
  misc_feature: Ceres CLONE 1996254
  misc_feature: Encodes the peptide sequence at SEQ ID NO. 38939
acatgaccggcggcttctgctcgcgttcggcgccatttccgcgagtttaccgtacccgctccgctccgccccgccaataaatcctccccgaaattcctcgacggatcgatcttgatttctcgccgccgtccgcgcatctctgccaccgccgccaccacctgcctgtttgggaggttgccaggccgcgcgcccatggccgtcaccgtgtgcgtcaccggcgccggcggcttcatcgggtcttggatcgtcaagctcctcctcgaccgcgggtacgccgtccggggcacctcccgccgcgcagatgatcccaagaacgcgcacctctgggcgctcgacggcgcggcggagcgcctcacgatgctgcaggtggacctgctcgaccgggccagcctccgcgccgccttcgacggctgcgacggcgtcatccacaccgcctcgccgatgcacgacaaccccgaggagatcatcgagccaattatcgccgggacacggaacgtcgtggaggccgcggccgacgccggcgtgcggcgcctggtgatctcttccaccatcggcaccatgtacatgaacccgcaccgcgaccccgacgcgcccctggacgagtggagctggagcgacctcgagcactgcaagaagaccgcgaactggtactgctacgccaagacgatcgcggagcagagcgcgtgggaggcggcgcgggcgcgggggctggacctggcgggtggtc

SEQ ID NO: 38939 - protein, 178 aa, Panicum virgatum
  misc_feature: Ceres CLONE 1996254
  misc_feature (5)..(176): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature: Useful for making plants with altered carbohydrate content
  misc_feature: Useful for making plants with altered cell wall content and/or composition
  misc_feature: Useful for making plants with altered lignin content
MAVTVCVTGAGGFIGSWIVKLLLDRGYAVRGTSRRADDPKNAHLWALDGAAERLTMLQVDLLDRASLRAAFDGCDGVIHTASPMHDNPEEIIEPIIAGTRNVVEAAADAGVRRLVISSTIGTMYMNPHRDPDAPLDEWSWSDLEHCKKTANWYCYAKTIAEQSAWEAARARGLDLAGG

SEQ ID NO: 38940 - DNA, 727 bp, Panicum virgatum
  misc_feature: Ceres CLONE 1996259
  misc_feature: Encodes the peptide sequence at SEQ ID NO. 38941
atcagagcctccgtctctcctctcctctccgcctccgcctccaccccaccccaccccacacctccgcccgacccccgccgccgcaggcaggaaggaaggatggaggcccctggctccccctacgcctcctcgccggaatccgccccgaagcgcgccccacgctcccctccgcagcagcagcagcagccgccctccgaggaaggagatgacaaggacaagccaacacatttgaggttcctggtgtctaatactgcagcaggatgtattattggcaagggtggatcaaccatcaatgactttcagtcccagtctggggctcgtattcagttatcacgtagccatgagttcttccctggtacaaatgaccgaatcatcatggtttctggaatgtttgatgaagtaatgaaggccatggagctaattcttgagaaacttttggctgagggtgaagagttcaatgaagctgaagctagacctaaagttagacttgtagttcctaacagctcttgtggtgggataattggtaaaggtggatcaacaataaagtcttttattgaagaatcgcacgctggaatcaaaatttcgccacaggataacaactatgctggtttgcatgacaggcttgttactgtcacaggaacttttgataaccagatgaatgcaatagatttgatattgaagaagttatgtgaggatgttcattaccctccctaatttgagttcccca

SEQ ID NO: 38941 - protein, 204 aa, Panicum virgatum
  misc_feature: Ceres CLONE 1996259
  misc_feature (43)..(108): Pfam Name: KH_1 Pfam Description: KH domain
  misc_feature (127)..(192): Pfam Name: KH_1 Pfam Description: KH domain
MEAPGSPYASSPESAPKRAPRSPPQQQQQPPSEEGDDKDKPTHLRFLVSNTAAGCIIGKGGSTINDFQSQSGARIQLSRSHEFFPGTNDRIIMVSGMFDEVMKAMELILEKLLAEGEEFNEAEARPKVRLVVPNSSCGGIIGKGGSTIKSFIEESHAGIKISPQDNNYAGLHDRLVTVTGTFDNQMNAIDLILKKLCEDVHYPP

SEQ ID NO: 38942 - DNA, 524 bp, Panicum virgatum
  misc_feature: Ceres CLONE 1996278
  misc_feature: Encodes the peptide sequence at SEQ ID NO. 38943
cccgcacacaaatcctcttccatcgcttcatcctccaaattccaactcctccgagcggttgcggcgagcgaagcttccggttcggcgatgtcggggcgcggcaagggcggcaaggggctgggcaaaggcggcgccaagcgccaccgcaaggtgctccgcgacaacatccagggcatcaccaagccggccatccggaggctggccaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcatctacgccctcaagcaccagggccgcaccctttacggcttcggcggctagatcggttcagcttctggtggcgaaggcgaactatatgtggtggggtctggggtgtgtcacggtttaatgtagtcagggctctctgtctcgacgctgtgtcatggtggttgtagtctatctactct

SEQ ID NO: 38943 - protein, 103 aa, Panicum virgatum
  misc_feature: Ceres CLONE 1996278
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVIYALKHQGRTLYGFGG

SEQ ID NO: 38944 - DNA, 1449 bp, Panicum virgatum
  misc_feature: Ceres CLONE 1996280
  misc_feature: Encodes the peptide sequence at SEQ ID NO. 38945
accctcaaacagcgcctcctcttcgccctccgcgcggccgcctcccttcaccgcctctccttatccaccaccgccgccgccacatcgcccgtcggattcctcgccgaggagtacctcgtctccagctgcggcctcaaggcagcgcaggcccggaaggtctccaagtacctctcccacctcaggtcccccgtcaagccagacgccgtgcgcgccttcctcgcgggcatcggcctcgccgaagccgacgtcgccgcggcggtcgccagctacccgttgctcctcagcgccaaggtggacacaaccctaatcccccgcatcggccagctccgcgaaatcggcctctcgcctccccagatctcccgtctaatcgccgtcacgcctgaagtcttatttagccccgtcaagatttcccggctcgcgttctacctctcgtttttgggatccttcgacagggtgcactccgccctaaacaggagcagctacctcctccgttcagaccttgagactgttgtcaggcccaacatagcattcctgcaccagtgtggcctaactgacgatgatattggcaagcactttttaatgaagtcgaggatgctcctaacgcagccacagcatctgaaggaaattgcagcgcgtgctgaggagctcggcgttccacgcaattctgtgatgttcaagaacgtcatgcctgccatctacagcttaaatgctggaaggctcaatgcgaagctcagtttcctgaagaaggttgttggatgctctgaggccgagctgggcaatctgatgcgcaagatgccgacagttctaacacgttcagagagtaagatagggcgcatactggagtttctgaaggtggaggttggattggaaccttcatacgtcttgcagagaccagcaatcctcggttatagcatagagaagcggctaatgccccggcattgtgtcttaaggattctgaaggcaaaggggtttctgagcaaagagattgacttttacacagcagtttgtccagcggaggagagagaccaaatggccactgaactataactgtgagatgctgaactagaactgttggatatcaattctgccttgcaagttggtatatgttgatgcagtaagatgttacatctctttcgctttagacaggatatctggttatcagagtactcattctgttatcatgcttgcatgctgatatctctgaggcgtttgaaagaactaagtttgattccctgctaagttattatatgcctgccaaatcatagatgtgaacttgctgctgaatagactgtagtatgcagtcaatatgccttatgaacttcgattttcgaaatgtaacactgctcattgatatcagttcggtagaaatatccttcttttttcactttcttatttgtaatggatactggttccgtttatttatttatatataaccaatagggttttgcc

SEQ ID NO: 38945 - protein, 348 aa, Panicum virgatum
  misc_feature: Ceres CLONE 1996280
  misc_feature (37)..(347): Pfam Name: mTERF Pfam Description: mTERF
TLKQRLLFALRAAASLHRLSLSTTAAATSPVGFLAEEYLVSSCGLKAAQARKVSKYLSHLRSPVKPDAVRAFLAGIGLAEADVAAAVASYPLLLSAKVDTTLIPRIGQLREIGLSPPQISRLIAVTPEVLFSPVKISRLAFYLSFLGSFDRVHSALNRSSYLLRSDLETVVRPNIAFLHQCGLTDDDIGKHFLMKSRMLLTQPQHLKEIAARAEELGVPRNSVMFKNVMPAIYSLNAGRLNAKLSFLKKVVGCSEAELGNLMRKMPTVLTRSESKIGRILEFLKVEVGLEPSYVLQRPAILGYSIEKRLMPRHCVLRILKAKGFLSKEIDFYTAVCPAEERDQMATEL

SEQ ID NO: 38946 - DNA, 671 bp, Panicum virgatum
  misc_feature: Ceres CLONE 1996298
  misc_feature: Encodes the peptide sequence at SEQ ID NO. 38947
cccgccccaccaacactcccaccatctctccactcgtccacagccgaatccgcctcccacccagcccaccaacgttccagtgagttcgagcgaggtaagctttagatctgagcgagttctcgcgcgtcgcaggtaaagttcactcccgaccctcctcttcctccccttccttttgttttcttggtcttggtttcgtcttcatcgagcagactgcgggagacccggggccttttcgatcctgggcttcagatctgccatttcttcttcttccgtttgggtttcctgtagcagtctaagttgctagttcggtagccaagaggggttctttttccacacctcccttgtgcaagttcgtgtgcagatctgccaccagaggccacctgtttttactgcggccgctgggttctgcctgatttgttcttggttttgctagagagaaaaaaaacaaaaaaaagtttgtttcttcagatctgctagtctagatggctgccgctatagatctgtccggggaggagctgatgagagcactcgagccttttatccgggatgcctctgctcctcacaaatccagtccgcttctccagcaccaccaccctctgagccccactctgcccttctccttccaccacgccgccgccgccgcctacggcgggtacccgttcttcgccggg

SEQ ID NO: 38947 - protein, 62 aa, Panicum virgatum
  misc_feature: Ceres CLONE 1996298
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
MAAAIDLSGEELMRALEPFIRDASAPHKSSPLLQHHHPLSPTLPFSFHHAAAAAYGGYPFFA

SEQ ID NO: 38948 - DNA, 623 bp, Panicum virgatum
  misc_feature: Ceres CLONE 1996298-R
  misc_feature: Encodes the peptide sequence at SEQ ID NO. 38949
ccgcctcccccgagtcggcggtgccggagatgcagcagctggacttcagcgaggcgccgtgggacgaggccgccggcttcgccctcaccaagtacccgtcgtacgagatcgactgggactccctcctcgccgccaattgaccaccttcttggctccttcatactactactactacagcagcagaggcttaacggccgttgcgcagatggtatttttgacatctcgcgcgggcactagtggattattagctctaatcccgttcgttgtgtagaaatgtttcaggattcgtttttggtgttggtgtcagtcagttgtagatccgtgttagggtctggttcccggatgggagaaccagccgatgggaggccggcgtttttgtgtccggcgtcttcccggtggtcggtcggtcactggtcagtggctccggccggtcaggtgtccattgttgtagctttgtttcttggtaggtggtgctgctgctcctgctgtttttacgggttgtaagaacagcggagcatgatgtgatattattatttgtatggtgtaaaatcagctcgctgtgtcgagcgcctgtaatctgatgaactgctattggtagtgctataattatattatctggttgc

SEQ ID NO: 38949 - protein, 45 aa, Panicum virgatum
  misc_feature: Ceres CLONE 1996298-R
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
  misc_feature: The sequence is a functional homolog of SEQ ID NO 1288 in the 10/374,780 US patent application
  misc_feature: The sequence is a functional homolog of SEQ ID NO 1434 in the 10/412,699 US patent application
  misc_feature: The sequence is a functional homolog of SEQ ID NO 1289 in the 10/374,780 US patent application
  misc_feature: The sequence is a functional homolog of SEQ ID NO 1435 in the 10/412,699 US patent application
  misc_feature: The sequence is a functional homolog of SEQ ID NO 116 in the 11/479,226 US patent application
  misc_feature: The sequence is a functional homolog of SEQ ID NO 1712 in the 10/412,699 US patent application
  misc_feature: The sequence is a functional homolog of SEQ ID NO 1948 in the 10/374,780 US patent application
  misc_feature: The sequence is a functional homolog of SEQ ID NO 256 in the 11/375,241 US patent application
  misc_feature: The sequence is a functional homolog of SEQ ID NO 6 in the 10/412,699 US patent application
  misc_feature: The sequence is a functional homolog of SEQ ID NO 722 in the 10/225,066 US patent application
  misc_feature: The sequence is a functional homolog of SEQ ID NO 906 in the 11/435,388 US patent application
ASPESAVPEMQQLDFSEAPWDEAAGFALTKYPSYEIDWDSLLAAN

SEQ ID NO: 38950 - DNA, 696 bp, Panicum virgatum
  misc_feature: Ceres CLONE 1996319
  misc_feature: Encodes the peptide sequence at SEQ ID NO. 38951
agacgcagccgccacaaacccggagagagctagagctgcgacgcgccgtcccctgcgcctcctcctccccttgctcagccatgggtaaggagaagacccacatcaacatcgtggtcattggccatgtcgactctggcaagtcaaccaccaccggccacctgatctacaagcttggaggtatcgacaagcgtgtgatcgagaggttcgagaaggaggccgctgagatgaacaagaggtccttcaagtatgcgtgggtgcttgacaagctcaaggctgagcgtgagagaggtatcaccattgatattgccctgtggaagtttgagaccaccaagtactactgcacggtcattgatgcccctggacaccgtgacttcatcaagaacatgatcacgggtacctcccaggctgactgtgctgtccttatcattgattccaccaccggtggttttgaggctggtatctccaaggatggacagacccgtgagcatgctctccttgctttcactcttggagtcaagcagatgatctgctgctgcaacaagatggatgccaccactcccaagtactcgaaggcccgttatgatgagatcgttaaggaagtctcctcctacctgaagaaggtgggctacaaccctgacaagattgcattcgtccccatctctggttttgagggtgacaacatgattgagaggtcca

SEQ ID NO: 38951 - protein, 205 aa, Panicum virgatum
  misc_feature: Ceres CLONE 1996319
  misc_feature (5)..(205): Pfam Name: GTP_EFTU Pfam Description: Elongation factor Tu GTP binding domain
  misc_feature: SWISSPROT Homolog: EC 2.7.7.4 Sulfate adenylyltransferase
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERS

SEQ ID NO: 38952 - DNA, 674 bp, Panicum virgatum
  misc_feature: Ceres CLONE 1996323
  misc_feature: Encodes the peptide sequence at SEQ ID NO. 38953
atcatcagtcatcttccttgataccgttgcatacagctactatactcccaaagttagagttagagacgatggcaaccacactagccacactacgtgagatccggcgtacgcagcgtgctgatggcccagcagccatgctcgctattggcaccgcaaatccaacaaactgcgtgcttcaggaggagtttcccgactactattttcgtgtcacaaacaaggagcacctcaccgacctcaaagaaacattcaagaaactatgtcggatcacggggctggagaaacgtttctttcaccacacggaggaagtgctcaacgcccacccgggcttgcttgacgggacgtcctcggccttggacgcgcggcttgacatcgtcgccaaggcagctccagagctcgccgcgtcggccgccgccaaggccatagcgagatggggccgcccggccaccgacatcacccacctaatcgtcagcaccaactccgaagcccgctcaccaggcgcagacctcgggctggccacactcctcggcctccgccccgatgtctgccgtaccgtgctccagctcaacggctgcgcggccggctgcaccgcccttcgcctggccaaggacctcgccgagaacaaccgcggcgcgcgtgtgctcgtggtctgcgtcgagctcaccatcaccaccttt

SEQ ID NO: 38953 - protein, 201 aa, Panicum virgatum
  misc_feature: Ceres CLONE 1996323
  misc_feature (6)..(201): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature: The sequence is a functional homolog of SEQ ID NO 2 in US patent 7202397
MATTLATLREIRRTQRADGPAAMLAIGTANPTNCVLQEEFPDYYFRVTNKEHLTDLKETFKKLCRITGLEKRFFHHTEEVLNAHPGLLDGTSSALDARLDIVAKAAPELAASAAAKAIARWGRPATDITHLIVSTNSEARSPGADLGLATLLGLRPDVCRTVLQLNGCAAGCTALRLAKDLAENNRGARVLVVCVELTITT

SEQ ID NO: 38954 - DNA, 654 bp, Panicum virgatum
  misc_feature: Ceres CLONE 1996342
  misc_feature: Encodes the peptide sequence at SEQ ID NO. 38955
atcgctccgtctccctctccaccacagcaggctagctagggttttctgggatttgcgagggggttgctccggtccggcgggaggggggagatggcggcggagcgggctcaggggacggtgaagtggttcaacgggaccaaggggttcggcttcatcagccccgacgacggcggccaggacctcttcgtccaccactcctccgtcaaggccgacggcttccccaacctcaaggacggtgacgccgtcgagttcaccgtcggcgccgacagcgacggccgcgccaaggccatcgacgtctccgcgcccggcggcggcgcgctcgccggcggggagcgcccggacaacggctacggcggacgcggtggcggcggctgcggcggctacggcggcggaggcgaccgcggctacgggggaggcggcgaccgcggctacggcggaggcggcgaccgcggctacggtggaggaggtgaccgcggctacggcggaggcggcggcgaccgcggctacgggggaggaggtggctacggaggaggcggcgaccgtggctacggcggcggcggcggaggcggccgcggctccgggtgctacaagtgcggcgaggagggccacatcgcacgggactgctcccagggcggcggcggcggctacggcggt

SEQ ID NO: 38955 - protein, 187 aa, Panicum virgatum
  misc_feature: Ceres CLONE 1996342
  misc_feature (5)..(72): Pfam Name: CSD Pfam Description: 'Cold-shock' DNA-binding domain
  misc_feature (163)..(180): Pfam Name: zf-CCHC Pfam Description: Zinc knuckle
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
MAAERAQGTVKWFNGTKGFGFISPDDGGQDLFVHHSSVKADGFPNLKDGDAVEFTVGADSDGRAKAIDVSAPGGGALAGGERPDNGYGGRGGGGCGGYGGGGDRGYGGGGDRGYGGGGDRGYGGGGDRGYGGGGGDRGYGGGGGYGGGGDRGYGGGGGGGRGSGCYKCGEEGHIARDCSQGGGGGYG

SEQ ID NO: 38956 - DNA, 1510 bp, Panicum virgatum
  misc_feature: Ceres CLONE 1996343
  misc_feature: Encodes the peptide sequence at SEQ ID NO. 38957
acctgtatcgttggctccgtctagggttttagcccctgccgccgcaacccaacctcccgtcccctgcctctgcccctgccgccgcaacctcctcctccccctatcgaatcccgtgcccccgcgacccgccgggcgacgagcgcctgcgccggcggccgagatggaccggtaccagagggtggagcggccgcggaccgagtcggcggccatcgaggagaacgagatccgcatcaccgcgcagggcctcatccgcaactatgtctcctacgccacctccctcctccaggagcggagaattaaagagattgttttgaaggccatgggacaggcaatcagtaagtctgttgctgttgcagagattatcaagaaaagaattcctggtttacatcaggataccaatatcagttctgtcagcatcactgatgtttgggaacctatagaagaaggccttgtcccgcttgagatgactcggcatgtctcgatgatttcaattactttgtctcctggagagttggataagagtactcctgggtaccaagcacctgcttacgttgaacagcccaggcaaccgcagcgcctccagcaggcaccactgccgcagcgccaacctcgccgagcacaaggccagttccagcagcctgagtacgaagactcctatgctcggggtcgaggtagaggaagaggccgtggacgtggaaggggttggggtagaggaggctatggtggttatggtggatatggaaacaaccaaggtgggtacaatcagggtggcggttattatgataatcaaggtgggtatggcggctatgataatcaaggtgggtatggaggctatgataatcaaggtgggtatggtggtggatatggctacaaccaaggcagatatggaaactaccaagaaaatggtgggtatagccgaggacgaggtggtggcatgcgcggaagaggcaactggggctaccgtggaggctatgatggaggcaggggcggtggctatgaaggaggyaggggtggaggctatgagcaaggcaggggcggtggctacgagggtggcaggggtgggggctatgaaggaggcaggggtgggggtggaaggggctatggtggtcgtggaaggggaagaatgggtggccgtgggcgagggaactgagcgcagacgcaaaatccatgggcttcgggtgtttcttcaatgcatgctttataatcaggggaaaagataagttatctgagaatttgtgttggaagccgtcagttatgtgaggtctgttgttttccctgagctcgaggtttggttgtgagcataatgcatttacaagtttaatcatgttgtcatctttcaatatttctgctgccgaggttgcttgttttcccaatggtctttaaatgctgagcatgctgcctaatgttcatgcccgcagtatcaacagatggaaactcttcccctgtgttaaattgttcattctatttgtgcaattttgcttaaattaatgtattcatgatagttgatacc

SEQ ID NO: 38957 - protein, 329 aa, Panicum virgatum
  misc_feature: Ceres CLONE 1996343
  misc_feature (18)..(88): Pfam Name: Alba Pfam Description: Alba
  misc_feature: SWISSPROT Homolog: EC 3.1.26.5 Ribonuclease P
  misc_feature: Useful for making plants with modulated nitrogen use efficiency
  misc_feature: Useful for making plants with altered alkaloid content
  misc_feature: Useful for making plants with altered lignin content
  misc_feature: Useful for making plants with modulated phosphate use efficiency
MDRYQRVERPRTESAAIEENEIRITAQGLIRNYVSYATSLLQERRIKEIVLKAMGQAISKSVAVAEIIKKRIPGLHQDTNISSVSITDVWEPIEEGLVPLEMTRHVSMISITLSPGELDKSTPGYQAPAYVEQPRQPQRLQQAPLPQRQPRRAQGQFQQPEYEDSYARGRGRGRGRGRGRGWGRGGYGGYGGYGNNQGGYNQGGGYYDNQGGYGGYDNQGGYGGYDNQGGYGGGYGYNQGRYGNYQENGGYSRGRGGGMRGRGNWGYRGGYDGGRGGGYEGGRGGGYEQGRGGGYEGGRGGGYEGGRGGGGRGYGGRGRGRMGGRGRGN

SEQ ID NO: 38958 - DNA, 742 bp, Panicum virgatum
  misc_feature: Ceres CLONE 1996352
  misc_feature: Encodes the peptide sequence at SEQ ID NO. 38959
acacttccattccacacactcgagactcgagagctagccaggcagccagcttcccgcagcgcacgagctgggctgagcctgagaggcaccgccgccgccgccgccgccgccgccaccaccagggataggatgatggcgcccaccgcctcatcattcctcgccgtcttcctgctcgtggcggcggccgcgtcgacgccggcgcggtcgtgcgcaccgagcgacctgcgcgcgctgctgagcatgaagcaggcgctgggcaacccggcgacgctgtcgtcgtggagcccgtcgtcgcccaactgctgcgcgtgggaccacctccggtgcgacgacgccgggcgcgtgaacaacgtgttcatcgacggcgccgccgacgtgcacgggcagatcccgtcggcggtggcggggctgacggcgctcatgtcgctgtccctgttccgcctgccggggctcacgggcgccatcccgccctgcctcgcggggctctccaacctgcagttcctcaccatctcccacaccaacgtgtcgggccccatcccggaggccctggcgcggctccgcaccctggactcggtcgacctctccagcaacaagctgtgcggccgcatcccggcggcgttcgccgacctgcccaacctccggtcgctggacctccagcacaaccagctgacgggccccatcccggcggggctcgtgcaggggcagttccggtcgctgatcctgtcctacaaccagctgagcg

SEQ ID NO: 38959 - protein, 203 aa, Panicum virgatum
  misc_feature: Ceres CLONE 1996352
  misc_feature (27)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MAPTASSFLAVFLLVAAAASTPARSCAPSDLRALLSMKQALGNPATLSSWSPSSPNCCAWDHLRCDDAGRVNNVFIDGAADVHGQIPSAVAGLTALMSLSLFRLPGLTGAIPPCLAGLSNLQFLTISHTNVSGPIPEALARLRTLDSVDLSSNKLCGRIPAAFADLPNLRSLDLQHNQLTGPIPAGLVQGQFRSLILSYNQLS

SEQ ID NO: 38960 - DNA, 1263 bp, Panicum virgatum
  misc_feature: Ceres CLONE 1996362
  misc_feature: Encodes the peptide sequence at SEQ ID NO. 38961
agggtgctggccgtcgtcgcctctttctttccgccgcggcagccgcagcggcgatctccatctcctcctcgcaccccacctcagcctcgctcctccagccctcctcctcgtcccctccgtccgcgggagcctaacggggccaacaccaaagagttggttgtgtcttcaagctgaggagtgaggaacaatgccgccgcataagattgagactgggcatcaagatgtggtgcatgatatcgccatggattactatgggaagcgtcttgctacagcctcctctgacaacacgataaagatcattggcgtaagtggcacatcgcatcagcagcttgcaactttgagtggacaccggggcccagtttggcaagttgcatgggcacatcctaagtttggttccatgcttgcatcctgcagctatgatggccaggttatcatctggaaagaagggagcaagcccgacgaatgggcacaggtacacacctttgttgagcacaagtcttcagtgaattccatcgcatgggcgcctcatgagctgggtctcagcttggcatgcggttcatctgatgggaacatttcagtcttcactgctcgttctgatggaggttgggacacaacacgcattgatcaggcgcatccagtaggagtgacctcagtctcttgggctcctgcaatggcaccaggtgctctaatcagtgcaggaccttctggccagtatgaatatgttcagaaactcacgtctggtggatgcgacaacactgtcaaggtgtggaagctcaccaacggaagctggaggatggattgtttccctgcactgcagatgcacaaggactgggtgagagatgttgcgtgggcgccaaatcttggcctcccaaagtccaccatcgcgagcgcctctcaggatggaacagtggtcatctggacatcagcgaaagaaggtgagcagtgggaaggtcggatcctgtatgatttcagaacccctgtgtggaggctgtcgtggtcgctgaccgggaatatactggcggtgtctgatggcaacaacaatgtgaccctgtggaaggaagctgtggatggtgagtggcagcaagttactactgttgagccgtagatttcttgagctcttctctcatatattattgccataatgtagttttcctgtaagtggagtctatggctgttcacagtagtagttagcaaggcagacatggtgtgagagatggttttggctgggaccaaagtgataaattgagttcttatatctggatc

SEQ ID NO: 38961 - protein, 305 aa, Panicum virgatum
  misc_feature: Ceres CLONE 1996362
  misc_feature (45)..(85): Pfam Name: WD40 Pfam Description: WD domain, G-beta repeat
  misc_feature (203)..(245): Pfam Name: WD40 Pfam Description: WD domain, G-beta repeat
  misc_feature (140)..(195): Pfam Name: WD40 Pfam Description: WD domain, G-beta repeat
  misc_feature (93)..(133): Pfam Name: WD40 Pfam Description: WD domain, G-beta repeat
  misc_feature (1)..(39): Pfam Name: WD40 Pfam Description: WD domain, G-beta repeat
  misc_feature: SWISSPROT Homolog: EC 2.3.1.48 Histone acetyltransferase
MPPHKIETGHQDVVHDIAMDYYGKRLATASSDNTIKIIGVSGTSHQQLATLSGHRGPVWQVAWAHPKFGSMLASCSYDGQVIIWKEGSKPDEWAQVHTFVEHKSSVNSIAWAPHELGLSLACGSSDGNISVFTARSDGGWDTTRIDQAHPVGVTSVSWAPAMAPGALISAGPSGQYEYVQKLTSGGCDNTVKVWKLTNGSWRMDCFPALQMHKDWVRDVAWAPNLGLPKSTIASASQDGTVVIWTSAKEGEQWEGRILYDFRTPVWRLSWSLTGNILAVSDGNNNVTLWKEAVDGEWQQVTTVEP

SEQ ID NO: 38962 - DNA, 1861 bp, Panicum virgatum
  misc_feature: Ceres CLONE 1996373
  misc_feature: Encodes the peptide sequence at SEQ ID NO. 38963
gatttgcaaagggcctccaaaccctagctccctcaatccccatctccacccccaccgagatccgatctctcttgccgccgccgtcgccgccatggcctccggcggcaaccccaaccccaccggcgccccgccccaatcgcgtcccccgcatccccagcagcagcagccgccgggcggctccccggcgacgcccatgacccacctccgcccaccctccctcgccggctccccgttccagggcgtcttccacacgccgccgtcccacaaccccgccttccagatccacatgggcgcctcctcgccccagaccccgctcatggcggccgccgccgctgtcgcggcgcaatcggccaagcgccccccgcagaagccccccgtgcgccccccggctcccgggtctacctcggccgctgcggcggcttcggcagctgccgcgtacaaggctgctgcggcggcggcggccgtggcgaactccggaggtgtcgacctcacccccgccgcgcgacgcaacaagaaacggaagctcccggagaagcagctgccggaccgcgtcgccgcgctgttcccggagtcggcgctctacacgcagctgctcgagttcgaggcccgcgtggacgcggcgctggcgcggaagatggtggacatccaggaggccctcaagacgccgccctcgctccagcgcacgctccgcatctatgtcttcaacaccttcgccaaccagggcccgcgcaccatcccgccgcccaagaacgccgacccgcccacctggtcgctcaagatcatcggccgggtgctcgaggatggcgccgagctggaccctgccagcgtcgtgcccaagcacaacccggtgtacccgaagttctcccagttcttcaagagggtgaccattgcgctggacccacagctgtaccctgaaaacccattgatcatctgggaaaatgcgcgttctgccgcccagcaggaagggttcgaggtgaagaggaaaggggataaggagtttgttgcgaacatccgcctggagatgaactacaaccctgagaagtttaagctgtcacagccgatgatggaggtgcttggggttgaggtggacactcgcgcgcgggtgattgctgccctgtggcagtacatcaaggcgaagaagcttcagaacccaaacgacccttccttcttcatgtgcgaccctcaattgaagaaggtgtttggggaggataagcttaagtttgcgatgctgtcacagaagatatcgcagcatctgactgccccaccgccaatcaacttggaacacaagattaagctatcaggcaatggagcttctggaagtgcttgctatgatgtgctggtggatgtgcccttccccctgcagaaggagatgatggcattccttgccaacacggagaagcacaaggacattgaggcctgcgatgatgtgatatccgcctcgatcaagaagatccatgagcaccgcaggaggagggctttcttcctgggtttcagtcagtccccagtggagttcatcaacgccctgatagcttctcagagcaaagatttgaagctggtcgctggcgaagcgaataggaacattgataaggaaagacgtgcagacttctacaaccaaccatgggttgaggatgctgttataagatacctgaatcgcaagccagctaatgagggcccaggtggtggtgctggtggttcttgaggataggatttcctctagtgcccttttggtgtagaaacaaattatcttttatgtattagtagtaaaatccagtggtgttagcgaggagatttgttcaatgttgtgaaagaatgttcgggctagtcactgtatgttgtgttctatattgcctaactattgtgg

SEQ ID NO: 38963 - protein, 535 aa, Panicum virgatum
  misc_feature: Ceres CLONE 1996373
  misc_feature (314)..(389): Pfam Name: SWIB Pfam Description: SWIB/MDM2 domain
MASGGNPNPTGAPPQSRPPHPQQQQPPGGSPATPMTHLRPPSLAGSPFQGVFHTPPSHNPAFQIHMGASSPQTPLMAAAAAVAAQSAKRPPQKPPVRPPAPGSTSAAAAASAAAAYKAAAAAAAVANSGGVDLTPAARRNKKRKLPEKQLPDRVAALFPESALYTQLLEFEARVDAALARKMVDIQEALKTPPSLQRTLRIYVFNTFANQGPRTIPPPKNADPPTWSLKIIGRVLEDGAELDPASVVPKHNPVYPKFSQFFKRVTIALDPQLYPENPLIIWENARSAAQQEGFEVKRKGDKEFVANIRLEMNYNPEKFKLSQPMMEVLGVEVDTRARVIAALWQYIKAKKLQNPNDPSFFMCDPQLKKVFGEDKLKFAMLSQKISQHLTAPPPINLEHKIKLSGNGASGSACYDVLVDVPFPLQKEMMAFLANTEKHKDIEACDDVISASIKKIHEHRRRRAFFLGFSQSPVEFINALIASQSKDLKLVAGEANRNIDKERRADFYNQPWVEDAVIRYLNRKPANEGPGGGAGGS

SEQ ID NO: 38964 - DNA, 691 bp, Panicum virgatum
  misc_feature: Ceres CLONE 1996376
  misc_feature: Encodes the peptide sequence at SEQ ID NO. 38965
aaaccaggtcagccacgctcaccggaacgacgcaactattctccacccgttccccaagcaccagcggcgccaccacgccaccacccatggctctggcggcggcgagatccggcctccggtcgctggcggcgcgcgccgcgccggccaggcgccgcatgtcctcctccgcccacgacgacgcctatgagacggccaagtgggagaagatcacctacgccgggatcgtgacctgcaccctcctggcggcgtacaacctctccaagggccacccccatttcgacgagccgccggcgtacccatatctgcacatccgcaacaaggagttcccctggggacctgatggcctctttgagaagaaggaccaccattaagcatgaataacaacacactgtcaggagtcatgcacgtcttaaagattatctggttgttccagtgtttttcttttctattgaaacctgtttgctgcaacaagaaataagaatgacaaaactcctgtgttgactgtcaggtcttaactgtgtcgttagctgaacaatacctgtctttgttttctttgctgtcccatccgcattaaagatcacacgcaagtttgtcttgcctagtttcaggaaaccatgtcactgttatcaaaaagcttgctattataagcaaattagcaaagcttgtcctcttctcttctcaagccaaggcg

SEQ ID NO: 38965 - protein, 94 aa, Panicum virgatum
  misc_feature: Ceres CLONE 1996376
  misc_feature (24)..(94): Pfam Name: COX6A Pfam Description: Cytochrome c oxidase subunit VIa
  misc_feature: SWISSPROT Homolog: EC 1.9.3.1 Cytochrome-c oxidase
MALAAARSGLRSLAARAAPARRRMSSSAHDDAYETAKWEKITYAGIVTCTLLAAYNLSKGHPHFDEPPAYPYLHIRNKEFPWGPDGLFEKKDHH

SEQ ID NO: 38966 - DNA, 651 bp, Panicum virgatum
  misc_feature: Ceres CLONE 1996378
  misc_feature: Encodes the peptide sequence at SEQ ID NO. 38967
ctcgagcctttcgcccaacccattccattccccaatccgaccaaaccctagaagccatagattttcgatcggagatttggcatggcaatgtcagatcccccagccgccgtgatccccaagcccgacggcatcggcgacgacgacgagtcggtggagatccgggaggtgtgggcggacaacctcgaggaggagttcgccctgattcgtgacatcgtcgacgagttccctttcgtcgcgatggacacggagttcccgggcattgtctgccgccccgtcggcgccttccgctccccggcggactacaactacgccaccctcaaggccaacgtcgacatgctccacctcatccagctcggcctcaccttctcaggcccgcgcggcgagctgccggccctcggtgccggccgccgccgctgcgtctggcagttcaacttccgcgagttcgacgacgcgcgcgacatcttcgcatccgactccatcgagctgctccgtcgcagcggcatcgacttccgccgaaatgccgagcgcggcgtcgatgcgcgccggttcgcggagctcctcatgtcatccggcgtcgtgctcaacgattcggtatactgggttaccttccacgcgggatacgactttgggtacctcctcaagatcctcact

SEQ ID NO: 38967 - protein, 189 aa, Panicum virgatum
  misc_feature: Ceres CLONE 1996378
  misc_feature (27)..(189): Pfam Name: CAF1 Pfam Description: CAF1 family ribonuclease
  misc_feature: SWISSPROT Homolog: EC 3.1.13.4 Poly(A)-specific ribonuclease
MAMSDPPAAVIPKPDGIGDDDESVEIREVWADNLEEEFALIRDIVDEFPFVAMDTEFPGIVCRPVGAFRSPADYNYATLKANVDMLHLIQLGLTFSGPRGELPALGAGRRRCVWQFNFREFDDARDIFASDSIELLRRSGIDFRRNAERGVDARRFAELLMSSGVVLNDSVYWVTFHAGYDFGYLLKIL

SEQ ID NO: 38968 - DNA, 765 bp, Panicum virgatum
  misc_feature: Ceres CLONE 1996379
  misc_feature: Encodes the peptide sequence at SEQ ID NO. 38969
acacccgcgcgcgtacgtgatcgagcgctacccaacccaccagagagatcgaccgagccccccgggccgcagcaccagcaccagcggaaagcggcaggatgtcgtggcagacgtacgtcgacgagcacctcatgtgcgagatcgagggccaccacctcacctccgccgccatcatcggccacgacggcaccgtctgggctcagagcgccgccttcccgtcgttcaagcctgaggagatgtccaacatcatgaaggacttcgacgagcccgggttcctggccccgaccggcctcttcctcggccccaccaagtacatggtcatccaaggcgagcccggcgccgtcatccgcgggaagaagggatctggaggcatcaccgtgaagaagaccgggcaggccctcgtgatcggcatctacgacgagcccatgacccccgggcagtgcaacatggtggtcgagaggctcggcgactacctcgtagagcaaagcctgtaaaaacgggctcgtcggcttcggctcgtccacggttgaagaagaagaagcccaagcaacaatacgaccgccagccagcacgtagtagcctgtgtctacgcacgcgtttttagtccccccaccccaccacgcctcctgggattgtgcgtggctcgatccgtcacccttacctccggcatttcttcccatgccccgtcgtcgccgatcaccagaggatcttttctttcattgattttgttggtgtcgttttggcaaataattttgtgattttcct

SEQ ID NO: 38969 - protein, 131 aa, Panicum virgatum
  misc_feature: Ceres CLONE 1996379
  misc_feature (2)..(126): Pfam Name: Profilin Pfam Description: Profilin
  misc_feature: Useful for biocontainment applications
  misc_feature: Useful for making plants with modulated biomass
MSWQTYVDEHLMCEIEGHHLTSAAIIGHDGTVWAQSAAFPSFKPEEMSNIMKDFDEPGFLAPTGLFLGPTKYMVIQGEPGAVIRGKKGSGGITVKKTGQALVIGIYDEPMTPGQCNMVVERLGDYLVEQSL

SEQ ID NO: 38970 - DNA, 667 bp, Panicum virgatum
  misc_feature: Ceres CLONE 1996383
  misc_feature: Encodes the peptide sequence at SEQ ID NO. 38971
ctgacacgcccgcacactccacacccaccgcgaggggccaggcgctggtgcccggcgtgatgatcttcggcgactcggtggtggacgccggcaacaacaaccggctggccacgctggtgcgcgccgacttcccgccctacggccgcgacttcccggcgacgcacgcgcccacggggcgcttctgcaacggcaagctcgccacggactacaccgtggagaacctggggctgagctcgtacccgccggcgtacctgagcgaggaggcgcagagcaacaacaagagcctcctccacggcgccaacttcgcctccggcgccgccggctaccttgacgccaccgccgcgctctacggcgcgatctcgctgagccggcaggcggactacttccgggagtaccagtcgcgggtggcggcgtcggccggcgagcagcgcgccaaggcgctgacgtcggggtccatctacgtggtgagcgccggcaccagcgactacgtgcagaactactacgtgaacccggtgctgggcgccgcctacgcgcccgaccagttcgccgacgcgctcatgcagccattcacctccttcgtcgaggtaacgactgcaaattttttttttctcgaattcaatcactcgcttatgttaggaccacatgtcagcgacgtgagtaacgactg

SEQ ID NO: 38971 - protein, 221 aa, Panicum virgatum
  misc_feature: Ceres CLONE 1996383
  misc_feature (19)..(219): Pfam Name: Lipase_GDSL Pfam Description: GDSL-like Lipase/Acylhydrolase
  misc_feature: SWISSPROT Homolog: EC 3.2.1.51 Alpha-L-fucosidase
DTPAHSTPTARGQALVPGVMIFGDSVVDAGNNNRLATLVRADFPPYGRDFPATHAPTGRFCNGKLATDYTVENLGLSSYPPAYLSEEAQSNNKSLLHGANFASGAAGYLDATAALYGAISLSRQADYFREYQSRVAASAGEQRAKALTSGSIYVVSAGTSDYVQNYYVNPVLGAAYAPDQFADALMQPFTSFVEVTTANFFFLEFNHSLMLGPHVSDVSND

SEQ ID NO: 38972 - DNA, 1497 bp, Panicum virgatum
  misc_feature: Ceres CLONE 1996391
  misc_feature: Encodes the peptide sequence at SEQ ID NO. 38973
attagcttcttgctgtccgtcagcgtgtccccttcaaatctttcgtgtccacttctacttgctgcctccatatatcatccaataataataacctatcagtccgtcgatcgtcgtctcctcgatcccatccatggccgccgcgagcttcgacggcgacgtcccgcggcacggcggggcggccgggaccggcccactcggcgtgcacgcggcgtcgcgcaagatcggcaagccgggcggcggcggcgggcacgggcagcaggagcggaagccggtcatcatctacatggtgtcccccaaggtcatccacgtcgaggcccacgagttcatgccgctcgtgcagcggctcaccggcccgggcgccggccgcggggacaggaagggcaggccgtcgacgcccggcggcggcgctgctggatcctcatcgtccccgaggcgggagcaggaaggcgcgggcagcaagggcagggcggcgccgccggtgcgcgtgaaggcgcgcgccctgaaccggccggccggcggccccgcggtgtcggtctcggtgacggccacgaggcagcagcccgccggcccctcggcggcgtcgccgccggggctcatgttccacgacctcagcccgctgcgcggcgcggcgctcaagggcgagcaccaccccatggtgtcccccgggtggctgcaccacgtcggcgaccatttcctgagccccggcgccggggccgcgctcgggtcgccggccgccagctttctcgacatcttcgggccgctgtgatcggatcggtccaaccggtgagtggtgacatgacatgcatggtttggtggccagcacacgatcgagctagggtttcttgcatacacaccacaccagtactcgcatgatgcatggcaactgacaggatcgaggatttgaggccgtcttactcttgaggccaggattgattaggctgcaggcagtggcggagccagaccacacaatcaggaggggccagccttagtaattgatgtgctaaattaataaacggtgttaaaattactattaatctaatgaagcttttgcatggtaaggaggggccatggcccactttggcctccacctagctccgccagtggctgcaggaattgtacatagtatagttttttttttcagtattcccttcgatccaaatcatccaatggcttcgcaagatcagacgagtcaagaatcatttcaagccggccggtgccacacttgtccggagagatggagatagggatggaattcgaaacaagttaggaggaggggaacggaaggggtaactatgtagattatggagttctttgagattctggttgttctttgttaatttgctttaccacagttcctagttttgtgatgtgtattcttaattatgcgagaagatgacattgttttgatttttgtgcattgctagttgttgtatacattaataatgtatgtaatggtaccatttggtacactgctcatggaattgatttattttattg

SEQ ID NO: 38973 - protein, 211 aa, Panicum virgatum
  misc_feature: Ceres CLONE 1996391
  misc_feature (51)..(81): Pfam Name: VQ Pfam Description: VQ motif
MAAASFDGDVPRHGGAAGTGPLGVHAASRKIGKPGGGGGHGQQERKPVIIYMVSPKVIHVEAHEFMPLVQRLTGPGAGRGDRKGRPSTPGGGAAGSSSSPRREQEGAGSKGRAAPPVRVKARALNRPAGGPAVSVSVTATRQQPAGPSAASPPGLMFHDLSPLRGAALKGEHHPMVSPGWLHHVGDHFLSPGAGAALGSPAASFLDIFGPL

SEQ ID NO: 38974 - DNA, 1335 bp, Panicum virgatum
  misc_feature: Ceres CLONE 1996402
  misc_feature: Encodes the peptide sequence at SEQ ID NO. 38975
aatggctcccagggtcgcccgcgcggtggcggcagccagctccggctccgaggatgaggaagaggacgcggggttctccaggagctacttcctggccaaggagaaggaaccctcctccggcaagaagcgcgcccgcgccgccgcgggcaagctctccgacctcaacctcgtcgatgagcaggtgttgcgtgcatccctttccgagatccccccgaagcacgaggaagaggtggaggctcttacgagaagctacaaggatcagtaccgcaactggctgttcgagctaaggtgcggttttggtctcttgatgtatgggtttggatctaagaagcaactgctcgaggattttgcctccactaccttgactgattttactgtcattgtgatcaatggctatcttccgtccatcaacttgaagcaggttatagcaacaatagctgaaatgttctgggatcaagcaaaatctaagcgcaaacgtcaacctggaacaaggtctcagttatcacagccttttccttcacaatcattcgatgacatcatttcatttctaaagagacagacatcagatgacgtggatgatcaggtgtgccttcttatacacaatattgatggacctgccttgcgtgatgctgaatcacagcaatgtctagcacaagtttcttgctgcccacaagtccgtgttgttgcatcaaccgaccatgttaatgcacctttattatgggacaagaaaatggtgcacactcagtacaggtggagctggtaccacgtcccaacatttgcaccttacaaagtcgaatgtgttttctacccattgattcttgctagtggtggtcacgcccaaaccacaaaaacggctctagtcgttctgcagagtctgacaccaaatgcacaaagtgttttcagagttcttgctgaatatcagttggcaaatgaaaaggaggaaggtatgcctgtcagtagcttgtatacaaaatgccgcgagcgctttctggtaagcagtcaagtgacactgaactcccacctgacggagtttaaagatcatgatctggttaagattagaaagcactctgatggccaagattgcctccggattcctcttgtttctgatgcactggagaaattgctgcaagaattgggttgacaccctgctcttgggcattgttccatcagtcagctggctccaaagcttaaggattttctgctgcatgtaactgaagaatgtgctaccaatcaacggaaaacatatcactttggatagaactcagatgagcattacagtctgtaactgtacatggattatctattacctctctcttattggcagcatgttgcacg

SEQ ID NO: 38975 - protein, 379 aa, Panicum virgatum
  misc_feature: Ceres CLONE 1996402
  misc_feature (38)..(378): Pfam Name: ORC2 Pfam Description: Origin recognition complex subunit 2
MAPRVARAVAAASSGSEDEEEDAGFSRSYFLAKEKEPSSGKKRARAAAGKLSDLNLVDEQVLRASLSEIPPKHEEEVEALTRSYKDQYRNWLFELRCGFGLLMYGFGSKKQLLEDFASTTLTDFTVIVINGYLPSINLKQVIATIAEMFWDQAKSKRKRQPGTRSQLSQPFPSQSFDDIISFLKRQTSDDVDDQVCLLIHNIDGPALRDAESQQCLAQVSCCPQVRVVASTDHVNAPLLWDKKMVHTQYRWSWYHVPTFAPYKVECVFYPLILASGGHAQTTKTALVVLQSLTPNAQSVFRVLAEYQLANEKEEGMPVSSLYTKCRERFLVSSQVTLNSHLTEFKDHDLVKIRKHSDGQDCLRIPLVSDALEKLLQELG

SEQ ID NO: 38976 - DNA, 1357 bp, Panicum virgatum
  misc_feature: Ceres CLONE 1996408
  misc_feature: Encodes the peptide sequence at SEQ ID NO. 38977
aaaaacacccccgaggccaaccatttccgacgcaaaaccccccggaatccgtgacacccgcccggaggagagcagagcagaggcaccaggcatggacgccgcggtggagctggagctggagcagaagccggcggtggggtactggggcttggccggcgcgcggccctgcgacgcgtgcgccgcggaggcggcgcggctgcactgccgcgcggacggcgccttcctgtgccccgggtgcgacgcccgcgcgcacggcgccgggtcgcgccacgcgcgcgtctgtctctgcgaggtctgcgagcacgcccccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtcctcagccttcgccgccgcgggggtccaggcccagggggacgcggctgcggacgacgacgggagcaacgaggccgaggccgcctcgtggctcctccccgagcccgacaactgccacgaggacagcgccgccgccaccgacgccttcttcgctgactccgacgcgtacctcggcgtcgacctcgacttcgcccggtccatggacggcatcaaggccatcggcgtgccggtcgcgccgcccgagctggacatggccaccggcggttactactaccccgaacactccatgaaccacagcgtgtcgtcgtcggaggtggcggttgtgccggacgcgctggcgggcggcgccccggccgcgccggcggtgccggcggcgagccgggggaaggagcgggaggcgcggctgatgcggtaccgcgagaagcgcaagaaccggcggttcgacaagaccatccggtacgcgtcccgcaaggcgtacgccgagacgcggccgcgcatcaagggccgcttcgccaagcgctgctcctccgcggaggccgaggccgaggacgaggcgctgctggagcacgaggaagcggcgtgcttctcgcccgcggcgtcggcgcccgcggcctcctcggacggcgtcgtcccgtcctgctgaggggacacgacgggcggcggccgcgcctcctcctcccaggctccccggcggcgaccccttaattttgccgactctgaatcgatcccaacgcatgcgaacatgcgatgcgatgcgcgctccgtgcagcacatgaataattgtacagtagttccacgaactcgatcgtggtcgcacggaatcgcatgtaatcctcctcaccgtccttgtaatccagccttgtacattaccgtctagaggtgtttgtgcttctctcgc

SEQ ID NO: 38977 - protein, 336 aa, Panicum virgatum
  misc_feature: Ceres CLONE 1996408
  misc_feature (254)..(298): Pfam Name: CCT Pfam Description: CCT motif
  misc_feature (66)..(108): Pfam Name: zf-B_box Pfam Description: B-box zinc finger
  misc_feature (21)..(65): Pfam Name: zf-B_box Pfam Description: B-box zinc finger
MDAAVELELEQKPAVGYWGLAGARPCDACAAEAARLHCRADGAFLCPGCDARAHGAGSRHARVCLCEVCEHAPAAVTCRADAAALCAACDADIHSANPLARRHERLPVAPFFGALADAPQPFPSSAFAAAGVQAQGDAAADDDGSNEAEAASWLLPEPDNCHEDSAAATDAFFADSDAYLGVDLDFARSMDGIKAIGVPVAPPELDMATGGYYYPEHSMNHSVSSSEVAVVPDALAGGAPAAPAVPAASRGKEREARLMRYREKRKNRRFDKTIRYASRKAYAETRPRIKGRFAKRCSSAEAEAEDEALLEHEEAACFSPAASAPAASSDGVVPSC

SEQ ID NO: 38978 - DNA, 649 bp, Panicum virgatum
  misc_feature: Ceres CLONE 1996416
  misc_feature: Encodes the peptide sequence at SEQ ID NO. 38979
accaacagctcgcgccgcgcaacgccaccgcgccaccgagcacgcacgcgacagaggcggcggcgggagccattccactccgcggcgagggcgacgggagaggaggaggaggccagggcggcttgtgacgacgccgccggagcggcggcagggcggcatggggaggtccccgtgctgcgagcaggcgcacacgaacaagggcgcgtggaccaaggaggaggaccagcgcctcatcgcctacatcaaggcccacggcgagggctgctggaggtcgctccccaaggccgcagggctgctgcggtgcgggaagagctgccggctgcggtggatcaactacctgcgcccggacctcaagcgcggcaacttcaccgaggaggaggacgagctcatcatcaagttccacgagctcttcggcaacaagtggtcgctcatcgccgggaggctgccgggccggacggacaacgagatcaagaactactggaacacgcacatcaagcgcaagctcctcgcccgcggcatcgacccgcagacgcaccgcccgctcgccgccgccgcgccgggccagcagcagcattaccagctggagccgcagcggcggcgcctcgacatcgacctcaacctgtccatcagcctggcgccctaccagccg

SEQ ID NO: 38979 - protein, 163 aa, Panicum virgatum
  misc_feature: Ceres CLONE 1996416
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1004 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1010 in the 11/435,388 US patent application
  misc_feature: The sequence is a functional homolog of SEQ ID NO 1002 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1073 in the 10/374,780 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 824 in the 10/412,699 US patent application
  misc_feature: The sequence is a functional homolog of SEQ ID NO 296 in the 11/479,226 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 442 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: Useful for making plants with altered carbohydrate content
  misc_feature: The sequence is a functional homolog of SEQ ID NO 271 in the 11/479,226 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 58 in the 10/666,642 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: Useful for making plants with altered cell wall content and/or composition
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 569 in the 10/374,780 US patent application
  misc_feature: Useful for biocontainment applications
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 836 in the 10/412,699 US patent application
  misc_feature: Useful for making plants with modulated biomass
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 822 in the 10/412,699 US patent application
  misc_feature: The sequence is a functional homolog of SEQ ID NO 1681 in the 10/374,780 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 796 in the 11/435,388 US patent application
  misc_feature: Useful for making plants with altered terpenoid content
  misc_feature: The sequence is a functional homolog of SEQ ID NO 1917 in the 10/374,780 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 794 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: Useful for making plants with modulated low light sensitivity
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 743 in the 10/666,642 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 790 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 1572 in the 10/374,780 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 126 in the 10/412,699 US patent application
  misc_feature: Useful for making plants with modulated flowering time
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
MGRSPCCEQAHTNKGAWTKEEDQRLIAYIKAHGEGCWRSLPKAAGLLRCGKSCRLRWINYLRPDLKRGNFTEEEDELIIKFHELFGNKWSLIAGRLPGRTDNEIKNYWNTHIKRKLLARGIDPQTHRPLAAAAPGQQQHYQLEPQRRRLDIDLNLSISLAPYQ

SEQ ID NO: 38980 - DNA, 707 bp, Panicum virgatum
  misc_feature: Ceres CLONE 1996423
  misc_feature: Encodes the peptide sequence at SEQ ID NO. 38981
aacagcccagccaccccaccgtctcctgctccgaaccaccctacccttgcttccatggacttgcaccacccacgccaccaccttcctgcaggccgcagctactatatatagaacccccacgagctgagagcccattcatccaaccatcctcgtcctcgatcgcaagaagagagaactctctttgatcttcttcttcttgcaacgtactagctagctaggttactgcacacttgcatcgatcggcactgctttttccatggcggcttccatgagtggtcgcctcgtcctgctcgcctgcctcgtcgtcgccccgctcctcctcgccggcgccgcccgcggccacccgtggggcggcggcctgttcccgcagttctacgaccgctcgtgccccagggccaaggagatcgtcaggtccgtcgtggcgcgggccgtcgcccgggagaccaggatggccgcgtcgctggtcaggctgcatttccatgactgcttcgtcaagggttgcgacgcttcagtgcttctggacaacagcaccggcatcgtgagcgagaaagggtccaaccccaacaagaactccctccgggggttcgaggtggtcgacgagatcaaggccgccctggaggccgcctgccccggcaccgtctcctgcgccgacatcctcgccctcgccgcccgcgactccaccgtcctcgccggcgggccgtcctggg

SEQ ID NO: 38981 - protein, 150 aa, Panicum virgatum
  misc_feature: Ceres CLONE 1996423
  misc_feature (51)..(150): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
  misc_feature: Useful for making plants with modulated phosphate use efficiency
MAASMSGRLVLLACLVVAPLLLAGAARGHPWGGGLFPQFYDRSCPRAKEIVRSVVARAVARETRMAASLVRLHFHDCFVKGCDASVLLDNSTGIVSEKGSNPNKNSLRGFEVVDEIKAALEAACPGTVSCADILALAARDSTVLAGGPSW

SEQ ID NO: 38982 - DNA, 604 bp, Panicum virgatum
  misc_feature: Ceres CLONE 1996442
  misc_feature: Encodes the peptide sequence at SEQ ID NO. 38983
gacacaaccgaaaaacctagggggaaaaatagtaaagaaacggaggcgaggcgaggcgaggcggccctcctccttccccctcctccccgtttcttatctatcctgatccaaatccgcctcgcttcttatatcctcctccgaggaaaacaattccatccccccccaccgcatctcgtcctgctcgcctccgtcgccgccgccgccgccgccgccgtcgccatggccaccgaggaagccgccaagccgtccccgctcccgccctacccggagatgatcctggcggcgatcgaggggctgggcgacaagaacgggtcgaacaagtcagccatctcgaggtacatcgagggcaagtacggcgagctgcctccggcgcacccgtcgctgctgacggcgcacctgtcgcgcatgaaggagtccggcgagctcatcttcctcaagaacaactacttccgcgccgacgcccccgacgcgccgccgaagcgcggccgcgggcgcccgcccaaggtgcgggacccgaacgcgccgccgccgccgcccaatgcgccgtccaccggctcgccgcgcccccgcgggcgcccgcccaaagccaaaggacccgctggac

SEQ ID NO: 38983 - protein, 128 aa, Panicum virgatum
  misc_feature: Ceres CLONE 1996442
  misc_feature (11)..(80): Pfam Name: Linker_histone Pfam Description: linker histone H1 and H5 family
  misc_feature: The sequence is a functional homolog of SEQ ID NO 138 in the 11/375,241 US patent application
  misc_feature: The sequence is a functional homolog of SEQ ID NO 204 in the 10/412,699 US patent application
  misc_feature: The sequence is a functional homolog of SEQ ID NO 2286 in the 10/374,780 US patent application
  misc_feature: The sequence is a functional homolog of SEQ ID NO 56 in the 10/669,824 US patent application
  misc_feature: The sequence is a functional homolog of SEQ ID NO 56 in the 10/870,198 US patent application
  misc_feature: The sequence is a functional homolog of SEQ ID NO 706 in the 10/225,066 US patent application
  misc_feature: Useful for making plants with modulated nitrogen use efficiency
MATEEAAKPSPLPPYPEMILAAIEGLGDKNGSNKSAISRYIEGKYGELPPAHPSLLTAHLSRMKESGELIFLKNNYFRADAPDAPPKRGRGRPPKVRDPNAPPPPPNAPSTGSPRPRGRPPKAKGPAG

SEQ ID NO: 38984 - DNA, 695 bp, Panicum virgatum
  misc_feature: Ceres CLONE 1996463
  misc_feature: Encodes the peptide sequence at SEQ ID NO. 38985
attcccatcccaccaccgcctctctcccattgcgttgcgcccggcccattccttcatccccaccggcaccggcaccggcaccggcagcgcaagaagaagatgaagctctccgtccagtccctggccaggaagctctccctcccgtccccgaagcggtcctggagtagcggcagcaagaaggacggcagcgggaagcgctccctgtcgcgcagcgaggcgccgtccttcgcgtcggcgtcctcctcctcctcctcctccgacgacacgctcgcgcgctcctccacgccgcggtccgtgctctcgctgtcccccgccgagatcccgcgccgggagctggaagccgtgctgcagcgcctcggccacggggagccctccgacgacgagctggacgccgtggccgccatggccgcgcagccgcccgcgcccggcggggaggacgacctcatggaggcgttccgggtcttcgacgccgacggcgacggccgcatcaccgccgaggagctccgcgccttcatggaggccatcctcggcggcggcgccgagggctgcagcctcgacgactgccgccgcatgatcggcggcgtcgacgccgacggcgacggcttcgtcggcttccaggacttcgcgcgcatgatgatgaacgccaccaccgccccaacgacaaccttcttgttgtgaacttgtgagcctcacct

SEQ ID NO: 38985 - protein, 192 aa, Panicum virgatum
  misc_feature: Ceres CLONE 1996463
  misc_feature (114)..(142): Pfam Name: efhand Pfam Description: EF hand
  misc_feature (154)..(182): Pfam Name: efhand Pfam Description: EF hand
MKLSVQSLARKLSLPSPKRSWSSGSKKDGSGKRSLSRSEAPSFASASSSSSSSDDTLARSSTPRSVLSLSPAEIPRRELEAVLQRLGHGEPSDDELDAVAAMAAQPPAPGGEDDLMEAFRVFDADGDGRITAEELRAFMEAILGGGAEGCSLDDCRRMIGGVDADGDGFVGFQDFARMMMNATTAPTTTFLL

SEQ ID NO: 38986 - DNA, 1210 bp, Panicum virgatum
  misc_feature: Ceres CLONE 1996484
  misc_feature: Encodes the peptide sequence at SEQ ID NO. 38987
aaaaatcacatttgccaaaacaaaagcaccaccgctcctcgtgcaaccgcacgccgccgccgccgccgccgccgcccatggaggcctctgccgccgccgccgtcgccgccgccgaaatcgatttgaactttccgatctgcatatcctccgacgacgaggaggacggccccatctacatatcctccgatgacgaggaagtgatcgagatccaagccccaatccccctctcgtctcgggccccgatcaccaccaactctgctttggcttctggatcctcttctttccctgccaccgcagaccgcaagggaaagcgcaagctatcatcgcaaggtcaaccctcaacgcctacaaccagctgctactggggcgaattctactgcgccatctgcatggagagcgtgcccaacgctctcaagttcagcgtcgccccatgccagcacgccttctgcttgagctgcaccgtgcagtacatcgctgccaaggtcggcgagagcgtcgtccatgtgcggtgccccgacccaagctgccgggacggcgtggtcgagctggaggactgccgcggcgtcatcccctcggacctgttcggaaagtgggacctcgcgttatgcgagtcggcggccgtgctcggggagaagaaggtctactgcccgttcagggactgctcggcgccgctcctcgccggcgagggtatgaccggcgaggggagcatcgcggaggccgattgcccgcactgccgccggctgttctgcgcccggtgcatggtgccgtggcacgacggcgtcggctgcgaggagttccaggagctcggggagcacgagcgcggccgggaggacgtgatgttgcggcggctcgccggcgccaagcggtggcagcggtgcccccagtgcaggatgtacgtggagaggtctcagggatgcaccttcatgcgctgcaggtgcgggtgctgcttctgctacacctgtggatctctgatgtgcgagcagctccattcctgcaaaagatgcaacagctgagcgttcggctgatgccttctctgcaggcgctctcactgaatgtttcatttttgccaaaactcttttgcttgtccttatattgttaccatatatgatcacgtgtgagtccagaggttctggacatgaaacgtatcttaaaaaggctcgaacgacttgtttcaagtcatcgccagttgtgctaatttattccttttatc

SEQ ID NO: 38987 - protein, 311 aa, Panicum virgatum
  misc_feature: Ceres CLONE 1996484
  misc_feature (170)..(237): Pfam Name: IBR Pfam Description: IBR domain
MEASAAAAVAAAEIDLNFPICISSDDEEDGPIYISSDDEEVIEIQAPIPLSSRAPITTNSALASGSSSFPATADRKGKRKLSSQGQPSTPTTSCYWGEFYCAICMESVPNALKFSVAPCQHAFCLSCTVQYIAAKVGESVVHVRCPDPSCRDGVVELEDCRGVIPSDLFGKWDLALCESAAVLGEKKVYCPFRDCSAPLLAGEGMTGEGSIAEADCPHCRRLFCARCMVPWHDGVGCEEFQELGEHERGREDVMLRRLAGAKRWQRCPQCRMYVERSQGCTFMRCRCGCCFCYTCGSLMCEQLHSCKRCNS

SEQ ID NO: 38988 - DNA, 510 bp, Panicum virgatum
  misc_feature: Ceres CLONE 1996489
  misc_feature: Encodes the peptide sequence at SEQ ID NO. 38989
aatcgatctcccccaccagacaggagcaccgatccccggaggccggacccggcggagcagcgagcgagcgcgcgcgcgcggccagcccaccgtccacccaccatgctccgggtcgcgggcaggcgcctctcgtccgccctcgcctggcgccccgccgccgccgccgcggccggcacccggggccccctcgccggcgccctccccggccccggccgctacgacgacgacgacgacgcgcgcggccgcagggcgcgcttcgccgtctactcccccttcttcgccgccgccagagggttttcggctgaaactcttgtgccaagaaaccatgatgtaggcttagctgagctcccagcaactgtggcacccgtgaagaatcccagtgcaaaaattgtgtatgatgagtataaccatgagagataccctcctggggaccccagcaagcgtgcttttgcatactttgtgctgagtggtgggagattcatttatgcctccctgttgcgtctgcttatc

SEQ ID NO: 38989 - protein, 135 aa, Panicum virgatum
  misc_feature: Ceres CLONE 1996489
  misc_feature: SWISSPROT Homolog: EC 1.10.2.2 Ubiquinol--cytochrome-c reductase
MLRVAGRRLSSALAWRPAAAAAAGTRGPLAGALPGPGRYDDDDDARGRRARFAVYSPFFAAARGFSAETLVPRNHDVGLAELPATVAPVKNPSAKIVYDEYNHERYPPGDPSKRAFAYFVLSGGRFIYASLLRLL

SEQ ID NO: 38990 - DNA, 697 bp, Panicum virgatum
  misc_feature: Ceres CLONE 1996494
  misc_feature: Encodes the peptide sequence at SEQ ID NO. 38991
atgtcgcagtagtgctgaccaaaaccctaaccctaaattcctccaccgacgccctcttcttgaggccgtatacatggacgcgaaggacattctcgggctcccgaagacctccttctcgtcctctcaggagaagaagtcgcggccgcccaaggagccgcagcgcaagcccgatggcgtctcgcgcgaggtctatgcgctcacaggaggggtgggaatggccccgctcatgccgactatcgaggcatcacacctgaagcggcggcctgctgcggagaaggagaaggtagcatggcagtggttacctttcacatcctctgcgcgaactgacaaccttcaactctatcactgggttagagttgttaatggtgttccaccaactggtgactatcagtttgcaaaatataataagaaagtggatattcttaaatacacggatgaggagtacgagaagtatttaattgatcctgcttggagtagggaggaaacagaccagctatttgaattatgtgaacggtttgaccttcgtttcatagtaatagcagataggtttccaacttctcgcagtgtggaagatctgaagagccgctactattctgtttctcggactctactaattcatagggcccggtcatttgatgatgtttctgggaacccccttgtgaaggatagctatgatgctgctcatgacactgagagg

SEQ ID NO: 38991 - protein, 207 aa, Panicum virgatum
  misc_feature: Ceres CLONE 1996494
  misc_feature (130)..(176): Pfam Name: Myb_DNA-binding Pfam Description: Myb-like DNA-binding domain
MDAKDILGLPKTSFSSSQEKKSRPPKEPQRKPDGVSREVYALTGGVGMAPLMPTIEASHLKRRPAAEKEKVAWQWLPFTSSARTDNLQLYHWVRVVNGVPPTGDYQFAKYNKKVDILKYTDEEYEKYLIDPAWSREETDQLFELCERFDLRFIVIADRFPTSRSVEDLKSRYYSVSRTLLIHRARSFDDVSGNPLVKDSYDAAHDTE

SEQ ID NO: 38992 - DNA, 706 bp, Panicum virgatum
  misc_feature: Ceres CLONE 1996496
  misc_feature: Encodes the peptide sequence at SEQ ID NO. 38993
tctcacacacactgcagttttttgttgtttgggtagcagcagaggagcgggcttctttcttgggtttagctttgttctttctccaaatctagcagcggatctggtggttcggcagctgcgccatgggcatcgtcgacgtcgtctccgagttctgcaccttgccgaggactcgccggcacatcaagaagaggaagctaacatgcagggctgggccgctgggatcggcgcggaggacctggaattgatccaaaaggctggggtgctgctgctgcagagggagatacccgattgggtcaacacgcaggctgcccaggctgcaaaaagtgcaggcgtgcctgttatcatggacgctggtggaatggatgctcctgtacctcaagatctactcagtctagtggatatttttagtccaaatgaaacagaactagcacggttgactgggatgcctactgagacatttgagcagatcagccaggctgcaggagaatgccataaaatgggtgtgaaagaagtactagttaaacttggatcgcagggatctgctttgtttgttgagggagagaagccagtcagacagccgattattcctgccacagaagttattgataccacgggggctggtgacactttcacctcagcttttgctgtagctctggttgaggggaagtctaaggaggagtgcatgagatttgctgccgctgctgcc

SEQ ID NO: 38993 - protein, 234 aa, Panicum virgatum
  misc_feature: Ceres CLONE 1996496
  misc_feature: SWISSPROT Homolog: EC 2.7.1.15 Ribokinase
LTHTAVFCCLGSSRGAGFFLGFSFVLSPNLAADLVVRQLRHGHRRRRLRVLHLAEDSPAHQEEEANMQGWAAGIGAEDLELIQKAGVLLLQREIPDWVNTQAAQAAKSAGVPVIMDAGGMDAPVPQDLLSLVDIFSPNETELARLTGMPTETFEQISQAAGECHKMGVKEVLVKLGSQGSALFVEGEKPVRQPIIPATEVIDTTGAGDTFTSAFAVALVEGKSKEECMRFAAAA

SEQ ID NO: 38994 - DNA, 739 bp, Panicum virgatum
  misc_feature: Ceres CLONE 1996504
  misc_feature: Encodes the peptide sequence at SEQ ID NO. 38995
aaaactcgaacccaccactcgaaaccctacccgcgtcccttgcgatggcggccgccaccaccgccccgagcacccctgcggccggcccgatggcccccccaccttcctacccggcctcctccgcgttctccccctccaatactgcgttcaccgaggacgacgacgacctctacggccgcctcaagtcgctccagcgacacatggagttcgttgagatccaggaggagtacgtcaaggatgagcagaagaacctcaagcgcgagctcctacgcgcgcaggaggaggtcaagcggatccagtccgtgccgctcgttatcggccagttcatggagatggtcgacggcaacaacggcatcgtgggctccaccacgggcagcaactactacgtccggatcctcagcaccatcaaccgcgagctgctcaagccctcggcgtccgtcgcgttgcaccgccactccaacgcgctcgtcgacgtgctgccgcccgaggctgactccagcatctccctgctcggatcgtcagagaagcctaacgtcacctataatgatattggaggatgtgacatccaaaagcaggaaatacgggaggcaatcgagttacccttgacacatcatgagttgtacaagcagattggtattgatcctccaagaggtgtgcttctgtatggtccctcaggtactggcaagaccatgcttgccaaagcagtggcacatcatactactgctgcttttatcagagt

SEQ ID NO: 38995 - protein, 231 aa, Panicum virgatum
  misc_feature: Ceres CLONE 1996504
  misc_feature: SWISSPROT Homolog: EC 3.6.4.3 Microtubule-severing ATPase
MAAATTAPSTPAAGPMAPPPSYPASSAFSPSNTAFTEDDDDLYGRLKSLQRHMEFVEIQEEYVKDEQKNLKRELLRAQEEVKRIQSVPLVIGQFMEMVDGNNGIVGSTTGSNYYVRILSTINRELLKPSASVALHRHSNALVDVLPPEADSSISLLGSSEKPNVTYNDIGGCDIQKQEIREAIELPLTHHELYKQIGIDPPRGVLLYGPSGTGKTMLAKAVAHHTTAAFIR

SEQ ID NO: 38996 - DNA, 976 bp, Panicum virgatum
  misc_feature: Ceres CLONE 1996507
  misc_feature: Encodes the peptide sequence at SEQ ID NO. 38997
aatccctccctctcaggtccggcgaatctcatccgaccatctccggtcgccgcacctgctccgggcgacatgggcaccgtcaccgccgcagatccgctcccctccttcctcgccgacaaggacgcgaaggtcttcgtcgccggccaccgcggcctcgtcggctccgcgatcctccgccgcctcctctccctcggcttcaccgacgtcgtcgtccgcaagcacgccgagctcgacctgacccgccaggccgacgtcgaggccttcttcgctgcggagcagccccgctacgtcgtcctcgccgccgccaaggtcggcggcatccacgccaactcaaccttccccgccgacttcatcgccgccaacctccagatccagaccaacgtcgtcgacgccgcgctcaggtgcggctccgtccggaagctcctcttcctcggctcgtcctgcatctaccccaagttcgcgccgcagcccatcccggaggatgccctgctctccggcccgctcgagcccaccaacgagtggtacgccgtcgccaagatcgctggcatcaagatgtgccaggcctaccgcatccagcacggcctcgacgccatctccgccatgccaaccaacctctacggcccgcaggacaacttccacccggagaactcacacgtcttgcccgccctcatacgccggttccacgaggccaaggcgtccaatgctcccgaggtcgtcgtatggggttccggatcgccgctgcgggagttcctccacgtcgatgacctcgccgacggcgttatcttcttgatggatcagtactccgggttggagcatgttaatggggggagtgggagtgaggtgaccatcaaagagctcgcggagctggtgaaggaggtggttggcttccaggggaagctggtgtgggactccagcaagccggacggcacacccaggaagctcagggatagctccaagatacatggaatggggtgga

SEQ ID NO: 38997 - protein, 302 aa, Panicum virgatum
  misc_feature: Ceres CLONE 1996507
  misc_feature (21)..(253): Pfam Name: Epimerase Pfam Description: NAD dependent epimerase/dehydratase family
  misc_feature: SWISSPROT Homolog: EC 1.1.1.271 GDP-L-fucose synthase
  misc_feature: Useful for making plants with altered carbohydrate content
  misc_feature: Useful for making plants with altered cell wall content and/or composition
MGTVTAADPLPSFLADKDAKVFVAGHRGLVGSAILRRLLSLGFTDVVVRKHAELDLTRQADVEAFFAAEQPRYVVLAAAKVGGIHANSTFPADFIAANLQIQTNVVDAALRCGSVRKLLFLGSSCIYPKFAPQPIPEDALLSGPLEPTNEWYAVAKIAGIKMCQAYRIQHGLDAISAMPTNLYGPQDNFHPENSHVLPALIRRFHEAKASNAPEVVVWGSGSPLREFLHVDDLADGVIFLMDQYSGLEHVNGGSGSEVTIKELAELVKEVVGFQGKLVWDSSKPDGTPRKLRDSSKIHGMGW

SEQ ID NO: 38998 - DNA, 722 bp, Panicum virgatum
  misc_feature: Ceres CLONE 1996511
  misc_feature: Encodes the peptide sequence at SEQ ID NO. 38999
gcgcagacctattcgcttcctacctcccctacacccccaatcgccgcctccttctcgactcgcgccgctcccccccccccccgctctcctcccgcccacgacctcgccaccggcttcgcccaatcgccgcctccttctcgactctcgccgcttccgccggctccatcccgcccgcgagtcgccgtcggcttcgggtcgccccgctcccctccatggctgggagacacaccattattctgatgcaaccatcccaaaatagggcttctaggacatttatggattataattcaattaaccatgcattggatggaatctgtgggctttatgaaaggaaaattagggatatcaaccctatggcccccataacctatgatatcagcgacctttataacttcattgatggcctagctgacataagtgccctggtttatgatcactcaattcaggcatttctgccatatgatagacagtggataaagcaaaagttgctccagcacctgaagaagctggctcagcggtagccgtgactgtttggaacggtgccttgtttccaacaagcaagcatgcgtggtaatggctgtgcaatgagtgtatcgggtggtgttttcttgtaaaattatgaaatgttacattgcagattgcacccttgtgctgtggatgttggactcggttgttggccgcttgcctgtggcacccaatatatctgataaacttgtctggtt

SEQ ID NO: 38999 - protein, 102 aa, Panicum virgatum; identical to SEQ ID NO: 12715
  misc_feature: Ceres CLONE 1996511
  misc_feature (3)..(102): Pfam Name: ER Pfam Description: Enhancer of rudimentary

SEQ ID NO: 39000 - DNA, 651 bp, Panicum virgatum
  misc_feature: Ceres CLONE 1996529
  misc_feature: Encodes the peptide sequence at SEQ ID NO. 39001
acctcacccacccaccatctcaaaatctcttgctagtctagtattctattattcggcggtaattgcatccaacagtaatcctcccgacgggatcaaatcaaacagaattaagaagaagaagaagaagaatcaaggagatgccttcccaggatttcgccaccgccgccggctggaggccgaagcagcagaagcagcagctgcaccacgaccagaagctgcagatccgggaggtctgggcggacaacatggaccgcgagttcacgctcatccgcgccgccatcgagcacttcccctacgtgtccatggacaccgagttcccgggcgtcatccaccgccccggcaacgccaagcaccccgccgccatgacccccgccgagcgctacgccctcatcaaggccaacgtcgacgcgctccacctcatccaggtcggcctcaccttggccgcctcccccaccgccccgcccgccctcgccttccagatcaacctccgcgagttcgacccgcgcctccaccgccacgcccccgactcggtcgccctcctcgccgccagcggcctcgacctcgccgcgcaccgcgccaggggcgtcagcgcgcgcgccctcgccgcgctgctcatgtcctcgggcctcgtctgcaacccggacgtggcct

SEQ ID NO: 39001 - protein, 171 aa, Panicum virgatum
  misc_feature: Ceres CLONE 1996529
  misc_feature (30)..(171): Pfam Name: CAF1 Pfam Description: CAF1 family ribonuclease
  misc_feature: SWISSPROT Homolog: EC 3.1.13.4 Poly(A)-specific ribonuclease
MPSQDFATAAGWRPKQQKQQLHHDQKLQIREVWADNMDREFTLIRAAIEHFPYVSMDTEFPGVIHRPGNAKHPAAMTPAERYALIKANVDALHLIQVGLTLAASPTAPPALAFQINLREFDPRLHRHAPDSVALLAASGLDLAAHRARGVSARALAALLMSSGLVCNPDVA

SEQ ID NO: 39002 - DNA, 486 bp, Panicum virgatum
  misc_feature: Ceres CLONE 1996540
  misc_feature: Encodes the peptide sequence at SEQ ID NO. 39003
attcacaccacaccagaggcatcggttacctaggtacgacctcaagaggcggcggcgggggctgggatctcccatatattctgctatcctagcgatagatagatagatagatgccggcagcgatggcttctggttggagcaggctcgtgatgatgagaacaatgctgctggtgctcggcgccatgtgctcgccggcgctgctcaccggcgtcgccagcgccgccggcagcttctaccaggacgtggacatcccctggggcaacagccgcggcaaaatgctcaacggcggccagctcctgacgccgaccatggaccgggcctccaggtcagagatcaagaccacaagccagtacgtctcctgccgataggagatccagctacagctcataaccggtgactgcgccggcacagtcaccaccgtctacccgtcatcgcaagggtggcactaagactagatcgacttctagttcatgaggaacgcaagcg

SEQ ID NO: 39003 - protein, 81 aa, Panicum virgatum
  misc_feature: Ceres CLONE 1996540
  misc_feature: SWISSPROT Homolog: EC 2.4.1.207 Xyloglucan:xyloglucosyl transferase
MASGWSRLVMMRTMLLVLGAMCSPALLTGVASAAGSFYQDVDIPWGNSRGKMLNGGQLLTPTMDRASRSEIKTTSQYVSCR

SEQ ID NO: 39004 - DNA, 693 bp, Panicum virgatum
  misc_feature: Ceres CLONE 1996544
  misc_feature: Encodes the peptide sequence at SEQ ID NO. 39005
gagtcgagtagagtagacgacgcccaacatccatctccctgcgatccgctcttgtaggctgcccccatccgctcctcccactcgtggcttctccggcggcggcgatggcggcggaggccaaggacgtgggcatcctcgccatggacatctacttcccgcccacctgcgtgctccaggaagagttggaaactcatgatggcgtgagcaaagggaaatacaccattgggcttgggcaggatagcatggcattttgcactgaagttgaggatgttatctcaatgagtttgacagtggtgaagtccctcctgaaaaattataacattgacccgaagtgcattggacgtttggaagttggcagtgaaacagtaatagacaagagcaagtctataaagacatggttgatgcaaatttttgaggaatatggcaacactgatattgaaggagttgactcctcaaatgcatgctatggtggaacagctgcgttgtttaattgtgttaactgggttgaaagcaactcatgggacgggcgttatggacttgttgtttgcacagacagtgcggtttacgctgaaggtccggctcgtcctactggtggtgcagctgctattgccatgctgattggaccaaacgctcctatttcttttgaaagcaaatataggggatctcatatggcccatgcatatgacttttaca

SEQ ID NO: 39005 - protein, 196 aa, Panicum virgatum
  misc_feature: Ceres CLONE 1996544
  misc_feature (4)..(177): Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
MAAEAKDVGILAMDIYFPPTCVLQEELETHDGVSKGKYTIGLGQDSMAFCTEVEDVISMSLTVVKSLLKNYNIDPKCIGRLEVGSETVIDKSKSIKTWLMQIFEEYGNTDIEGVDSSNACYGGTAALFNCVNWVESNSWDGRYGLVVCTDSAVYAEGPARPTGGAAAIAMLIGPNAPISFESKYRGSHMAHAYDFY

SEQ ID NO: 39006 - DNA, 719 bp, Panicum virgatum
  misc_feature: Ceres CLONE 1996555
  misc_feature: Encodes the peptide sequence at SEQ ID NO. 39007
atcgctccctctccctctccaccacagcaggctagctagggttttctggggtttgcgagggggttgctccggtccggcgggaggggggagatggcggcggagcgggctcaggggacggtgaagtggttcaacgggaccaaggggttcggcttcatcagccccgacgacggcggccaggacctcttcgtccaccactcctccgtcaaggccgacggcttccccaacctcaaggacggtgacgccgtcgagttcaccgtcggcgccgacagcgacggccgcgccaaggccatcgacgtctccgcgcccggcggcggcgcgctcgccggcggggagcgcccggacaacggctacggcggacgcggtggcggcggctacggaggcggaggcgaccgcggctacgggggaggcggcgaccgcggctacggcggaggcggcgaccgcggctacggtggaggtgaccgcggctacggcggaggcggcggcgaccgcggctacgggggaggaggtggctacggaggaggcggcgaccgtggctacggcggcggcggcggaggcggccgcggctccgggtgctacaagtgcggcgaggagggccacatcgcacgggactgctcccagggcggcggcggcggctacggcggtggcggtggctacggcggtggcggcggcggctacggcggaagccgcggctccgggtgctacaactgcggtgaggacgg

SEQ ID NO: 39007 - protein, 209 aa, Panicum virgatum
  misc_feature: Ceres CLONE 1996555
  misc_feature (5)..(72): Pfam Name: CSD Pfam Description: 'Cold-shock' DNA-binding domain
  misc_feature (159)..(176): Pfam Name: zf-CCHC Pfam Description: Zinc knuckle
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
MAAERAQGTVKWFNGTKGFGFISPDDGGQDLFVHHSSVKADGFPNLKDGDAVEFTVGADSDGRAKAIDVSAPGGGALAGGERPDNGYGGRGGGGYGGGGDRGYGGGGDRGYGGGGDRGYGGGDRGYGGGGGDRGYGGGGGYGGGGDRGYGGGGGGGRGSGCYKCGEEGHIARDCSQGGGGGYGGGGGYGGGGGGYGGSRGSGCYNCGED

SEQ ID NO: 39008 - DNA, 731 bp, Panicum virgatum
  misc_feature: Ceres CLONE 1996572
  misc_feature: Encodes the peptide sequence at SEQ ID NO. 39009
atggctctgcaaaacattggtgcttcaaacagggatgatgccttctacaggtacaagatgccaaggatgattaccaaaatagaagggcgtggtaatggcatcaagacaaacattgtgaacatggttgacattgcaaaagcacttgccaggccagcttcctacacaaccaaatactttgggtgtgagcttggcgcacagtctaagtttgatgagaagacaggagtttccttggttaatggtgctcatgacactgcaaagctggctggtctacttgaggtgttcatcaagaagtatgtccagtgttacgggtgtggcaaccctgagactgagattctgatctctaagacccagatgatgtcactgaaatgtgctgcctgtggcttcatctcagatgttgacatgagggacaagcttacaaccttcatcctgaagaacccacctgaacagaagaagggaggaaaagataagaaggccatgaggagagctgagaaggaacgtctgaaggaaggtgaggctgccgatgaggagcagaagaaactgaagaaggatgcaaagaagaaaggtgtatcttccaaggaatccacagctaaggtttcaaagaagaaggctgctgcagctggctctgatgaagatcattcaacatctccaactcgcagtcgtgatggagacaatgcagctgcagaagaggatgatgatgtcgagtggcagactgacacttctctggaggctgc

SEQ ID NO: 39009 - protein, 243 aa, Panicum virgatum
  misc_feature: Ceres CLONE 1996572
  misc_feature (1)..(131): Pfam Name: eIF-5_eIF-2B Pfam Description: Domain found in IF2B/IF5
MALQNIGASNRDDAFYRYKMPRMITKIEGRGNGIKTNIVNMVDIAKALARPASYTTKYFGCELGAQSKFDEKTGVSLVNGAHDTAKLAGLLEVFIKKYVQCYGCGNPETEILISKTQMMSLKCAACGFISDVDMRDKLTTFILKNPPEQKKGGKDKKAMRRAEKERLKEGEAADEEQKKLKKDAKKKGVSSKESTAKVSKKKAAAAGSDEDHSTSPTRSRDGDNAAAEEDDDVEWQTDTSLEA

SEQ ID NO: 39010 - DNA, 675 bp, Panicum virgatum
  misc_feature: Ceres CLONE 1996611
  misc_feature: Encodes the peptide sequence at SEQ ID NO. 39011
aggacagcaaacgcgaagccaaggcagcgagccagatctcgcctgcccgccgcggctgtgaacaggacagccaccgtcgccagatcggaccaagcgccggagctccgggaatccaccggagcagaagcggcagcagatcccgagagcagagcagtgggtagccgccaaggcaaaaggaggcggcgaagatgctgccgacgaccgcgtccaaggggcgcggggccgcccgctccttcccgccgctcttcggcccctacctccgccgcatcgttaagtggcaacaaatggatattgaatacacattttggcaaatggttcatctctgtacttcaccaaaagtagtctatcagcacaccaaatatcacaagcaaacaaagaaccagtgggctcgggatgatcctgcatttgttgtcattctgattcttttcctcgtgttcgcaacatcagcttactgtgcagcgtatggagagagtgcctcacatgctgctctaacaatcacttcggttgtgttcttccatttcttgtttgctgggatagttttgggcacactttgctggtttcttacaaattcttacttgagagaggaacctaacagccatgttgttgagcaacgtgtggagtgcacccaaaattctttgcaggctctatgcatttgatgttcactgtaactcgttc

SEQ ID NO: 39011 - protein, 155 aa, Panicum virgatum
  misc_feature: Ceres CLONE 1996611
  misc_feature (17)..(153): Pfam Name: UNC-50 Pfam Description: UNC-50 family
MLPTTASKGRGAARSFPPLFGPYLRRIVKWQQMDIEYTFWQMVHLCTSPKVVYQHTKYHKQTKNQWARDDPAFVVILILFLVFATSAYCAAYGESASHAALTITSVVFFHFLFAGIVLGTLCWFLTNSYLREEPNSHVVEQRVECTQNSLQALCI

SEQ ID NO: 39012 - DNA, 680 bp, Panicum virgatum
  misc_feature: Ceres CLONE 1996617
  misc_feature: Encodes the peptide sequence at SEQ ID NO. 39013
cccttgctccagtcctcgtcccgccgccgccgccgccgccgccgccgccccctgcaccagcaccagccgccgcctagcagcagccgtcgccggagaagaaggggagggagccatgggtcgcgtccgcaccaagaccgtgaagaagacctccaggcaggtgatcgagaagtactactcccgcatgaccctcgacttccacaccaacaagaaggtgctggaggaggtctcgatcctgccctcgaagcgcctccgcaacaaggtggccggcttcaccacccacctgatgcgccgcatccagcgcggccccgtccgcggcatctcgctcaagctccaggagattcggttggattattggaggagggctccggcggcggcggatagcagcgggatgaagctccactgggtggtgcggttcctgttcgggccggtgccggtctacttctcggcgctggccatcctcatcgtgctcaccaacgcgcagtacttcgggctggtgggcgtcggcgtggcgccgcgcgccgccaagctcgcgtcctccacgccggtggtcggcgtgatgaagtactgcgacatcttccgcggggagtgggtgcccgacccggaggcgccctactacacccacaagacgtgccacatgatccaggagcaccagaactgcctcaagtacgggcgccccgact

SEQ ID NO: 39013 - protein, 189 aa, Panicum virgatum
  misc_feature: Ceres CLONE 1996617
  misc_feature (1)..(121): Pfam Name: Ribosomal_S17e Pfam Description: Ribosomal S17
MGRVRTKTVKKTSRQVIEKYYSRMTLDFHTNKKVLEEVSILPSKRLRNKVAGFTTHLMRRIQRGPVRGISLKLQEIRLDYWRRAPAAADSSGMKLHWVVRFLFGPVPVYFSALAILIVLTNAQYFGLVGVGVAPRAAKLASSTPVVGVMKYCDIFRGEWVPDPEAPYYTHKTCHMIQEHQNCLKYGRPD

SEQ ID NO: 39014 - DNA, 718 bp, Panicum virgatum
  misc_feature: Ceres CLONE 1996618
  misc_feature: Encodes the peptide sequence at SEQ ID NO. 39015
atcccattccccttccttccagaggagagagagagaagaaaagataagctcagctcaggctcaggctcagctcgcaagcaagtggagatgcggagcccacgaggaccagcagcagccgggcgctgcggcgcccaggagcacgtcgacctgatcccgggcatccccgacgacgtcgccgtcgactgcctggcgcgcgttccccacgcgtcccaccgcgcgctccgccgcgtctgccgcggctggcgcagcgccgccgccaagccggccttcgcctcggcgcgcgccgccgcgggcgccaccgaggacctcgtctacctcctgcagttcggcaacccctccgccgccgacgacgacggggcgcctaaggacggcgccgacgcgccgccgcccagcgcgccggcctacggcgtcgccgtctacaacgtgaccacgggcgagtggcgccgggagcgcggcgcgccgcccgtgctccccgtcttcgcgcagtgcgccgcggtgggcacccgcgtggccgtgctcggcggctgggacccgcgcaccttcgagcccgtcgccgacgtgcacgtcctcgacgccgccaccggcgcgtggcgccgcgccgcgccgatgcggtccgcgcggtccttcttcgcgtgcgccgaggccggcggcaagatctacgtcgccggcgggcacgacaagcacaagaacgcgctcaagacggccgaggcctacgacg

SEQ ID NO: 39015 - protein, 210 aa, Panicum virgatum
  misc_feature: Ceres CLONE 1996618
  misc_feature (20)..(67): Pfam Name: F-box Pfam Description: F-box domain
MRSPRGPAAAGRCGAQEHVDLIPGIPDDVAVDCLARVPHASHRALRRVCRGWRSAAAKPAFASARAAAGATEDLVYLLQFGNPSAADDDGAPKDGADAPPPSAPAYGVAVYNVTTGEWRRERGAPPVLPVFAQCAAVGTRVAVLGGWDPRTFEPVADVHVLDAATGAWRRAAPMRSARSFFACAEAGGKIYVAGGHDKHKNALKTAEAYD

SEQ ID NO: 39016 - DNA, 1499 bp, Panicum virgatum
  misc_feature: Ceres CLONE 1996638
  misc_feature: Encodes the peptide sequence at SEQ ID NO. 39017
gactctcgactcgccgcccactgcgcccccctccccctcggcccctccaatccctccgatccaatccccccaaaccctaggcaatccgccaccagagtgccaaggtcgtcccccctcctcacccgcggcggcgcggcacatggcccacggcggcggcgggagggcgaaggtgacgccgaacctcgcggtggacggcgagggcacgcggacgctcaacctcaccgtgctgcagcgcctcgaccccgccgtcgaggacatcctcatcaccgccgcccacgtcacgctctacgacttcgacaccgacgtcaaccagtggagccggaaggatgtcgaggggtcgctcttcgtggtcaagaggaatgcccaacccagattccagttcattgtcatgaatcgccggaacacagataatctagttgaagatctcttgggagattttgaataccaactccaagttccttatataatgtaccgcaattctgcacaagaagttattggaatttggttttacaactcccaggagtgtcaagaagttgcaaatctttttagcaggatactgaatgcattttcgaaggtgcctccaaagccaaagattccctctgttcaaagtgaatttgaagagctggaagcagcacctgcgttggttgaaggtcctctggaaccgcaaacatcaaatatcatatcaactaccacccacgttcaagtggaccccttatctgcattcttcagtgcagctgcgaacgctggtggcaccacctctgtagctgttgcaggacagccaaatcaatcttttggtgctattcctttgtcacatgaacctactagtacaattacatcgcaatcaccgggcttgcatcatttgcttccttcacaggcctcatcagtttctggcataccttctgatgttcatggtggcactggtcctatagtgaggtccacaagccttgtaaatccatcacatttctcaccattgacatcagcgcagacagcaatggtgcgcagtaattctgcagcaccaactgctccacctcaacaccctcgtactgctcaccatccgcaaagtgctcccttgcttcagccttttccattacctacagcttcaccttctccaccatatgggactccattgcttcaaccatttccaccaccaaatccatcgccgtctcttgcatcagctccagtctacaacccagcactgtccagagacaaagttagagatgcattactgagacttgtggagaatgatgaatttatcgatttggtctaccgggagatcgtgaacagacaataatgaatattgaatgaacagacctctcaaacaggctggttgtgtttggactcttgctatctgttgtgagcttgcaattcaagttatgatgtaaattcattagtgaagtccatcggttggcgaagtttgtattatgtactttctacatatctgtaaatgcttatgaaatctgtctgctccgtggaatgtcatctgctatattcgtggtgcg

SEQ ID NO: 39017 - protein, 383 aa, Panicum virgatum
  misc_feature: Ceres CLONE 1996638
  misc_feature (18)..(140): Pfam Name: DCP1 Pfam Description: Dcp1-like decapping family
MAHGGGGRAKVTPNLAVDGEGTRTLNLTVLQRLDPAVEDILITAAHVTLYDFDTDVNQWSRKDVEGSLFVVKRNAQPRFQFIVMNRRNTDNLVEDLLGDFEYQLQVPYIMYRNSAQEVIGIWFYNSQECQEVANLFSRILNAFSKVPPKPKIPSVQSEFEELEAAPALVEGPLEPQTSNIISTTTHVQVDPLSAFFSAAANAGGTTSVAVAGQPNQSFGAIPLSHEPTSTITSQSPGLHHLLPSQASSVSGIPSDVHGGTGPIVRSTSLVNPSHFSPLTSAQTAMVRSNSAAPTAPPQHPRTAHHPQSAPLLQPFPLPTASPSPPYGTPLLQPFPPPNPSPSLASAPVYNPALSRDKVRDALLRLVENDEFIDLVYREIVNRQ

SEQ ID NO: 39018 - DNA, 698 bp, Panicum virgatum
  misc_feature: Ceres CLONE 1996646
  misc_feature: Encodes the peptide sequence at SEQ ID NO. 39019
acaccactccccaccccgagctgtcccccattgcttgcttccgcagtagctgctcgctcgctctagagtgttcacccgcggtccggtcgagagagctcgagctcttgcagccatggcggttcccctgcttctcctgctgctgctggccatgttcgcaggctcagatgcggcgttctgcgtgtgcaagccgggcaccccggacgcgatgatgcagaaggcgatcgactacgcctgcagcaagggcgccgactgcgcccagaccgcgcagggcgggccgtgctacggcaacggcaacaaggtggccgtctgctcctacatctgcaacagctacttccagagcaagagctccatgggcgccacctgcgacttcggcggcgtcgccaccctcaccaccaccgaccccagctccggcacctgcaagttcgcctctggacccagcagcgttggcaccggcggcggcggcatgggcaccggcgggacaggcgccggcgccggcaccggcggcatgggcgccggcgcgggcacaggagcaggcaccggcgctggcactggagcgggcactggtggcatgggcgcggggaccggcgctggcgctggcgctggcaccggcgcgggcaccggcgcaggcgcgggtgtcacgacccccgggagcgggagcaccctgagcccaccgttcggcggcacgggcgcgtacggcc

SEQ ID NO: 39019 - protein, 195 aa, Panicum virgatum
  misc_feature: Ceres CLONE 1996646
  misc_feature (20)..(104): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
MAVPLLLLLLLAMFAGSDAAFCVCKPGTPDAMMQKAIDYACSKGADCAQTAQGGPCYGNGNKVAVCSYICNSYFQSKSSMGATCDFGGVATLTTTDPSSGTCKFASGPSSVGTGGGGMGTGGTGAGAGTGGMGAGAGTGAGTGAGTGAGTGGMGAGTGAGAGAGTGAGTGAGAGVTTPGSGSTLSPPFGGTGAYG

SEQ ID NO: 39020 - DNA, 1503 bp, Panicum virgatum
  misc_feature: Ceres CLONE 1996650
  misc_feature: Encodes the peptide sequence at SEQ ID NO. 39021
agcacgagccacgaagtgtcaactcgatctgcaagcccgccgcaagctcagagagagtgaggaggagatgggggaggtgatcgtgaacggaggcggaggggcgatggagggaggggcggccgcgaaagggccggtggtggtgacgggggcggcgggcttcctcggctcctggctcgtcatgaagctcctccgggccggctacacagtacgggccaccgtgcgcgaccccgcgaacgttgggaagacgaagccattgctggaccttcccggagcaacggagcggctgtccatctggaaggccgacctgaccgaggaaggcagcttcgacgacgcgatcaagggatgcaccggcgtcttccacgtcgccacgcccatggacttcgagtccaaagaccctgagaacgaggtgatcaagccgacggtggaagggatgctggacatcatgcgagcctgcaaggaggccggcaccgtgcgccgcatcgtcttcacctcctccgccggggccgtcaacatcgaggagcggcagaggcccgtctacgaccaggacaactggagcgacgtcgacttctgccgccgcgtcaagatgaccggatggatgtacttcgtgtccaagtccctggcggagaagscggccatggcgtacgcggcggagcacggcctggacctcatcmkygtcatcccgacgctggtggtcggcccgttcctcagcgcggccatgccgcccagcctcgtcaccgcgctggcgctcgtcacggggaacgagccccactactccatcctgaagcaggtgcagttcgtccacctcgacgacctctgcgatgccgagatcttcctctttgagcacccggccgccgccggccgctacgtctgctcctcccacgacgccaccatccacgggctcgccgccatgctcagggagaggtaccccgagtatcgcatcccggagaggttccgggggatcgacggcgacctccagccggtgctcttctcgtccaagaagctcctcgaccacgggttcgcgttcaggtacacggtggagggcatgttcgacgccgccatccggacgtgccgggagaagggcctgatcccgctcgccacggccggaggggacagccccacctcatcgcgcgcgcccggcgagacggatgctgctcttgggagggaaggtccggctattggcgcttagaaaaccgctggcggtgattcaaaattgctgtcctatgttgatgctatatgtcgttccacatgtgaaacatgttggtatttgaattcataattttctggatcaagtgttgttttatcccaaacaaatatttccatcttttacttttaccacagcttgcttcaacagtaggagtcctactgtatacatctcctataaataagctacatgtaaaggttttgatataaacttgctaccgccaaaaaaaaaattcacatcaattcctcgaggcagtacactagcagctttgatctaatactatattcatcataagagatacg

SEQ ID NO: 39021 - protein, 372 aa, Panicum virgatum
  misc_feature: Ceres CLONE 1996650
  misc_feature (23)..(269): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature (188)..(188): Xaa is any aa, unknown, or other
  misc_feature (202)..(202): Xaa is any aa, unknown, or other
MGEVIVNGGGGAMEGGAAAKGPVVVTGAAGFLGSWLVMKLLRAGYTVRATVRDPANVGKTKPLLDLPGATERLSIWKADLTEEGSFDDAIKGCTGVFHVATPMDFESKDPENEVIKPTVEGMLDIMRACKEAGTVRRIVFTSSAGAVNIEERQRPVYDQDNWSDVDFCRRVKMTGWMYFVSKSLAEKXAMAYAAEHGLDLIXVIPTLVVGPFLSAAMPPSLVTALALVTGNEPHYSILKQVQFVHLDDLCDAEIFLFEHPAAAGRYVCSSHDATIHGLAAMLRERYPEYRIPERFRGIDGDLQPVLFSSKKLLDHGFAFRYTVEGMFDAAIRTCREKGLIPLATAGGDSPTSSRAPGETDAALGREGPAIGA

SEQ ID NO: 39022 - DNA, 722 bp, Panicum virgatum
  misc_feature: Ceres CLONE 1996676
  misc_feature: Encodes the peptide sequence at SEQ ID NO. 39023
ggccaccaacctccccccaggaaatccagctccgtctccgcctcctcccggcctccctcccccggcggagagatccgggtcggccccgcccgcccggtaatcaatccctcgcgctcgtccggcccgtaatttcgcctcctgaaaccggccgccagggctcgggggcgggggtggagaggagtgggggggccttctttctcttctccctgggggcgatggggattggggcggcgtcggacgagctgctgggcacgttcgtgccgatcgccgtgtactggctctactcgggcctctacgtcgcgctggacggggtggggcgtctcgacgggtaccggctgcacgtcagggaggaggccgccaccaagaacgtcgtctccaaggccgccgtcgtcaggggcgtcctcgtccagcaggccttccaggtcgccgtctcgctcaccctcttcgcggttattggtgatgagagtggtcctggacagaaacaacctcctgctcttgtgatagtgttgcagtttataactgcaatggttgttatggacacatggcagtacttcatgcacagatacatgcacattaacaagtttctgtataagcacatccattcaaagcaccacactcttgtagtcccttattcctttggagctctttacaaccatcctctcgagggccttattttggacaccattggtggcgcactctcatttctcgtctccggtatgact

SEQ ID NO: 39023 - protein, 168 aa, Panicum virgatum
  misc_feature: Ceres CLONE 1996676
  misc_feature (100)..(168): Pfam Name: FA_hydroxylase Pfam Description: Fatty acid hydroxylase
  misc_feature: SWISSPROT Homolog: EC 1.14.13.72 Methylsterol monooxygenase
MGIGAASDELLGTFVPIAVYWLYSGLYVALDGVGRLDGYRLHVREEAATKNVVSKAAVVRGVLVQQAFQVAVSLTLFAVIGDESGPGQKQPPALVIVLQFITAMVVMDTWQYFMHRYMHINKFLYKHIHSKHHTLVVPYSFGALYNHPLEGLILDTIGGALSFLVSGM

SEQ ID NO: 39024 - DNA, 729 bp, Panicum virgatum
  misc_feature: Ceres CLONE 1996689
  misc_feature: Encodes the peptide sequence at SEQ ID NO. 39025
aattgtacacgggcactggaattatcagcgcatcgcttacatgatcctctacaacttctaccgcaatgctgtctttgtgctaatgcttttctggtatatcttacatacagcttattctgcaactctagcattaacagattggagtagtgttttctactcccttatatacacatcagttccaactgtagtagttggcattctcgacaaggacttgagtcataatacccttctttattacccgagactatatgaggcagggcttcgaaatgagggctacaacttgtcactcttctggatcacaatgctagataccttatggcaaagccttgtccttttctatgttcctttcttcacatacaacatcagtacaatggacatatggagtatgggaagtttgtggacaattgctgtggttataattgtcaatatgcatctggccatggacattcgacgatgggtgcttattacccatcttgccgtatggggttccatagctgctacgtttttgtgcatggtgttaatagactcgataccaattttccctaactacgggacaatatacaacatggctgcttcaactacttattggctgagcgtttgtcttataatagtccttgggttgcttcctcggttcctttgcaaagtaatatatgaaaccttttggccatctgatattcaaatagcaagagaagctgagcttttaaaaaagctgcctcagcagtttggttc

SEQ ID NO: 39025 - protein, 242 aa, Panicum virgatum
  misc_feature: Ceres CLONE 1996689
  misc_feature: SWISSPROT Homolog: EC 3.6.3.1 Phospholipid-translocating ATPase
IVHGHWNYQRIAYMILYNFYRNAVFVLMLFWYILHTAYSATLALTDWSSVFYSLIYTSVPTVVVGILDKDLSHNTLLYYPRLYEAGLRNEGYNLSLFWITMLDTLWQSLVLFYVPFFTYNISTMDIWSMGSLWTIAVVIIVNMHLAMDIRRWVLITHLAVWGSIAATFLCMVLIDSIPIFPNYGTIYNMAASTTYWLSVCLIIVLGLLPRFLCKVIYETFWPSDIQIAREAELLKKLPQQFG

SEQ ID NO: 39026 - DNA, 703 bp, Panicum virgatum
  misc_feature: Ceres CLONE 1996690
  misc_feature: Encodes the peptide sequence at SEQ ID NO. 39027
gtcgcatcgtctccccatctcccctccctcccaccacgagcggccgccgctcacctctccaaaccctaaaccccagggaccctccgcctcgggatcgggcgggaccccaggcctcgccggagccgccgcggccgcggccgccttcgccctcgtcccctctccccttagcgggggagggagaggctagcggcggggccgagccggagcagggggaggcaagatgaggatcatgatcaagggcggcgtgtggaagaacacggaggacgagatcctcaaggtcgccgtcatgaagtacggcaagaaccagtgggcgcgcatctcgtcgctgctcgtccgcaagtccgccaagcagtgcaaggcacgctggtacgagtggctcgacccctccatcaagaagactgagtggacaagggaagaggatgagaagctacttcatcttgctaaactcatgcctactcagtggaggacaattgcacctattgtaggtcgaacaccatctcagtgccttgagcgttacgaaaaactgcttgatgctgcatgtgcgaaggatgaaaattatgagcctaatgatgaccctaggaagctgcgtcctggtgagattgacccaaaccctgagtcaaaacctgcacgtcctgatcctgtcgatatggatgaagatgaaaaagaaatgctttctgaggcaagggctcgcttagctaacact

SEQ ID NO: 39027 - protein, 160 aa, Panicum virgatum
  misc_feature: Ceres CLONE 1996690
  misc_feature (7)..(53): Pfam Name: Myb_DNA-binding Pfam Description: Myb-like DNA-binding domain
  misc_feature (59)..(103): Pfam Name: Myb_DNA-binding Pfam Description: Myb-like DNA-binding domain
  misc_feature: The sequence is a functional homolog of SEQ ID NO 2260 in the 10/374,780 US patent application
  misc_feature: The sequence is a functional homolog of SEQ ID NO 313 in the 11/479,226 US patent application
  misc_feature: The sequence is a functional homolog of SEQ ID NO 804 in the 10/225,066 US patent application
MRIMIKGGVWKNTEDEILKVAVMKYGKNQWARISSLLVRKSAKQCKARWYEWLDPSIKKTEWTREEDEKLLHLAKLMPTQWRTIAPIVGRTPSQCLERYEKLLDAACAKDENYEPNDDPRKLRPGEIDPNPESKPARPDPVDMDEDEKEMLSEARARLAN

SEQ ID NO: 39028 - DNA, 1098 bp, Panicum virgatum
  misc_feature: Ceres CLONE 1996693
  misc_feature: Encodes the peptide sequence at SEQ ID NO. 39029
cagaaattgattcatgattgttttaaaattatgtccatcaaagtgtctgctatgtcatatcatacaagtaacacgtacctgaaaggctgaaacttatgttgtggatggagttttcaagtgggttattcgcctcttgtttcaataatcatgtaactccataagactatcatgttttatctgtcctgtccaacaagtctttcaactataaatgaaaaatccaatagtttgcatgtcagcaacttttgagtgcacgaatgtaaatgctgttacgcacttgcgctgttgcccccagtcgcattcatcacttgttattttgttaagctcctctttttaatcatattgctatttacataagaccaagagactatactctgtgaatgtttgcaagccaattggaaatttggttcaattaagatgcaaagttccattttgttccctacatggaacacttgcaacctgaagttctgatcccatctttgcctccgttatatacctgtttcatattttcagattaccatattctgctacctaatgaggtattattaccttgaaagaaataatcaccttaacaacatttttattttgacaatctgatgcattgtagctacagacttacagttgatatttgtttttgattaacactagcccgacaaaaaccatgcttgtcttcttckttttggtactatccacaacttgcttacactgayttttgsccttttggcttggcattatcagaagcgcagcatggcaaagctcaagccaaaggcgttgctggcacaaagcaaagtgaagaaggcccctagccaaatcagtgtgatcacaatcttcacctacttggtcctcggtgtcatagttgtatcctctgtttatgctgcttacaaatatttggtaggctaaggaccagcagtgacagcagcaggcgtcgaggggaattaaacctcaaactatgtaactgattttgttgttgtatcatccagttggataattttggttactgcagctagtaaaaggagcatggatagattgtatcttgctacagttttattgtaaaccgagggtacattatattgatatgtgtatgctaaattcctttcctcg

SEQ ID NO: 39029 - protein, 50 aa, Panicum virgatum
  misc_feature: Ceres CLONE 1996693
  misc_feature: SWISSPROT Homolog: EC 5.2.1.8 Peptidylprolyl isomerase
MAKLKPKALLAQSKVKKAPSQISVITIFTYLVLGVIVVSSVYAAYKYLVG

SEQ ID NO: 39030 - DNA, 704 bp, Panicum virgatum
  misc_feature: Ceres CLONE 1996708
  misc_feature: Encodes the peptide sequence at SEQ ID NO. 39031
atcaaaacggagacgagggggatctcgtccgatccagctcgagcacccccgtccgctgcgctgcctacctcgtctccctctgcctctgctggcctgctatgtacaaactcctcctactctagaaccaactactactactcggctccagggtcttcttcttcttctttcccaacatctccggccttcccaaccaattcaatcgacccggcggcaggcggatccactccccgcgcgccggcagggagaacatcaggtagccatggcgttcgatgccttcaccgacaagaacgccgtcttccgccgcctcaaggccaagccagagaacaagatgtgcttcgactgcaacgccaagaaccccacctgggcctccgtcacctacggcatcttcctctgcctcgactgctccgccgtccaccgcagcctcggagtacacatcaccttcgtcaggtcaacaaaccttgactcatggactccagatcagctcaagatgatggctttcggaggcaacaacagggcacatgctttcttcaaacagcatggatggaatgatggtggcaaagtcgaggcatagtacacatcaagagctgctgagttgtacaggcagatactttcaaaggaggtcgctaagagtgccaccaatgataatgccttaccgtcatcacctgtcgcatcggagccaccgaagccagccgatgacttccctg

SEQ ID NO: 39031 - protein, 103 aa, Panicum virgatum
  misc_feature: Ceres CLONE 1996708
  misc_feature (10)..(103): Pfam Name: ArfGap Pfam Description: Putative GTPase activating protein for Arf
MAFDAFTDKNAVFRRLKAKPENKMCFDCNAKNPTWASVTYGIFLCLDCSAVHRSLGVHITFVRSTNLDSWTPDQLKMMAFGGNNRAHAFFKQHGWNDGGKVEA

SEQ ID NO: 39032 - DNA, 670 bp, Panicum virgatum
  misc_feature: Ceres CLONE 1996712
  misc_feature: Encodes the peptide sequence at SEQ ID NO. 39033
tcattcccatcaaggagggggggtctcgccgctttctcctccctcctctttgcttcgctgcttcgacctcgcccaccagccatgccggcggacggctccaagggcgaaattaccttcgccggccgcttcaccgccagcgccatcgcagcatgcttcgccgagatatgcaccatccccctcgacacggccaaggtccgcctccagctgcagaagaccgtcgtgggggacgcaacagcgccggcggcgctgcccaagtaccgcggcctgctgggcaccgccgccactatagccagggatgaaggggccgccgcgctctggaaggggatcgtgccgggcctccaccgacagtgcatctacggaggactccgcattggcctctacgagcccgtcaagtccttctacgtcggccaagaccatgtcggggatgtgcccctctccaagaagattgccgccggcttcaccaccggtgccattgcaatcgccgttgccaaccccactgaccttgtcaaggtcaggctccaggctgagggcaagcttgccccaggtgcgccacgccgctatgctggcgccatggatgcctatgcaaagatcgctaggcaggaagggtttaccgctctctggaccggcctaggaccaaatgtagcacgcaacgctatcatcaacgctgctg

SEQ ID NO: 39033 - protein, 196 aa, Panicum virgatum
  misc_feature: Ceres CLONE 1996712
  misc_feature (11)..(111): Pfam Name: Mito_carr Pfam Description: Mitochondrial carrier protein
  misc_feature (117)..(196): Pfam Name: Mito_carr Pfam Description: Mitochondrial carrier protein
MPADGSKGEITFAGRFTASAIAACFAEICTIPLDTAKVRLQLQKTVVGDATAPAALPKYRGLLGTAATIARDEGAAALWKGIVPGLHRQCIYGGLRIGLYEPVKSFYVGQDHVGDVPLSKKIAAGFTTGAIAIAVANPTDLVKVRLQAEGKLAPGAPRRYAGAMDAYAKIARQEGFTALWTGLGPNVARNAIINAA

SEQ ID NO: 39034 - DNA, 728 bp, Panicum virgatum
  misc_feature: Ceres CLONE 1996714
  misc_feature: Encodes the peptide sequence at SEQ ID NO. 39035
acacaagccacaaggggcactgggtgtgcagcgacgacctgtacgaagagtcgactggcggtggaggcggagttccaagaacagccacccacgcgcgagaagtactcccagatggcatttgggaactgtgcgagtgattgggtttaactacgaatctaggggacaccgtcatggcatacttcccagaggaagtggtggagcagatccttggctatgtaacctcgcacagggatcgcaacgccacgtcgctagtgtcccgggcatggtaccacattgagcgccgtagccgccgctcggtgcttgtaagcaactgctatgcagtgcgcccagagcgtgtgcttgtgcggttccccagcatgcgctcgctgagcgtgaagggcaaaccacactttgctgacttcgaccttgtcccggcggggtggggcgccacggctgatgcatgggtggattcgtgcgcccgtgcgtgccctggccttgaggagctccggctgaagcggatggttgtgactgatgagtgcctcaaactgattgctggctcttttaccaactttaaatcacttgtccttgtcagctgcgaggggttcagcactgctggccttgctactatcgccaccaattgcaggtttcttaaggaactggacttacaagagagtgttgtgaaacctcgaggccatcattgggctaattgttttccaaagccttctacagaactagaatccttgaacttg

SEQ ID NO: 39035 - protein, 185 aa, Panicum virgatum
  misc_feature: Ceres CLONE 1996714
  misc_feature: Useful for making plants with altered carbohydrate content
MAYFPEEVVEQILGYVTSHRDRNATSLVSRAWYHIERRSRRSVLVSNCYAVRPERVLVRFPSMRSLSVKGKPHFADFDLVPAGWGATADAWVDSCARACPGLEELRLKRMVVTDECLKLIAGSFTNFKSLVLVSCEGFSTAGLATIATNCRFLKELDLQESVVKPRGHHWANCFPKPSTELESLN

SEQ ID NO: 39036 - DNA, 1399 bp, Panicum virgatum
  misc_feature: Ceres CLONE 1996718
  misc_feature: Encodes the peptide sequence at SEQ ID NO. 39037
agccacccacctcaaacgaatccagctgctgcttcttcctcctcgcgccgtcctcctccccctccccaatccgctcgttcccggaggggaggacgccccgtcgtgccccggaatcgatctgttccctcggtgaggcgcgccaccacgccccggcgttttcttttcttccgccgcaagtcaacgagccctgttctgcaatgatacagttcgtcccggattcggttgcttcacggcggggcgtttgctagtccgatccgtacgcctgtccgcgtccctggtcccgccgattgaaataggaatccgtctcctccgtcccctgtgcggcggcgcaaggtcgatcgatcgagctgttcctctccggtgcgcggagcggcgcggagagttctggtcgtgcgttgttcctggcaggggggaggatggagtccgggaggaagcctcggagcctgctggacatgtgcgtccagaagctcatcgacaacctccgctacgtggtcagggtcgacggcatcgagatggagctgctcaagcgcatcctgccgcactgcacgctggagcagctcacccgcatcgagaaccgcaccgagatggatattagcccggtaaccgattcgctgtggaagcgattctatcagcgggaattcggcgaggagcatacgaacatggtcatcaagaggatgaaagagagtggaggaagagcgcgttacacatggagggagctcttcaaggcgaaaacagagaagcaaaaggaagttgaagataagatgcttgagaaaattgcaaagaagtttcaggcagagaaagctgagaaacagagcaagcaaattaaactttgtacaaaggtgccaccaagcagcaaaagaagtttctttggagggagtggacctagcagtctatccaattccaattacaagagccctatactgaaaaaagccaggatagaggttaacagccatgcaagattgcaatgtgctatgcaaaagaataattttgggaggccatctcagccaataaggacaaactctggacagacaatgcgaacgacaacgattcatagacccaattcaaccatcaccatcaccaaaccgattggttcaaacaggcaaattcagaacagcatacccaaattctagagaggttttgctgcaaatggcgtgctcgactccagtgcttggcttctgcagaaagaatctcctttctacgagctgtgctacttgccatttcacgaagctcttgtgcccaaagaaacggtgtcttagtttttgcccagctgagaacttgcatttgtatcttaaggtgcagccatttggcaaaagagaaacgcaccaactgtaacatataagggcagtatcaatacttgtaagtcattttcttattaaagaaagaaacatgtttcttggtg

SEQ ID NO: 39037 - protein, 237 aa, Panicum virgatum
  misc_feature: Ceres CLONE 1996718
  misc_feature (9)..(142): Pfam Name: Elongin_A Pfam Description: RNA polymerase II transcription factor SIII (Elongin) subunit A
MESGRKPRSLLDMCVQKLIDNLRYVVRVDGIEMELLKRILPHCTLEQLTRIENRTEMDISPVTDSLWKRFYQREFGEEHTNMVIKRMKESGGRARYTWRELFKAKTEKQKEVEDKMLEKIAKKFQAEKAEKQSKQIKLCTKVPPSSKRSFFGGSGPSSLSNSNYKSPILKKARIEVNSHARLQCAMQKNNFGRPSQPIRTNSGQTMRTTTIHRPNSTITITKPIGSNRQIQNSIPKF

SEQ ID NO: 39038 - DNA, 683 bp, Panicum virgatum
  misc_feature: Ceres CLONE 1996719
  misc_feature: Encodes the peptide sequence at SEQ ID NO. 39039
atccaccctcatcggaagctccccaactccaagcctccttccagcagcgaagaagcgaagagccagccggagagcggcgatcgagcagcgtcgcgacaccagccagtcggatacaagcgatcccatggcgcccagaaggtcaccgtcgccggccgggagcagcggcagcggcagcgccgtgtgcgcgccggcggcggcggcggcggggcagcagccgaggctccgaggcgtgcggaagcggccgtggggccggtacgcggcggagatccgcgaccccgtacgcaaggcgcgcgtgtggctggggaccttcgacacgcccgaggacgccgcgcgcgcctacgacgacgccgcgcgccggctccgcgggccacgcgccgccaccaactacccggcccgggacccgaaggccgcggtggcggacgctccggcggcgagcgggagcgggagcgcggtgctgtccgaggacgcctcgtcctcgtcctcgtcctcctgccgggacttgccgctggcagtgacggtggccgtcgcggcgcacccgtcgctggacctgggcctgggcctggcgctaccggccatggcggccacggcgtcgtcgcaccacatgttcctggacccggccgcgacgatggtggccgtggcgccggcgctgctgcagttcctgccgcccaagagcgaggaagagc

SEQ ID NO: 39039 - protein, 186 aa, Panicum virgatum
  misc_feature: Ceres CLONE 1996719
  misc_feature (31)..(82): Pfam Name: AP2 Pfam Description: AP2 domain
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
MAPRRSPSPAGSSGSGSAVCAPAAAAAGQQPRLRGVRKRPWGRYAAEIRDPVRKARVWLGTFDTPEDAARAYDDAARRLRGPRAATNYPARDPKAAVADAPAASGSGSAVLSEDASSSSSSSCRDLPLAVTVAVAAHPSLDLGLGLALPAMAATASSHHMFLDPAATMVAVAPALLQFLPPKSEEE

SEQ ID NO: 39040 - DNA, 676 bp, Panicum virgatum
  misc_feature: Ceres CLONE 1996725
  misc_feature: Encodes the peptide sequence at SEQ ID NO. 39041
tatatcagataacacgactctacaagaataaggagcatgccgaagttgaatacacgattggaccaatccctgtcgatgatgacataggcaaggaggttatcacacgaatgacagcaaatatggtcacgaacagtacattttatactgattcaaacggaagggatttcctcaaaagggtgagaaacttcagggaagattgggatcttcaagttactcaacctgttgcaggaaattactacccggttaatctgggactgtatatagccgatggaaactatgaactatctgtacttgttgatcgtgctgttggagcatcaagtatccaggatggtcagctagagattatgctacacaggcgtatgcttaaagatgatgctcgaggtgttggagaaccactatatgaagttgtttgtgtgggtaaagattgccaggggctcacggccaggggcacttactatgtcaatgtcgaaaagatagggcatggagctcattggcgacgtacatacggccagcaagtctattcgcccttcctccttgcttttactcatgaggaggagacagaatggaaatcctacagtgttcctaaagctagcatgatggatgcaaactacagtcttcctgataatgtcgcaatcgtcactttgcagaatctagatgatggtaccacactactccg

SEQ ID NO: 39041 - protein, 224 aa, Panicum virgatum
  misc_feature: Ceres CLONE 1996725
  misc_feature (1)..(224): Pfam Name: Glyco_hydro_38C Pfam Description: Glycosyl hydrolases family 38 C-terminal domain
  misc_feature: SWISSPROT Homolog: EC 3.2.1.24 Alpha-mannosidase
YQITRLYKNKEHAEVEYTIGPIPVDDDIGKEVITRMTANMVTNSTFYTDSNGRDFLKRVRNFREDWDLQVTQPVAGNYYPVNLGLYIADGNYELSVLVDRAVGASSIQDGQLEIMLHRRMLKDDARGVGEPLYEVVCVGKDCQGLTARGTYYVNVEKIGHGAHWRRTYGQQVYSPFLLAFTHEEETEWKSYSVPKASMMDANYSLPDNVAIVTLQNLDDGTTLL

SEQ ID NO: 39042 - DNA, 712 bp, Panicum virgatum
  misc_feature: Ceres CLONE 1996730
  misc_feature: Encodes the peptide sequence at SEQ ID NO. 39043
gggaaaaatcggggaaagggagaaaaacctcgggcgaaagcgatgcacagttggacgcagcgcctgctgaccgcggcaacgacggccgccgtcctcctcgccgccgtctgcgcggccgcctccgcgcttgacgccttccacgtcccctccgtccaagcgcaagcccatgttacaaagattaaccggttccacaaacagatcaatggcaacgacaaggtgacgttgaccttcaatgtatctgcaaatttggagtcgctattcacttggaacacaaaacaggtctttgtctttgtgacagctgagtatgaaaacgcgaaaaattcactgaaccaggtatgctggtcaatgtgcatcctgtctgtaatagtattttcgagattgtctttgtgacagctgagtatgaaaacgcgaaaaattcactgaaccaggtatgctggtcaatgtgcatcctgtctgtaatagtattttcgagaacagagaactggttggaatcaataattgcttgaatcttgaaataagccttagtctgtttgaatcttgaaatcctccttgctcacctcaagataattcagtcttgtacctggcttccatctttgtgtataccaaaaaaattagtagcatctaagtcactatattgtatcacgaaattaagtaatgcattggtctttcttagatgctagtgtcattttcatcagatatatgtctttgatat

SEQ ID NO: 39043 - protein, 115 aa, Panicum virgatum
  misc_feature: Ceres CLONE 1996730
  misc_feature (5)..(115): Pfam Name: SPC22 Pfam Description: Signal peptidase subunit
MHSWTQRLLTAATTAAVLLAAVCAAASALDAFHVPSVQAQAHVTKINRFHKQINGNDKVTLTFNVSANLESLFTWNTKQVFVFVTAEYENAKNSLNQVCWSMCILSVIVFSRLSL

SEQ ID NO: 39044 - DNA, 709 bp, Panicum virgatum
  misc_feature: Ceres CLONE 1996738
  misc_feature: Encodes the peptide sequence at SEQ ID NO. 39045
ctcccttccgccgccacgccgccgcctccgttctgccgccgccacgcatccgcctccccttgagcttcctctcctcgctcgcctggataagccgcggcgcggcgctgcaccaccactgcccactgccctacgatctcttctattactactactccaaggaggcctggagcgaactccctcgccctccgctcggaatcccggcgaccggggcaagccgcagcaaaggctgcctatatctttgtccttctcggcccacttgcagggtgacgaagaagccttttctctcgacggcagtggcagcggacgagcgtttggaggacgggaagcttgctgtgcggctgtgcgcggctcaaaatcatagctcctcgcctgcttcttctcgccaagtgctctcctgcctcgccgatcccgcgggcacgatgagggtgaaggtgatatcgcgctccaccgaagagttcacgcgcgaccgcaggcaggacctgcagaaagtattccgcaactatgatccagggcttcgtagtcaagagaaagccgttgagtacactcgggcacttaatgctgcaaagttagagaagatatttgctaagccatttattggagctatggatggtcatattgatgcggtatcgtgcatggccaagaaccccaatcatttgaaagcaatattttctggttcaatggatggagatattcgcctttgggacatttc

SEQ ID NO: 39045 - protein, 96 aa, Panicum virgatum
  misc_feature: Ceres CLONE 1996738
  misc_feature (56)..(95): Pfam Name: WD40 Pfam Description: WD domain, G-beta repeat
MRVKVISRSTEEFTRDRRQDLQKVFRNYDPGLRSQEKAVEYTRALNAAKLEKIFAKPFIGAMDGHIDAVSCMAKNPNHLKAIFSGSMDGDIRLWDI

SEQ ID NO: 39046 - DNA, 736 bp, Panicum virgatum
  misc_feature: Ceres CLONE 1996749
  misc_feature: Encodes the peptide sequence at SEQ ID NO. 39047
gctatagagctgagtcacaggccacagccagacacactcacacacccaaggaggaggagaggaagctgcttttcagataagatggagatggcgttgctgcttcggcttgttgccctctcgctgctcctcgcagtggccactccagtcagggacatcaccgatgcgtgctcgtctcaagtcaaggctgcagacttcccgcacctgaacggctccgggctccacctgacgctgcaccacccgcggggcccctgctcgccggcgccgctacccgccgacctccccttctccgcggtgctcacccacgacgacgcgcgcgtcgcctcgctcgccgcgcgcctcgccaagacgccgtcctcgcggcccaccgcgctcggcgagtcgtcgtcgtcgtccacggtgcccgacgagtccctcgcgtccgtgccgctgggcccgggcacgtcgataggcgtgggcaactacgtcacccgcatgggcctcggcacgccggccaagtcgtacgtcatggtcgtggacacgggctcctcgctgacgtggctccagtgctccccgtgcgtggtgtcgtgccaccgccaggccggccccgtgttcaaccccaaggcgtccagctcctacgcctccgtctcctgctcggcgccgcagtgcggcgacctcacctccgccacgctcaaccccgccgcctgctccaagtccaacgtctgcgtctaccaggccagctacggcgacagctccttct

SEQ ID NO: 39047 - protein, 216 aa, Panicum virgatum
  misc_feature: Ceres CLONE 1996749
  misc_feature: SWISSPROT Homolog: EC 3.4.23.12 Nepenthesin
MALLLRLVALSLLLAVATPVRDITDACSSQVKAADFPHLNGSGLHLTLHHPRGPCSPAPLPADLPFSAVLTHDDARVASLAARLAKTPSSRPTALGESSSSSTVPDESLASVPLGPGTSIGVGNYVTRMGLGTPAKSYVMVVDTGSSLTWLQCSPCVVSCHRQAGPVFNPKASSSYASVSCSAPQCGDLTSATLNPAACSKSNVCVYQASYGDSSF

SEQ ID NO: 39048 - DNA, 723 bp, Panicum virgatum
  misc_feature: Ceres CLONE 1996751
  misc_feature: Encodes the peptide sequence at SEQ ID NO. 39049
aactaaaccccgcagccgccgcctctcgctctcctctcgcgccgccaccgcctctcgctctcctctcgcgccgccaccgccatacacctccgctccgatccgctcctttccttctccgctctacctctcagatccagcgcggcgattctccgcttcctagcccggctctcccgggccccttgtgctagtttggttgcattcagggggctaggttttagattcggagacatggcggaagtggaggactacgagattattagggagggtgaggccgagatcctccagctcaagaaaaacgccgtcttcttcaatcccgtgcaggttcacaacagagacatgtccattgctgttttaagggcctttgttgccaagcgcaaggaagaacatgaagcgctggcgaataagaggaataaatcgcatcaagaaaacaaacatagtgaaacatctgttcagaatggagaggatgcttcaactagccagcctgatgaaatggatgttgttcctgaaaaggatcaaagtcaagctcaagcgacaaaaacaccttcctggaaagtaaccagagaacttaagccgccacttgttcttgaggctttggctgcttctgggttgagatctctccggtatgcccgtgaagttgatggcttaggaaaggtagttgctctggacaatgataaagcttctgtcgattcttgcaagcggaacataaagttcaatggtgcttcc

SEQ ID NO: 39049 - protein, 164 aa, Panicum virgatum
  misc_feature: Ceres CLONE 1996751
  misc_feature: SWISSPROT Homolog: EC 2.1.1.32 tRNA (guanine-N(2)-)-methyltransferase
MAEVEDYEIIREGEAEILQLKKNAVFFNPVQVHNRDMSIAVLRAFVAKRKEEHEALANKRNKSHQENKHSETSVQNGEDASTSQPDEMDVVPEKDQSQAQATKTPSWKVTRELKPPLVLEALAASGLRSLRYAREVDGLGKVVALDNDKASVDSCKRNIKFNGA

SEQ ID NO: 39050 - DNA, 660 bp, Panicum virgatum
  misc_feature: Ceres CLONE 1996759
  misc_feature: Encodes the peptide sequence at SEQ ID NO. 39051
actattccgctctggcttctcacgcaaagcttacctcccttgcaaactagcaactgcaggtacttctagctttttcttttgttgcatcgccatcggccacctgctcctcagtcctcagtcctcacaaaagatccaagaattccagggcaggatttccaaaatggccacgccaagatcctcccccaactcctagcacatgccatgcgcaacaattttgatctctctctccgaaaagatttcattccattcaatcccattccgtccttttttgggttggtcataaagcagagctgctccttggatccacggcggtttagcggtttcctttcccctggctccgtgagattgatccaggctgcgatgagcggcggcaactcgtcgtggctgatgcctccgccgtcgccgccgcagcccccgccgtcggcgctcgacaacgtggaggccaagataagcccgagcatcctcttcatcgtggccatcctggcgatcgtcttcttcgactgcgccgtctgcctgtgcgagttctcgcccgacgaccagctccggctgctgcccaagtgcagccacgcgttccacctagagtgcatcgacacatggctgctctcgcactccacgtgcccgctctgccgccggagcctcctcgccgagctctcgccgacg

SEQ ID NO: 39051 - protein, 152 aa, Panicum virgatum
  misc_feature: Ceres CLONE 1996759
  misc_feature (101)..(142): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MRNNFDLSLRKDFIPFNPIPSFFGLVIKQSCSLDPRRFSGFLSPGSVRLIQAAMSGGNSSWLMPPPSPPQPPPSALDNVEAKISPSILFIVAILAIVFFDCAVCLCEFSPDDQLRLLPKCSHAFHLECIDTWLLSHSTCPLCRRSLLAELSP

SEQ ID NO: 39052 - DNA, 693 bp, Panicum virgatum
  misc_feature: Ceres CLONE 1996778
  misc_feature: Encodes the peptide sequence at SEQ ID NO. 39053
acggtaatactccagtcacgggtcacatatgcttgtagtctccaagtttccatgtgcccatgtcacatatcatcaaatgaaacagatttgtgacccctagcactatcagacatcttcataggcttgtggtttgttcggcaaatggccatcgggcgtgtccaaatgtttataatcttagtctgcataatctcgtaagttatagccatccttcatcgacacagatgactgtaccgataggggcgccagcaaaccatccagctctgctgctgtgcccacttgtgtgtatgtttggagcttgtcaagcgccggaagataccatcctgatcaaccgatagttggcgcgaatggagccagggaagacaacaaactgtggtagctgcggcacagctcatggagcatggcaacgccgccctattgctgctgctcgtgctcggcgtctcgacatggcagaccatcgggatggccagtggaacgagcctcaccggcggcagagaccggccgctagtgccggccatcctggtgttcggcgactccatcgtcgacacgggcaacaacaacgcggtcctcacgctcaccaaggccgacttcagcccctacggcaaggacctcaacggcggcgtccccaccggccgcttctctaacggccggattcccccagacttcttagcttcgcggctcggcttgaaagacctg

SEQ ID NO: 39053 - protein, 100 aa, Panicum virgatum
  misc_feature: Ceres CLONE 1996778
  misc_feature: SWISSPROT Homolog: EC 3.2.1.51 Alpha-L-fucosidase
MEHGNAALLLLLVLGVSTWQTIGMASGTSLTGGRDRPLVPAILVFGDSIVDTGNNNAVLTLTKADFSPYGKDLNGGVPTGRFSNGRIPPDFLASRLGLKD

SEQ ID NO: 39054 - DNA, 704 bp, Panicum virgatum
  misc_feature: Ceres CLONE 1996783
  misc_feature: Encodes the peptide sequence at SEQ ID NO. 39055
taatggtttcagttaagtcatcgttgttattccctgctgatacctcagagttgtttctgttgtcacctggatcgcctcaccatgaaggttctagagggctcttgggcttcctactattgcggatgcatactatgcatgacaaatgatgatcaaggtacctggtggttggcattttggtggccaaaagtgttggataggtaacaacacttttgcagatatgctcatcattttagctagatatgcatatacaaaccaattaaatgggtaatcatcttctctttcttgcctttatgttgccctctattgttggtaaatgtcaacctgaagttatatctattgcctatcaaatgtcaatgcaaggattatcctgcttgctaatactgaacttgattatcaaatgtcaaggcagggtcaggaacacatggcctagggagatctaaaaactggtgcagttctttgcgagaaaatacactgcctgtttgatgaacccgtgatggaattgatgtggggcctgaagaacatgatgaagagtttagtgcctgctgaaacatgtgaactgactacggaggaccgccgccacatgagtaaaggaatgcaattgatcctgattcctgaataagtatgacttcaaagtggagccagagatggtgagctcatttcttcctttcccatatctcagatcggtgagccagagatggtcgatg

SEQ ID NO: 39055 - protein, 41 aa, Panicum virgatum
  misc_feature: Ceres CLONE 1996783
  misc_feature: SWISSPROT Homolog: EC 1.3.3.6 Acyl-CoA oxidase
MMIKVPGGWHFGGQKCWIGNNTFADMLIILARYAYTNQLNG

SEQ ID NO: 39056 - DNA, 676 bp, Panicum virgatum
  misc_feature: Ceres CLONE 1996786
  misc_feature: Encodes the peptide sequence at SEQ ID NO. 39057
gagtgctctgctctgctgctctacactgtgctgagctgccaagatcttgcacaggcagacgccgcaccaccgtttcctatcgccagttgcgagctttgcctgccactcctcgtgccgtactggtggtcaaattggtcggcatcaagcgtgtgtcgatcatggccatggggagccgccgaattaggattgctggtgccccgccggcgtcggcgctgatgctgaccttgctctgcgcgtcgtgggtgctcgccgcggcgcagaactacagtgccatcttcaacttcggcgactccatcacagataccggcaacctgtgcaccaacggcaggccgtcgcagatcaccttcacccagcctccctacggcgagacctacttcggcaccccgacatgccgctgctccgacggccgcgtcatcgtcgacttcctgagcgaccagttcggactaccgttcctgccgccgtccaagtcgagcagcgcggacttcaagcacggcgcgaacatggcgatcacgggcgcgacggccatggacgcgcccttcttccggtcgctggggctctccgacaagatctggaacaacgggcccatcagctttcagctccactggttccagcagatcgccacttccgtctgcgggcaaagttgcgcaagctatctggccaactccctattcgtgtt

SEQ ID NO: 39057 - protein, 170 aa, Panicum virgatum
  misc_feature: Ceres CLONE 1996786
  misc_feature: SWISSPROT Homolog: EC 3.2.1.51 Alpha-L-fucosidase
MGSRRIRIAGAPPASALMLTLLCASWVLAAAQNYSAIFNFGDSITDTGNLCTNGRPSQITFTQPPYGETYFGTPTCRCSDGRVIVDFLSDQFGLPFLPPSKSSSADFKHGANMAITGATAMDAPFFRSLGLSDKIWNNGPISFQLHWFQQIATSVCGQSCASYLANSLFV

SEQ ID NO: 39058 - DNA, 1243 bp, Panicum virgatum
  misc_feature: Ceres CLONE 1996789
  misc_feature: Encodes the peptide sequence at SEQ ID NO. 39059
aatccccccggctcggcggcggccggctcaccagcggtaccagcagcaatggggaggtacagcccttcgtaccatagcccgccaaggagaggacatggcggcaggggaaggagcccgccgcctaggagaggctatggtggtggtggtggtggtggcggccgtggagggcgagatgaccaaggttctgttagcctcctggtccgcaacattccgctgagatgcaggcctgaggagcttcgagtccctttcgaaaggtttggtcctgtgagggatgtttacctcccaagagattatcacactggggagccaagggggtttggatttgtggagtttgttgatgcttatgatgcttctgaggcgcaataccacatgaaccgccagatgttttctggtcgtgagatcactgttgttcttgctgcggatacacggaaaaggcctgatgaaatgcgtagacgaatggggccaaggggttattctgatcatgaagggcgtcgatcttctcgccgtggacgttctcgttcatactcacgttcacgctctccgcgcccccgaggccgtgctagatcccggtcatactctcctgcccccagaaggcgtgatgactactctgcctccccaccacgggcaaaggaagaagagcacagaaggtcatcgaagcagcctaaagaacacaatggtgataagaagtgtagatcctatacacctgaggataggaatgaccgccgtggtgcagacaatggtcatgatgagaggaagaggtccccaggtgcagcagcagatgacgatgaggagcctcgtcgtgggcgccgcaggtcaccccggctggtgtcggtgtcgcccccagggtcgcggtcgaggtcggcgtcaccagccaatagcggctgatgtgaaacgggtggctgctactagataggcaggcgttatttgtagctttccttattatacgccaaagtgtatcgcgccaaagtgtatcgctccgtctcatctgtgtgagggatggttgaaggttagtagtcgccgtcagaagttgcgaggtttgttgccgagaatggtggacttggatgtacgacgagaggcgagaatgatggacggactgaaggtagaatggaaagagtcgagaatgatggattgtggtgttttgttgttgtggagtgagggagcgagttgataaactagctgttcggtgttgttctaagttgattgatcgatgacatggtgattgattgtgtggtgttttgctgcc

SEQ ID NO: 39059 - protein, 278 aa, Panicum virgatum
  misc_feature: Ceres CLONE 1996789
  misc_feature (49)..(120): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGRYSPSYHSPPRRGHGGRGRSPPPRRGYGGGGGGGGRGGRDDQGSVSLLVRNIPLRCRPEELRVPFERFGPVRDVYLPRDYHTGEPRGFGFVEFVDAYDASEAQYHMNRQMFSGREITVVLAADTRKRPDEMRRRMGPRGYSDHEGRRSSRRGRSRSYSRSRSPRPRGRARSRSYSPAPRRRDDYSASPPRAKEEEHRRSSKQPKEHNGDKKCRSYTPEDRNDRRGADNGHDERKRSPGAAADDDEEPRRGRRRSPRLVSVSPPGSRSRSASPANSG

SEQ ID NO: 39060 - DNA, 729 bp, Panicum virgatum
  misc_feature: Ceres CLONE 1996795
  misc_feature: Encodes the peptide sequence at SEQ ID NO. 39061
atctctcgctctacggccggcgcagagtagagcaggctgtgtactagctagcgagttaaagcagctagcaggctgatcattaagcggcgccagcgatggcgaaggtcgccgcgggccggcaggcggcgtccttcgtgctcggctgcgtcgccgcgctgacagtggtcgtgctcatcctgcagcgccgccccgaggagctcacccgtcccagggcgccggtgcaattcttcgccggctcgaggtcgaagtcgtcaccatcatcaggacgacgcggcggggcatcatcttccggatcctcgtcgtcgtcgacgccggcaggtcagacgacggcgatcgtcgcagctgatgatggccaaccgcaggcagccgttcccgtgcaggccaacgccacaaagctgaagcctgcagctgctggcgcaggcggcgctaccactgctgctgcggccgccgatgatctacgccgcgttccggccactcccgcacatcgccaacaagagggcgaggccgcggacgacgacgccgagttcccgggcctggccgccgtggtggcgcgcgcggcgacggcggacgaccggacggtgatcatcacgtgcgtgaaccacgcgtgggcggcgccggggtcgctgctggacctcttcctggagagcttccgcgtgggcgacggcatcgcggacctgctgggccacgtcctcatcgtggccatggacccgacggccatggcccgctgcc

SEQ ID NO: 39061 - protein, 211 aa, Panicum virgatum
  misc_feature: Ceres CLONE 1996795
  misc_feature: Useful for making plants with altered carbohydrate content
MAKVAAGRQAASFVLGCVAALTVVVLILQRRPEELTRPRAPVQFFAGSRSKSSPSSGRRGGASSSGSSSSSTPAGQTTAIVAADDGQPQAAVPVQANATKLKPAAAGAGGATTAAAAADDLRRVPATPAHRQQEGEAADDDAEFPGLAAVVARAATADDRTVIITCVNHAWAAPGSLLDLFLESFRVGDGIADLLGHVLIVAMDPTAMARC

SEQ ID NO: 39062 - DNA, 741 bp, Panicum virgatum
  misc_feature: Ceres CLONE 1996800
  misc_feature: Encodes the peptide sequence at SEQ ID NO. 39063
ccctccctcccctcgcctctcccacctcaatcctagacgccaccacacccatccatacacacacgccgcaggcgcgcgcctcccgcacaaaggaaaagaacgaggccatggcgccgagaacgtcggagaaaacgatggcaccggcggcggcggcgccggggctcgcgctcggcgtcggcccgcacttccgcggcgtcaggaagcgcccgtggggccggtacgcggcggagatccgcgacccggccaagaagagccgcgtgtggctcggcacgtacgacacggccgaggaggctgcgcgggcctacgacaccgccgcgcgagagtaccgcggcgccaaggccaagaccaacttcccctacccttcgtcgtcgcccatgcccccggcagccaccgccggcaccggcggcagccggagcggcgacagcagcaccgtggagtccttcggcggcgacgtgcaggcgcccatgcaggccatgccgctgccgccgtcgctcgagctggacctgttccacagcgcggcggccgcgggcgccggcgccggcgtgcgcttcccgttcggcagctaccccgtgacgcacccctactacttcttcggccaggccgccgcggggtgccacatgcagctgaagctgccgccgccgacggtgaccgtggcggccgtggcgcagagcgactccgactcctcgtcggtggtggacctgtcgccgccgccgctcgccggcgccgtgtcggcgaagaagg

SEQ ID NO: 39063 - protein, 211 aa, Panicum virgatum
  misc_feature: Ceres CLONE 1996800
  misc_feature (25)..(76): Pfam Name: AP2 Pfam Description: AP2 domain
  misc_feature: Useful for making plants with altered alkaloid content
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
MAPRTSEKTMAPAAAAPGLALGVGPHFRGVRKRPWGRYAAEIRDPAKKSRVWLGTYDTAEEAARAYDTAAREYRGAKAKTNFPYPSSSPMPPAATAGTGGSRSGDSSTVESFGGDVQAPMQAMPLPPSLELDLFHSAAAAGAGAGVRFPFGSYPVTHPYYFFGQAAAGCHMQLKLPPPTVTVAAVAQSDSDSSSVVDLSPPPLAGAVSAKK

SEQ ID NO: 39064 - DNA, 671 bp, Panicum virgatum
  misc_feature: Ceres CLONE 1996809
  misc_feature: Encodes the peptide sequence at SEQ ID NO. 39065
actagctaccttgcgagtgctctgtctatccgcagggccatcctgtactgctgtacagtggtggtggctgtgcagagtgcagagcagcagagatgggcgccgccactgctaccagagctctagtacggctgcagctcgccgcggcggccgtcgtcgtggcgtgggcgtgctgcggcttccgcccgtcggcggcgcagctgcaggtgggctactacaacgccacctgcccgggcgccgagaccctcatcgagaccatcgtccacgccgccgtccgaaaggacgccggcaacgggcctggcctcatccgcctcttcttccacgactgcttcgtcaggggctgcgacgcgtcggtgctgctggacgacccgacgggcaccccgggcaacaggacggtggagaagacctcgccgcccaacttccccagcctccggggcttcgccgtcatcgaccgcgccaagcgcgtggtggagcgccgctgcccagggaccgtctcctgcgccgacatcgtcgccttcgcggcgcgcgacgccgcgcgcatcatgggcgggatcaaattcgccatgccgtcgggccgcctcgacggccgcatctccaacgcctccgaggccgtcgccaacctgcccccggcctccttcaacctcacccagctcgtcgcgcgcttcgcggccaag

SEQ ID NO: 39065 - protein, 192 aa, Panicum virgatum
  misc_feature: Ceres CLONE 1996809
  misc_feature (52)..(192): Pfam Name: peroxidase Pfam Description: Peroxidase
  misc_feature: SWISSPROT Homolog: EC 1.11.1.7 Peroxidase
  misc_feature: Useful for making plants with altered carbohydrate content
MGAATATRALVRLQLAAAAVVVAWACCGFRPSAAQLQVGYYNATCPGAETLIETIVHAAVRKDAGNGPGLIRLFFHDCFVRGCDASVLLDDPTGTPGNRTVEKTSPPNFPSLRGFAVIDRAKRVVERRCPGTVSCADIVAFAARDAARIMGGIKFAMPSGRLDGRISNASEAVANLPPASFNLTQLVARFAA

SEQ ID NO: 39066 - DNA, 1329 bp, Panicum virgatum
  misc_feature: Ceres CLONE 1996823
  misc_feature: Encodes the peptide sequence at SEQ ID NO. 39067
aaaaacgcgatcagctctgctctcttcttctcatctcgtttgcctcccctagcctgtcccgtgcgcttgggggagacgagcacattctccgccgctcgctcatcaaagctctcggcttcctcttttctactcccgttctttaattttaccgtaatctttgttcgattgattctgctcctgttcaatttaatccgtgttagatttagctgcttcttctattgctgttttacttctgtttcttctatctattgtgtgcttgctcttggtcttgtaccgtttcttctgaccatggatgcaggctcccactcgatctcctccgagaagagccgtgccgcggcgccgcgtccgccgctgcaggaggccggttcccgcccctacatgccgtcgctgagcacggggtcgcgcaacccgtcggccaagtgctacggcgacagattcatcccggacaggtcagcgatggacatggacatggcgcactacctgctcacggagtccaagaaggacaaggagaacgcggcggcgtcgtcgccgtccaaggaggcgtaccggaggctgctagccgagaagctgctcaacaacaggacgcggatcctcgccttcaggaataagcctccggagcctgagaatgtctccgctgacgtggcttcctcccacctgcaagccaagccggccaagcagcggcgccacattccccagtcagctgagaggactctggacgctccagaccttgttgatgactactacctcaaccttctggactggggaagcaacaacgtgttgtcaattgctttgggcgacacggtgtacctgtgggacgcctcgagcggatccacatctgagcttgtgaccgtcgacgaggacagtggtcccatcaccagcgtcagctgggctcccgacggccggcacatcgccgttgggctcaactcgtctgatgtccagctctgggacactagctccaaccgactgttgagaactctcagaggtgtgcatgaagcaagagttggctcgctggcatggaacaacagcatcctgacaaccggcggcatggacggcaaaattgttaacaatgatgtgaggattaggaaccatgtcgtgcagacgtacgaggggcacagccaggaggtgtgcgggctcaagtggtccgggtcggggcagcagctggcgagtgggggcaacgacaaccttctgcacatttgggatgtgtcgatggcatcctccgtcccgtctgctggccgcaaccagtggctgcacaggcttgaggaccacatggccgctgtgaaggctctcgcttggtgcccgttccagagcaacttgctggcaaccggcggt

SEQ ID NO: 39067 - protein, 346 aa, Panicum virgatum
  misc_feature: Ceres CLONE 1996823
  misc_feature (266)..(304): Pfam Name: WD40 Pfam Description: WD domain, G-beta repeat
  misc_feature (182)..(220): Pfam Name: WD40 Pfam Description: WD domain, G-beta repeat
  misc_feature: SWISSPROT Homolog: EC 2.3.1.48 Histone acetyltransferase
MDAGSHSISSEKSRAAAPRPPLQEAGSRPYMPSLSTGSRNPSAKCYGDRFIPDRSAMDMDMAHYLLTESKKDKENAAASSPSKEAYRRLLAEKLLNNRTRILAFRNKPPEPENVSADVASSHLQAKPAKQRRHIPQSAERTLDAPDLVDDYYLNLLDWGSNNVLSIALGDTVYLWDASSGSTSELVTVDEDSGPITSVSWAPDGRHIAVGLNSSDVQLWDTSSNRLLRTLRGVHEARVGSLAWNNSILTTGGMDGKIVNNDVRIRNHVVQTYEGHSQEVCGLKWSGSGQQLASGGNDNLLHIWDVSMASSVPSAGRNQWLHRLEDHMAAVKALAWCPFQSNLLATG

SEQ ID NO: 39068 - DNA, 511 bp, Panicum virgatum
  misc_feature: Ceres CLONE 1996823-R
cgccaaggcttcctacactgggatgttcaacagcttcaaccatatccgataggatggctcatgagaacaagctcttctattggatatggtcccagcatactcgagttagatcacctcataccgagggtctatcttccttggctaaccaggcggcgtgaaggaggaagcaatcctctgcatcatttagtagctttcaggagggtcaagaatcaatggcagagtttggttcgttgacgtcttcaacacccagtacatcggattgcagatcctaaaatatggaaacgctggtacctacagattagatacatcagggccttgccttgctgtgatgggaatttagcttctagtatacgtagtacttatgtagtcagtattgatgtacatcgaaatacagtgcttctgttattttccccttttggttggtgcaacatcaaaagttcagtttgatgtggcagttattagttgtacatcgcctcaagtttataatggaatatttgcccccttttccctt

SEQ ID NO: 39069 - DNA, 751 bp, Panicum virgatum
  misc_feature: Ceres CLONE 1996844
  misc_feature: Encodes the peptide sequence at SEQ ID NO. 39070
acccaaacccaatccttccaaatccatttccctccctccccatcccgccccccttccctgtccacttcctcccagccgccaccgccgccggtgatccgagtcgccgcggaccaccagccagccatgtcgtgctcccacctctccaccgcctggtcctcctcggcgctcgccagcagcgcctcctccacccggcggcgctcctccgccccgcgctccggcggcagcggtctggtggtgcggtgctccctccgcgagctccgcagccgcatcgactccgtccgcaacacgcagaagatcaccgaggccatgaagctcgtggccgccgccaaggtccggcgcgcgcaggaggccgtcgtctcctcccgccccttctcggaggccctcgtggaggtgctctacaacatgaaccaggagatccagacggaggacatcgacctgccgctcacccgcacccgccccgtcaagaaggtcgccctcgtggtcctcaccggcgagcgtggcctctgcggcagcttcaacaacaacgtgctcaagaaggcggacacccgcatcgaagagctcaagcagctgggcctccagtacacagtcgtcagcgtgggcaagaagggcaacgcctacttccagcgccgcccttacatcccgctggagcgggagctggaggtgaacggcgtgcccaccgtcaaggattcacaggccatctgcgacctcgtctactcgctcttcgtctccgaggaggtggacaaagtggagc

SEQ ID NO: 39070 - protein, 209 aa, Panicum virgatum
  misc_feature: Ceres CLONE 1996844
  misc_feature (40)..(209): Pfam Name: ATP-synt Pfam Description: ATP synthase
  misc_feature: SWISSPROT Homolog: EC 3.6.3.14 H(+)-transporting two-sector ATPase
MSCSHLSTAWSSSALASSASSTRRRSSAPRSGGSGLVVRCSLRELRSRIDSVRNTQKITEAMKLVAAAKVRRAQEAVVSSRPFSEALVEVLYNMNQEIQTEDIDLPLTRTRPVKKVALVVLTGERGLCGSFNNNVLKKADTRIEELKQLGLQYTVVSVGKKGNAYFQRRPYIPLERELEVNGVPTVKDSQAICDLVYSLFVSEEVDKVE

SEQ ID NO: 39071 - DNA, 698 bp, Panicum virgatum
  misc_feature: Ceres CLONE 1996858
  misc_feature: Encodes the peptide sequence at SEQ ID NO. 39072
acacacacacactactctcgttaacatcgagaagaggggggccagcttcacttcggaagctcagcctcgcaggatgcaacaagaacatggccaagcttcaatggttgagaaggggtgtgacagctgcaggaagtggcaagagcactactactgggagcacatggatgtgagcaagatccgcttcttcaagctcatgaccggagattttgccaagggcactagcataccagagaagtttgcacagaatttcaaggggcagattactggagggtttgaactgaaagcgccgagtggcaaaacatggcacatcagtgtagataagcgtggagatgaactgttcctcatgtcaggatgggaggattttgttaaggctcatgaactacaggagaatgatctcctgctcttcacatgctgtggcaactcttcctttcaggtgctagtcttcgaagcaagtggttgtgagagagtgtcttctatgtttggcgaccgaattggtcctgatatgtgcaaacatgtcaagaatatcgcgggtcaacatggtaagcattgctctgtgaatgattctgaggacactacgataccgtcacagctggttagatcccctcacaacgcctcttcttcgaagaaattaagtgggaagactaaaccaagtgaatatgaagctccaaccacaagcaacttcattgtcaagcattctg

SEQ ID NO: 39072 - protein, 199 aa, Panicum virgatum
  misc_feature: Ceres CLONE 1996858
  misc_feature (27)..(120): Pfam Name: B3 Pfam Description: B3 DNA binding domain
MVEKGCDSCRKWQEHYYWEHMDVSKIRFFKLMTGDFAKGTSIPEKFAQNFKGQITGGFELKAPSGKTWHISVDKRGDELFLMSGWEDFVKAHELQENDLLLFTCCGNSSFQVLVFEASGCERVSSMFGDRIGPDMCKHVKNIAGQHGKHCSVNDSEDTTIPSQLVRSPHNASSSKKLSGKTKPSEYEAPTTSNFIVKHS

SEQ ID NO: 39073 - DNA, 641 bp, Panicum virgatum
  misc_feature: Ceres CLONE 1996873
  misc_feature: Encodes the peptide sequence at SEQ ID NO. 39074
gaaaattccccacacgcgcccaccctccccctctcctctctttctttccacacccctctgcgtccgtgcgctgtgttgttggggggccaaactgccaggggcaatggcggccgggcgggagctggtggtgagtttcggcgagatgctgatagacttcgtgccgacggtggcgggggtgtcgctggcggaggcgccggccttcctcaaggcccccgggggcgcgcccgccaacgtcgccatcgccgtctcgcgcctcggcggcggggccgccttcgtcggcaagctcggcgacgacgagttcggccgcatgctcgcggccatcctccgcgacaacggcgtcgacgacggcggcgtcgtcttcgacgcgggcgcgcgcaccgcgctcgccttcgtcaccctgcgcgccgacggggagcgcgagttcatgttctaccgcaaccccagcgccgacatgctcctcaccgccgccgagctcaacgtcgagctcatcaagagggctgcagtctttcactacggatcaataagcttgattgctgagccttgccggtcagcacatctccgtgcgatggagattgccaaagaggctggtgcactgctctcttatgacccaaacctgagggaggcattgtggccatcccgtg

SEQ ID NO: 39074 - protein, 179 aa, Panicum virgatum
  misc_feature: Ceres CLONE 1996873
  misc_feature: SWISSPROT Homolog: EC 2.7.1.4 Fructokinase
MAAGRELVVSFGEMLIDFVPTVAGVSLAEAPAFLKAPGGAPANVAIAVSRLGGGAAFVGKLGDDEFGRMLAAILRDNGVDDGGVVFDAGARTALAFVTLRADGEREFMFYRNPSADMLLTAAELNVELIKRAAVFHYGSISLIAEPCRSAHLRAMEIAKEAGALLSYDPNLREALWPSR

SEQ ID NO: 39075 - DNA, 1098 bp, Panicum virgatum
  misc_feature: Ceres CLONE 1996886
  misc_feature: Encodes the peptide sequence at SEQ ID NO. 39076
tcagttacttctccttcctccaaactaacccaagttaccccgcgccgagtggcattttccctccctctcctcctgtgcggccaccccccttggatttcactctcagctgctatatcaaccaaggatgcacaaagctgaatgtttgattaagcatgggaagactaaagacgggagctctacaaggagcttggactatttaaccatggagcaggcagcacacgggatatctgatggaatgtacacttataagcatcgttgtgagggaggagttgatatccatgacatcgtggtcaagaagagcagattcagaattcttctgtatcatatcggcacaatctgccttctcatgactgtttgccgcatcctgttggcaaaggagactttaggccttggttccctttggagtatttcctttgctggtgtaattgcaaaatggttgcgatgtgatcctgtgaagaaagagtcgttggtgatcatgccgacttttggggttcaattagagcaacacttttggagtggtagagttcatcgcaaatttgtgcccgctggcaagattctaagaccagtgctgaacgagtgtgtgacccctttcactttctactggagcttggcactgcttctacgagacgaatatggcctcatgcttgttttcaagaacttgaatccaccagctaagatgttggtcccagtctggaaagcattatgtgcattcgtggactcgaatactttgagcgcttctgtattacctcaattacacgatccacataaacatgctgaacagacgggggaagtgtgcactcctgactctgactgcacattgaacatttgatccctgaagactttgattactgacagcagaatgttcatgtttccatacaaatgactgaagacacagaatattactacttaagcatcaggaattccgttacccacttgtacctttgtccatcgtgtaattctgccttttaatattgacagattcatctcctgcgtattcgagaaaaaaaatattcagagattcatgttctggcagttcgttatactgaaaaatcattggctggcactcctgctgacattaaaaaatagtcacttgcaggc

SEQ ID NO: 39076 - protein, 234 aa, Panicum virgatum
  misc_feature: Ceres CLONE 1996886
  misc_feature: SWISSPROT Homolog: EC 2.4.1.198 Phosphatidylinositol N-acetylglucosaminyltransferase
MHKAECLIKHGKTKDGSSTRSLDYLTMEQAAHGISDGMYTYKHRCEGGVDIHDIVVKKSRFRILLYHIGTICLLMTVCRILLAKETLGLGSLWSISFAGVIAKWLRCDPVKKESLVIMPTFGVQLEQHFWSGRVHRKFVPAGKILRPVLNECVTPFTFYWSLALLLRDEYGLMLVFKNLNPPAKMLVPVWKALCAFVDSNTLSASVLPQLHDPHKHAEQTGEVCTPDSDCTLNI

SEQ ID NO: 39077 - DNA, 1387 bp, Panicum virgatum
  misc_feature: Ceres CLONE 1996887
  misc_feature: Encodes the peptide sequence at SEQ ID NO. 39078
cttgtttttctctctcctgcgctgcgccgtcgctcgtctccgccgtcgaatccgagactccgatctcgggttcaccgcagcgcaccaagcctccgacctccagttcaatccgctctcctctccgcgcgtcagtcatggcaggaatggcaccagagggctcccagttcgatgctaagcactacgactctaaattgcaggaactgctgagcactggcgagactgaggacttcttcactccatatgaagaagtttttgaaagttttgatgacatgggcctccaagagaatctgctgagaggcatttatgcttatggttttgagaagccttctgcaattcagcagagaggaattgttcccttctgcaaggggcttgatgtcatccagcaggcacaatcaggaactggaaagactgcaactttctgttctggtatcttgcagcagctcgactacagcttggttgagtgtcaggccttggtccttgccccaacccgtgagcttgcccaacaaattgagaaagtcatgcgggccctcggtgactaccttggtgtgaaagttcatgcatgtgtgggaggaacctctgtccgtgaagaccaaaggatccttgcaagtggtgttcatgttgttgttggaacacctggtcgtgtgtttgacatgctgcgcaggcagtccctccgccctgaccacatcaagatgtttgtcctggatgaagctgatgagatgctttctcgtggtttcaaggatcagatctatgacatcttccagctcctcccagcaaaaattcaggttggagttttctctgctaccatgcctcctgaggcccttgagatcacccgcaagttcatgaacaagcctgtgagaatccttgtgaagagggatgagcttacccttgaaggtatcaagcagttctatgtgaatgtggagaaggaagattggaaactggacacgctatgtgacctgtacgagaccctggccattactcagagtgtcatctttgtgaacacccggcgcaaggtggactggcttactgataagatgaggagcagggaccatacggtgtctgccactcacggtgatatggaccagaacactcgggacatcatcatgagggagttcaggtctggttcatcccgtgtgctcattaccacagacctccttgctcgtggtattgatgtgcagcaggtgtccctggtcatcaactacgaccttcccacccagccggagaactatctgcatcgcattggtcgtagtggtcgttttggtaggaagggtgttgccatcaactttgtgacccgtgatgacgagaggatgctttttgatatccagaggttctacaacgtggtgattgaggagctgcccgccaacgttgctgaccttctgtgagcaaattg

SEQ ID NO: 39078 - protein, 414 aa, Panicum virgatum
  misc_feature: Ceres CLONE 1996887
  misc_feature (65)..(231): Pfam Name: DEAD Pfam Description: DEAD/DEAH box helicase
  misc_feature (299)..(375): Pfam Name: Helicase_C Pfam Description: Helicase conserved C-terminal domain
  misc_feature: Useful for making plants with altered alkaloid content
  misc_feature: Useful for making plants with altered lignin content
  misc_feature: Useful for making plants with altered terpenoid content
MAGMAPEGSQFDAKHYDSKLQELLSTGETEDFFTPYEEVFESFDDMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPANVADLL

SEQ ID NO: 39079 - DNA, 722 bp, Panicum virgatum
  misc_feature: Ceres CLONE 1996905
  misc_feature: Encodes the peptide sequence at SEQ ID NO. 39080
acaccagcaccaccaaagagaaatcattgccgggcagccgcaccatcaactgagagcagcggcgagcaccttgcagctgcagctcccatggcttccgctcccgtgtccgttccccgcatcaagctcggctcgcaggggctggaggtctccgcgcagggcctcggctgcatgggcatgtccgccttctacggcccgcccaagccggagcctgacatgatcaagctcatccaccacgccgtcgccgccggggtcaccttcctcgacacctccgacatctacggcccgcacaccaacgagatcctcctcggcaaggcgctgcaaggcggggtgcgggagaaggtggagctggccagcaagttcggcatctccttcgctgacggcaagcgcgagatccgcggggacccggcgtacgtccgggcggcgtgcgagggcagcctcaagcggctgggcgtggattgcgttgacctctactaccagcaccgcatcgacaaaagagtgcccatcgaggtcacgatgggtgaactcaagaaactagttgaagaaggaaagataaagtacattggattatctgaagcatcggcgtcaacaattagaagagctcatgcagtccatcctattactgcagttcaacttgaatggtcattatggtgtagagatgtagaagaagatataattcccacttgcagggagcttggaattggaattgtagcttacagtccact

SEQ ID NO: 39080 - protein, 211 aa, Panicum virgatum
  misc_feature: Ceres CLONE 1996905
  misc_feature (14)..(211): Pfam Name: Aldo_ket_red Pfam Description: Aldo/keto reductase family
  misc_feature: SWISSPROT Homolog: EC 1.1.1.65 Pyridoxine 4-dehydrogenase
MASAPVSVPRIKLGSQGLEVSAQGLGCMGMSAFYGPPKPEPDMIKLIHHAVAAGVTFLDTSDIYGPHTNEILLGKALQGGVREKVELASKFGISFADGKREIRGDPAYVRAACEGSLKRLGVDCVDLYYQHRIDKRVPIEVTMGELKKLVEEGKIKYIGLSEASASTIRRAHAVHPITAVQLEWSLWCRDVEEDIIPTCRELGIGIVAYSP

SEQ ID NO: 39081 - DNA, 688 bp, Panicum virgatum
  misc_feature: Ceres CLONE 1996906
  misc_feature: Encodes the peptide sequence at SEQ ID NO. 39082
caactcgcaccaccaccgcaccgctcgccctcgcctccgacagcgaccgcgcaaccgcgtcgtcatccccggccccggcgcctctcttctcctccgcagccgcctccgtcctctgtgcagccctgagcgtatcggccggagccacgcggcgcgagacagccgagaccgagaggaccagagcagcaagcacttgcacggagacgcgtcactgacgacgatgtcgacgacctccgccaactccgcggcggtgtccggcctggactacgacgacacggcgctcacgctcgccctcccgggctcatcctcctccgccggctccgacgaccgcaagcgcgcccacgccggccacgacaagtcgccctccccaaaggcgcgggccgtggggtggccgccggttcgcgcgtaccggcgcaacgcgctgcgcgacgacgaggccaagctcgtcaaggtggccgtggacggcgcgccgtacctgcgcaaggtggacctcgcggcgcacgacgggtacgcggcgctgctccgcgagctgcgcggcatgttcgcctcctgcctcggcgccggcgccgccgggaggctcgtcgacgccgccaccggcgccgagtacgtgcccacctacgaggacaaggacggcgactggatgctcgtcggagacgtccccttcaagatgttcgtcgactcgtgcaagcgg

SEQ ID NO: 39082 - protein, 156 aa, Panicum virgatum
  misc_feature: Ceres CLONE 1996906
  misc_feature (14)..(156): Pfam Name: AUX_IAA Pfam Description: AUX/IAA family
  misc_feature: The sequence is a functional homolog of SEQ ID NO 736 in the 10/374,780 US patent application
  misc_feature: The sequence is a functional homolog of SEQ ID NO 738 in the 10/374,780 US patent application
MSTTSANSAAVSGLDYDDTALTLALPGSSSSAGSDDRKRAHAGHDKSPSPKARAVGWPPVRAYRRNALRDDEAKLVKVAVDGAPYLRKVDLAAHDGYAALLRELRGMFASCLGAGAAGRLVDAATGAEYVPTYEDKDGDWMLVGDVPFKMFVDSCK

SEQ ID NO: 39083 - DNA, 1120 bp, Panicum virgatum
  misc_feature: Ceres CLONE 1996914
  misc_feature: Encodes the peptide sequence at SEQ ID NO. 39084
gaaccgaacggcgcctccctcccgcggctgcgtagggttctcctcctcctcctccgatcagccgtcagcgagcactctccgacaagatctctcctccccgtgctccttggatggcgaccagcgaggagctagcgcagatcgacatctccaaggaggagaaggacaagctggtgaatgacgtgatgcgctacgtgctcttcaagacgcaccaggcttccggctgccccatcaagcgggaggagctcaccgggatcatcaccaagaactaccgtcagcgcggcctgcccacgctcatcatcaacgaggccagggacaggctcgctgccaccttcgggtacgagatgagggagctccagaggacccgcgccccatccacacgctttggccgggcgtcggagccgcaaccgaatgcggaggcgaagagctatgttctggtcagccagatagaccctgaggtgcatagcgagtgggttgaggacaaggaggctgcccctctgtctgctttttcttttgctgtcattagccttgttcaccttgctggtggcaaagcctccgaagaggacctctggcatcagttgaagcggctgggtttgatggagaacgatgagaagcaccctgtttttggtaacaataagcaggcgcttgaacgtcttgtgcagcaaaggtacttgctgaaggagaaacttgctggacccgaaggtcatgttgtgatgtatgagcttgctgagagggcattggatgaatccatcagtgggagtctcaaagcctacatttcaaagattgtgggcacaagcactgccacagaagaaacttcaagttgatatgatgacatttgatcaggtatctgccctgtttgttgcgctcgaggacaagctgactccattcaggcttggaagctatatcgtcttgcatggccggccgttcgtctgtcaaagcagggcgtattttgtacaggacagaagtgtgcttctctgaataggcggtagtgtctttaactgaacaatgttcactacatgcagtaaccaccttagcattgcttggattaccatttgtcaggcagtgtacgtttgtgccgtagaacgcagctgaagaccttattcagtagaccgtattgtttgtc

SEQ ID NO: 39084 - protein, 236 aa, Panicum virgatum
  misc_feature: Ceres CLONE 1996914
  misc_feature (24)..(217): Pfam Name: MAGE Pfam Description: MAGE family
MATSEELAQIDISKEEKDKLVNDVMRYVLFKTHQASGCPIKREELTGIITKNYRQRGLPTLIINEARDRLAATFGYEMRELQRTRAPSTRFGRASEPQPNAEAKSYVLVSQIDPEVHSEWVEDKEAAPLSAFSFAVISLVHLAGGKASEEDLWHQLKRLGLMENDEKHPVFGNNKQALERLVQQRYLLKEKLAGPEGHVVMYELAERALDESISGSLKAYISKIVGTSTATEETSS

SEQ ID NO: 39085 - DNA, 1178 bp, Panicum virgatum
  misc_feature: Ceres CLONE 1996923
  misc_feature: Encodes the peptide sequence at SEQ ID NO. 39086
gtacttgcaacagcaacgccaccaacaaagcccccaagctagcagctctcctctcactactccagcatcgtgctcgtcgatcaccggccggcttctctcttactgattgccgagttcaggggagtttgcagcggaggcgccaccatgagctacgggggaagctcgtccggcgggcgcggcgggcggcggctggagtacggcaggacctacgtggtgaggcccaaggggaggcaccaggcgaccattgtgtggctccacggcctcggcgacaatggcgcaagctggtcccagctcctggattctcttccactgcccaatatcaaatggatttgccctactgcaccaacacggcctgttgcggctttcggtggattcccttgcactgcatggttcgatgtggaggagacttcattggatggccgagatgatatcgaaggacttgatgcttcagcagctcatgtcgcaaacctactgtcctctgagccatccgatgtgaggcttgggatcggaggattcagcatgggtgctgcggctgcccttcactctgctgcatgctatgctcatgggagattcacaaatggcattgcctatccgatcaccctcagtgttgtcgtcggtttaagtggctggcttccttgctctaggaccctgaggagcaaaattgagaactcacagactgcacttagaagagcttctgcgttgccaatcctgctcaaccatggaagagccgatgaggttgtcacctacaggaacggtgagaggtcggctgagattctgcgatcctcagggttccagtatacgtatttcaaagcctacaatggacttggtcactataccatccctgaagaaatggatgatgtcagcaagtggctcagctcaaggttggggcttgaccgaccttgcggctaacctgaaaacatgctggcggtgcgatggctttggtagtgagatatagaaagaagtattgacaatatgcagaaggttgataggttatgtgaattgtgagttgtgactgtcatggcttggtaggcagtaaccccatgagctttcctcacacatacatatcatgttagtttaccggtaatgtaccttgttaccactaaagaggatgcccgtaatgtagtattgtattgcttgtttgattacattagtaataatgctcttgagtcttctttaaa

SEQ ID NO: 39086 - protein, 254 aa, Panicum virgatum
  misc_feature: Ceres CLONE 1996923
  misc_feature (18)..(247): Pfam Name: Abhydrolase_2 Pfam Description: Phospholipase/Carboxylesterase
  misc_feature: SWISSPROT Homolog: EC 3.1.1.1 Carboxylesterase
MSYGGSSSGGRGGRRLEYGRTYVVRPKGRHQATIVWLHGLGDNGASWSQLLDSLPLPNIKWICPTAPTRPVAAFGGFPCTAWFDVEETSLDGRDDIEGLDASAAHVANLLSSEPSDVRLGIGGFSMGAAAALHSAACYAHGRFTNGIAYPITLSVVVGLSGWLPCSRTLRSKIENSQTALRRASALPILLNHGRADEVVTYRNGERSAEILRSSGFQYTYFKAYNGLGHYTIPEEMDDVSKWLSSRLGLDRPCG

SEQ ID NO: 39087 - DNA, 679 bp, Panicum virgatum
  misc_feature: Ceres CLONE 1996924
  misc_feature: Encodes the peptide sequence at SEQ ID NO. 39088
gtcctccgcctcgccgccaccaccggcgctctccctccactcccccctccacctcacctcccatggcgatagcccctccacccgcacactctcctcatccctaaccctagatcccacccccactctcacaccacaaccacaaacgcaaaccgcactcctcccttgtccccccatctcctccgtccgtctccatggaggcgggcaccggcaccggctgcagcgcccggacgctggcggcgtgcgtcatcggcggcatcgtgctgggcgcatccgtgctcgcgctccacctcgcggggcccgtgtcccttccgtccctgccgccgctcgacgcggtcaggcgccggcttcgccgccgccccgtgcgcgtctacatggacggctgctttgacatgatgcactacggacactgcaacgcgctgcgccaggctcgcgccctcggggacgagctcatcgtcggcgtcatcagcgacgaagagatcaaggccaacaaagggccgcctgttacgccgctccacgagagaatgataatggtccgtgctgtgaaatgggtggatgatatcattccagatgcaccttatgctataaccgaagaattcatgaacaagctattcactgagtacaacatagattacattatccatggtgacgatccttgcttgctacccgatgggactgatgc

SEQ ID NO: 39088 - protein, 162 aa, Panicum virgatum
  misc_feature: Ceres CLONE 1996924
  misc_feature (60)..(160): Pfam Name: CTP_transf_2 Pfam Description: Cytidylyltransferase
  misc_feature: SWISSPROT Homolog: EC 2.7.7.14 Ethanolamine-phosphate cytidylyltransferase
MEAGTGTGCSARTLAACVIGGIVLGASVLALHLAGPVSLPSLPPLDAVRRRLRRRPVRVYMDGCFDMMHYGHCNALRQARALGDELIVGVISDEEIKANKGPPVTPLHERMIMVRAVKWVDDIIPDAPYAITEEFMNKLFTEYNIDYIIHGDDPCLLPDGTD

SEQ ID NO: 39089 - DNA, 719 bp, Panicum virgatum
  misc_feature: Ceres CLONE 1996928
  misc_feature: Encodes the peptide sequence at SEQ ID NO. 39090
acgactcactctcagatccacccccaacacgcgaagaccgagcccagcgatgccgccgccgccgccgccgcaggccaacgcggggaaggtgaccccgaaccttgccatggacgcagaggccacgcgcatgctcaacctcaccgtgctccagcgcctcgaccccgccgtcgaggacatcctaatcaccgccgcgcacgtcacgctctacggcttcaacatcgacctcaaccagtggagccgcaaagacgtggaagggtcgctgttcgtcgtcaagaggaactcgcagccgaggttccaattcattgtcatgaacaggcgcaacactgataatctggtggaggatctattaagcgattttgaatatgaacttcagcccccatatttgttgtaccggaatgctgcgcaagaagtaaatggtatttggttttataaccaacatgactgtgaagctgttgcaaggctttttggaagaatactgaatgcttacgccaaagtgcctccaaaaccaaaagtgccttccacaaaaagtgagtttgaagaattggaggctgttccgacatctgctgcaatagatggcccccttgaacctccgccatcatccagtgctctagtttccgatgcacctgatgaatcactggccaattacttcagtggtgctgctagcattgggagtgtaccaagtgcacaaatggctggaagagcgcatccatccgctgaag

SEQ ID NO: 39090 - protein, 223 aa, Panicum virgatum
  misc_feature: Ceres CLONE 1996928
  misc_feature (21)..(143): Pfam Name: DCP1 Pfam Description: Dcp1-like decapping family
MPPPPPPQANAGKVTPNLAMDAEATRMLNLTVLQRLDPAVEDILITAAHVTLYGFNIDLNQWSRKDVEGSLFVVKRNSQPRFQFIVMNRRNTDNLVEDLLSDFEYELQPPYLLYRNAAQEVNGIWFYNQHDCEAVARLFGRILNAYAKVPPKPKVPSTKSEFEELEAVPTSAAIDGPLEPPPSSSALVSDAPDESLANYFSGAASIGSVPSAQMAGRAHPSAE

SEQ ID NO: 39091 - DNA, 701 bp, Panicum virgatum
  misc_feature: Ceres CLONE 1996929
  misc_feature: Encodes the peptide sequence at SEQ ID NO. 39092
atcatcacccaccgccgccgacacagccgccgcccgccggagcaccttgactgcttgagcgtagtttaggagagaggattcgaggagtgatgtctaccgaggaggctgccgctgcggcgaccgaggtccccgcgaccgaggtcgagtccgaggcgccggccgccgaggaggcggaggcgaagcccgccaaggccaagaaggcggcgcccaaggagaagaaggcccccaaggagaagaaggcggccaaggagaagaagcccgccgcggcgaggaagccggccgcccacccgccgtacgccgagatgatctcggaggcgattgcggcgctcaaggagaggaccgggtcgagctcggtggccatcggcaagtacgtggaggagaagcacggcgggcagctgccgcccaacttccgcaagctgctggccgggcagctcaagaagctcgccgccgcggggaagctgacccgcgtcaagaactcgttcaagctgccggccgccgccgacgccaagtccaaggcgcccaagcccgccgccgcggccaagccgaagccagccaaggccgccaagcccgccgtcaagcccaaggcgtccccgaaggcgaagaccaagaccgccgccaagcccaaggcggccgccgcctcccccaagcgcaaggccaaggccgccgccgccgcccccgccgcggcgcccaagccccgcggc

SEQ ID NO: 39092 - protein, 203 aa, Panicum virgatum
  misc_feature: Ceres CLONE 1996929
  misc_feature (65)..(135): Pfam Name: Linker_histone Pfam Description: linker histone H1 and H5 family
MSTEEAAAAATEVPATEVESEAPAAEEAEAKPAKAKKAAPKEKKAPKEKKAAKEKKPAAARKPAAHPPYAEMISEAIAALKERTGSSSVAIGKYVEEKHGGQLPPNFRKLLAGQLKKLAAAGKLTRVKNSFKLPAAADAKSKAPKPAAAAKPKPAKAAKPAVKPKASPKAKTKTAAKPKAAAASPKRKAKAAAAAPAAAPKPR

SEQ ID NO: 39093 - DNA, 1428 bp, Panicum virgatum
  misc_feature: Ceres CLONE 1996933
  misc_feature: Encodes the peptide sequence at SEQ ID NO. 39094
tggtcacacacccacacagcagcgcagcggagaagaccgcgacgcgaccccacaccacccccaagccgagcgcgagcgggatccctcccgtccgtgttgccctctgcctcctcctcctcctccaccccgtcgcttccgtgccatccgcggctcgcctccccacctcccattcccggcgcccgatgcctcccgcccgcccgtagccgcccgacgacgaccgccatggccgccgattccgtcaaaggggtggccgacctggagatcgggctggcgtcgccggggtcggagggcgcgccgtcgccggcgtccagcgccggcgcctccggggagcggcccgaccagtccccggcgcgggcggccaagcgccccggcctcgtcatgtccttctccgggaagcgcctggaccagtcgccgtcgcgcccggtgctcgtcatgtcccactccagcaaccgcctcgaccagtcgcccgcgcgcccggtgctcgtcatgtcgcgctccagcaaccggctcgaccagtcctccccggcgtcgtcgccgtcgctggcgcccgccagggggcccgtgctcgtcatgtccggctccagcaatcggctcgacagctcgcagccgtcgccgtcgccgtcgccgacggccgcggccgccgcgccgccggtgctggtgctctccaactccggcaagcggatggaccaggctgggcggaagaagtacgtcaagcaggtgacgggccgccacaacgacacggagctccacctcgccgcgcagcgcggggacctcgaggccgtgcgccagatcatcgcagagatcgacgcgcagatgaccggcaccggcgaggagttcgacagcgaggtcgctgagatccgcgctgccatagtgaacgaaaccaacgagatggaggagactgctctgctcatcgccgccgagaaggggtttcttgacatcgtcgttgagctgctcaaacactccgacaaggacagcctcacaaggaagaacaagtctggattcgatgctctgcacgtcgctgcaaaagagggccaccgagatattgtgaaggtacttctggaccatgatccatccctcgggaagacgtttggccaatcaaatgtgactcctctcataactgcggccattagaggccacactgaggtggtcaacctgctgctagagcgtgtctctgggttggttgaattatcaaaagcgaatggaaagaatgccttgcacttcgctgcccggcaggggcatgttgaaattgtgaaggctttgctagatgctgaccctcagcttgctcggaggactgataagaaaggccagactgctctacacatggcagtgggaactagtgctgaagttgttcaagggcttgtgaatgctgatccggctatagtcatgctacctgatagaaatggcaatttagctttgcatgttgcaacc

SEQ ID NO: 39094 - protein, 401 aa, Panicum virgatum
  misc_feature: Ceres CLONE 1996933
  misc_feature (326)..(358): Pfam Name: Ank Pfam Description: Ankyrin repeat
  misc_feature (258)..(290): Pfam Name: Ank Pfam Description: Ankyrin repeat
  misc_feature: SWISSPROT Homolog: EC 2.7.11.1 Non-specific serine/threonine protein kinase
MAADSVKGVADLEIGLASPGSEGAPSPASSAGASGERPDQSPARAAKRPGLVMSFSGKRLDQSPSRPVLVMSHSSNRLDQSPARPVLVMSRSSNRLDQSSPASSPSLAPARGPVLVMSGSSNRLDSSQPSPSPSPTAAAAAPPVLVLSNSGKRMDQAGRKKYVKQVTGRHNDTELHLAAQRGDLEAVRQIIAEIDAQMTGTGEEFDSEVAEIRAAIVNETNEMEETALLIAAEKGFLDIVVELLKHSDKDSLTRKNKSGFDALHVAAKEGHRDIVKVLLDHDPSLGKTFGQSNVTPLITAAIRGHTEVVNLLLERVSGLVELSKANGKNALHFAARQGHVEIVKALLDADPQLARRTDKKGQTALHMAVGTSAEVVQGLVNADPAIVMLPDRNGNLALHVA

SEQ ID NO: 39095 - DNA, 714 bp, Panicum virgatum
  misc_feature: Ceres CLONE 1996937
  misc_feature: Encodes the peptide sequence at SEQ ID NO. 39096
tgttaaacttggtctgatgtccttgcttgctgtgtttaaggacattattccaagttatcggattaggcaactaacagaaaaggagctagcagtagaagtttcaaaagaagtgaagaaaactagatattatgagtacacacttatccgctgctacaaggcatatctacagaaattgatatcattggagaagcaaccccatttttattctgtggctgttcgatgcatgtgcgctttattagatacagctccgcattttaacttccgtgaaagcctattggccagtgtggcaaaaaatttaagctcctcagacgatgtagtaaggaaaatgtgttgtgaaacaataagatcaatatttataaatgaaggaaaacaccgtggcgaggcaacaattgaagcagtaaggttgattgcagatcatgtgaagcttaatgattgccagctccatcccgatagcattgaggtcttcctgtctttgagatttgatgaagatcttagagaagatgaaaccgaggagcaaaaggtgaaaccaaagaagaataaacatcggcaaaatcaggaggccccaaagccattgacagttagtgataagaagaaaaccagacaggaactgatctcaaaagctagagaggaggttgatgcagatcttagggcagtttccttcacccttgatcccaaggagagaaaaaggatacaaagagaaacactttctgctct

SEQ ID NO: 39096 - protein, 237 aa, Panicum virgatum
  misc_feature: Ceres CLONE 1996937
  misc_feature (1)..(54): Pfam Name: NOC3p Pfam Description: Nucleolar complex-associated protein
VKLGLMSLLAVFKDIIPSYRIRQLTEKELAVEVSKEVKKTRYYEYTLIRCYKAYLQKLISLEKQPHFYSVAVRCMCALLDTAPHFNFRESLLASVAKNLSSSDDVVRKMCCETIRSIFINEGKHRGEATIEAVRLIADHVKLNDCQLHPDSIEVFLSLRFDEDLREDETEEQKVKPKKNKHRQNQEAPKPLTVSDKKKTRQELISKAREEVDADLRAVSFTLDPKERKRIQRETLSA

SEQ ID NO: 39097 - DNA, 717 bp, Panicum virgatum
  misc_feature: Ceres CLONE 1996941
  misc_feature: Encodes the peptide sequence at SEQ ID NO. 39098
tcacacttgagtttttagaacgtattacaaataagttttctgagcagaacatcgttggccgtggtgcgtatggagttatttacaagggagtactggacaatggagaagagattgctgtcaagaagcttcaccaaatgttgtggaatgacaatgaacaatttaagaatgagcttaataatcttatgagggtcaaacacaaaaatatcgtccggttagttggttactgccacaatatagcacacattcttgttgagtacaaatgagaacttgtttctgctagggtggagcaaagagctctttgcttggaatacttgcagggaggaagccttgacaagcatatttccgatgaggcctgtagacttgactgggacacatgttacaaaataatcaaaggagtttgtgagggtttagattaccttcataatggacctgatggtcccatttaccatctggacttgaaacctgcaaatatattgttggataaagacatggtgccaaaaattggtgattttggtttgtcaagactctttgattcgatagaaacctatatgacacaatcccaagatgttatcggaacacatggatacatgccaccagaatacatcaacagacagacaatcagtcagaagtctgacgttttcagcctgggtgtcataatcatacaaatgatggcaggaaagaagggctactttgattgtgcagacacacctcccgaag

SEQ ID NO: 39098 - protein, 86 aa, Panicum virgatum
  misc_feature: Ceres CLONE 1996941
  misc_feature: SWISSPROT Homolog: EC 2.7.11.1 Non-specific serine/threonine protein kinase
TLEFLERITNKFSEQNIVGRGAYGVIYKGVLDNGEEIAVKKLHQMLWNDNEQFKNELNNLMRVKHKNIVRLVGYCHNIAHILVEYK

SEQ ID NO: 39099 - DNA, 1242 bp, Panicum virgatum
  misc_feature: Ceres CLONE 1996947
  misc_feature: Encodes the peptide sequence at SEQ ID NO. 39100
gtgtccggcgctccagatcggctcggctctgccccccatgcgcccagcggcccaccccatttgaccgtctcgcctcgcccccgcaccagtgactcgacttcctccgcgaaccgccaccgccacctcacccaccacctcgccggagatcacgagaggagcctcgccgctgccctcccgcccgccatgggggatgccgcctccggccgcggccacgttgtctaccctccccgctccgccgaggacatcttcaaggactaccgcgcccgccgctccgccatcctccgggccctcacccacggtcagtgagctcgactctccctccctccctctgctcccttcgctccccgaaccctaatcctcgcccagcgggtacctgagcgggtacctgaccgcgctcgattgcttccctcgttcgcagacgtcgaggacttctacgcgcagtgcgatccagagaaggagaacctctgcctgtacgggtacgcgaacgaggcctgggaggtggcgctgccggcggaggaggtgccaacggagctgccggagcccgcgctggggatcaacttcgcgcgcgacggcatgaatcgccgcgactggctcgcgctcgtcgccgtccactccgactcatggctcctctccgtcgctttctactacgctgctcggctcaatcggaatgaccggaaacgtttatttggtatgattaacgaattgcaaactgtttttgaagttgtctccggtgcgagacaacaacaatctaaggagaggtccagtatggacaatggtgggagggccaaaccctcagtaaagatagaaaataacggaaaagcatcagaagatgcatacggagaagatgacagtgatcacggtgaaactctatgtggtacctgtggtggtatatacagcgcagatgagttctggattgggtgcgacatctgcgagaggtggtatcacggcaagtgcgtcaagataactcccgccaaggcagaaagcataaaacattacaagtgcccgagctgcagctccaagagggctaggcagtagcaaagcttatggatgcttcagagtgctggatgtatgctgcagtggtggcagtgcaaagtttgcctgcaggagaagctccatttacaagattagctatcttcgttgtaccttatgcttactttacctatgatgaagctaatgtgaggaacgatgagacatttgacaaccagaggcacttgagttgaatgcccctagataaatggggtg

SEQ ID NO: 39100 - protein, 153 aa, Panicum virgatum
  misc_feature: Ceres CLONE 1996947
  misc_feature (99)..(149): Pfam Name: PHD Pfam Description: PHD-finger
  misc_feature: SWISSPROT Homolog: EC 2.1.1.43 Histone-lysine N-methyltransferase
  misc_feature: Useful for making plants with altered lignin content
  misc_feature: Useful for making plants with modulated flowering time
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Useful for making plants with altered alkaloid content
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1981 in the 11/479,226 US patent application
MNRRDWLALVAVHSDSWLLSVAFYYAARLNRNDRKRLFGMINELQTVFEVVSGARQQQSKERSSMDNGGRAKPSVKIENNGKASEDAYGEDDSDHGETLCGTCGGIYSADEFWIGCDICERWYHGKCVKITPAKAESIKHYKCPSCSSKRARQ

SEQ ID NO: 39101 - DNA, 455 bp, Panicum virgatum
  misc_feature: Ceres CLONE 1996950
  misc_feature: Encodes the peptide sequence at SEQ ID NO. 39102
  misc_feature (307)..(307): n is a, c, t, g, unknown, or other
accatcccgaaaccccatcgcaactactccaatccccgaccccaaacccccaatccacccacacccccctcatccactccgggcggcggcggcggctgctttaagtgcggggagcctggccacatggccagggactgctccagcggcggaggaggctatggaggtggcggctacggaggaggcggcggcggtgcctgctacaactgcggccagaccggccacatggcgagggactgcggctccggcggcggcggcggcggccgcttcggaggtggcggcggcggcggcggcgaccgctcctgctccngctgcggccggagcggccccctggcgagggactgcgccgcgtgagatcgggccggatctcgccgccgccgtcgcctccgcgcccgcccccgccgccggggctcccgtctccgcgccgctctccgtctcctccgcctgcgcccctccct

SEQ ID NO: 39102 - protein, 116 aa, Panicum virgatum
  misc_feature: Ceres CLONE 1996950
  misc_feature (31)..(48): Pfam Name: zf-CCHC Pfam Description: Zinc knuckle
  misc_feature (64)..(81): Pfam Name: zf-CCHC Pfam Description: Zinc knuckle
  misc_feature: The sequence is a functional homolog of SEQ ID NO 468 in the 11/479,226 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1126 in the 11/479,226 US patent application
  misc_feature: The sequence is a functional homolog of SEQ ID NO 2410 in the 10/374,780 US patent application
  misc_feature: The sequence is a functional homolog of SEQ ID NO 492 in the 10/412,699 US patent application
  misc_feature: The sequence is a functional homolog of SEQ ID NO 552 in the 10/225,066 US patent application
  misc_feature (103)..(103): Xaa is any aa, unknown, or other
TIPKPHRNYSNPRPQTPNPPTPPSSTPGGGGGCFKCGEPGHMARDCSSGGGGYGGGGYGGGGGGACYNCGQTGHMARDCGSGGGGGGRFGGGGGGGGDRSCSXCGRSGPLARDCAA

SEQ ID NO: 39103 - DNA, 625 bp, Panicum virgatum
  misc_feature: Ceres CLONE 1996955
  misc_feature: Encodes the peptide sequence at SEQ ID NO. 39104
attgcagtgcttcgtaaacactctcctctgaatgagatccaggtggtagatggggtaaaaagtgagcagagtatctcaaaagacaagactgggaaacttgaggaagatttgggatcagataaggtatcatctgaagaaaatattgtgccccagcaagtggttgataacacaaatgttgttgatggagaacaaaatggagacatggatagcaaaagttcaaaagataagagctctgaggatgctaaggtgattgttaaggagacagaaaaagctcaagcaggaacaagagataggaggcagcagaaccaaggcaggtggagaggggttgaccctgttatattttttaaagatgaagtgacaatcaaaagtatagtttctttctatggtatcaaggattcatttccacttgaaggtcatctcgtgactaggaatcctgatattagtcatgttaagagaatatactacgtgtcaaaatctgttcaagatgttttggagctcaacataaaagttggcgagcggcttaagatcacctcacttggcctaaagatatttgaaagacagtcatcaaaggaaggctcaccgtgcacgtttagattgtcctctgagggattgccactcctgcttc

SEQ ID NO: 39104 - protein, 208 aa, Panicum virgatum
  misc_feature: Ceres CLONE 1996955
  misc_feature: SWISSPROT Homolog: EC 2.1.1.29 tRNA (cytosine-5-)-methyltransferase
IAVLRKHSPLNEIQVVDGVKSEQSISKDKTGKLEEDLGSDKVSSEENIVPQQVVDNTNVVDGEQNGDMDSKSSKDKSSEDAKVIVKETEKAQAGTRDRRQQNQGRWRGVDPVIFFKDEVTIKSIVSFYGIKDSFPLEGHLVTRNPDISHVKRIYYVSKSVQDVLELNIKVGERLKITSLGLKIFERQSSKEGSPCTFRLSSEGLPLLL

SEQ ID NO: 39105 - DNA, 581 bp, Panicum virgatum
  misc_feature: Ceres CLONE 1996956
  misc_feature: Encodes the peptide sequence at SEQ ID NO. 39106
atcactctggtctcgtcacaccccaccccaccaaacaatggcggcggcggcggcggcggcggcagcggcggcctcctccttcccctccgcccgcagggaaaggaccaggtcctgggcctggtccgcccgcccttcccttgtctccctccgctccggagccctgctcagggtccgcgccgccgccgaacccgccccggccttccactccgtgacggccttcgcgcccgctaccgtggccaacctcggcccgggcttcgacttcctcggatgcgccgtcgccgacgcctccctctccctcggcgacacggtgacggccaccctggaccccaccctgccccccggcactgtctccatcgcctccgtcacctccccgtcccgcccccacctcgccgcccgcctctccaaggacccgctccgtaactgcgcgggcgtggccgccatcgcggcgctccgcgccctcggcgtccggtcccacgccgtgtccatccagctgaccaggggcctgccgctgggctcgggcctgggctcctccgcggcctccgccgtcgccgccgccaaggccgtggaccccctcttcggct

SEQ ID NO: 39106 - protein, 181 aa, Panicum virgatum
  misc_feature: Ceres CLONE 1996956
  misc_feature: SWISSPROT Homolog: EC 2.7.1.39 Homoserine kinase
MAAAAAAAAAAASSFPSARRERTRSWAWSARPSLVSLRSGALLRVRAAAEPAPAFHSVTAFAPATVANLGPGFDFLGCAVADASLSLGDTVTATLDPTLPPGTVSIASVTSPSRPHLAARLSKDPLRNCAGVAAIAALRALGVRSHAVSIQLTRGLPLGSGLGSSAASAVAAAKAVDPLFG

SEQ ID NO: 39107 - DNA, 708 bp, Panicum virgatum
  misc_feature: Ceres CLONE 1996957
  misc_feature: Encodes the peptide sequence at SEQ ID NO. 39108
ctccctgcctcgtccgccccctttcccctccgcgtccagggcccgagccacccacccagccgcggatccgaggcgcagacccgaagatccggcgatggcgtccacggcggcgaggcggctgcgggagctgcaggcgcaggcggggaacaagacctgcgtggactgtgcgcagcggaacccgcagtgggcgagcgtctcctacggggtgttcatgtgcctcgaatgctcgggcaagcaccgcggcctcggcgtgcacatcagcttcgtgcgctccgtcaccatggactcctggaccgaggcgcagctccgcaagatggaggccggcggcaacgaccgcctcaacgccttcctcgccgcgcggggcgtgcccaaggagacgccccacgtcgccaagtacaactccaacgccgcggccgcctaccgcgaccgcatcgtcgctctcgccgagggcaggccgtggaccgacccgcccgtagtcagggagacgcccggatctggggcgcccgctgccgccaggaagccgcccgtgcacgcctccgccgcctccggaggcggcgacggcggctgggacgagtgggacgacgacttccggccggacatgaggcggaaccaatcggttggatcattcgccgccgcggggacgcagtcggggaggcagccgccgaggtccaaatcgacgcaggacatgtacactaggcagcagctgga

SEQ ID NO: 39108 - protein, 204 aa, Panicum virgatum
  misc_feature: Ceres CLONE 1996957
  misc_feature (6)..(122): Pfam Name: ArfGap Pfam Description: Putative GTPase activating protein for Arf
MASTAARRLRELQAQAGNKTCVDCAQRNPQWASVSYGVFMCLECSGKHRGLGVHISFVRSVTMDSWTEAQLRKMEAGGNDRLNAFLAARGVPKETPHVAKYNSNAAAAYRDRIVALAEGRPWTDPPVVRETPGSGAPAAARKPPVHASAASGGGDGGWDEWDDDFRPDMRRNQSVGSFAAAGTQSGRQPPRSKSTQDMYTRQQL

SEQ ID NO: 39109 - DNA, 633 bp, Panicum virgatum
  misc_feature: Ceres CLONE 1996961
  misc_feature: Encodes the peptide sequence at SEQ ID NO. 39110
ccgacatcgacgcatcccctgcttctctccaagtccaatccacccctcgatcctccggccatccccctccctagcggcgaaaccctagcccgccccccgccccgcgccgcccggcccgtatgtcggctgcttgatcggcccagcagtccgacccacctctgcccttggccccccatctgatgttcctctcccgcatcgtcctgcgcgacctggactccatcgactccccggcctccatggcgtcctcgaagaaggtggtgacccgcgacgagtgggagcggaagctccgcgacgtcaagatccgcaaggaggacatgaaccgcctcgtcatgaacttcctcgtcaccgagggcttcgttgacgccgccgacaagttccgcatcgagtccggcacccagccggagattgacctagcgaccatcacggaccggatggaggttaagaaagcagtacaatcggggaatgttcaggaggccatcgagaaaatcaacgatcttaatcccacgattctggacacgaatccccaactatactttcatcttcagcaacagaaactaatagagttgattcgcgcgggaaaaataagtgaagctttggagtttgctcaggaagagctcgcaccaagaggcgaag

SEQ ID NO: 39110 - protein, 132 aa, Panicum virgatum
  misc_feature: Ceres CLONE 1996961
  misc_feature (25)..(51): Pfam Name: LisH Pfam Description: LisH
MASSKKVVTRDEWERKLRDVKIRKEDMNRLVMNFLVTEGFVDAADKFRIESGTQPEIDLATITDRMEVKKAVQSGNVQEAIEKINDLNPTILDTNPQLYFHLQQQKLIELIRAGKISEALEFAQEELAPRGE

SEQ ID NO: 39111 - DNA, 689 bp, Panicum virgatum
  misc_feature: Ceres CLONE 1996970
  misc_feature: Encodes the peptide sequence at SEQ ID NO. 39112
cacaagcagctcttcctcgccccaacagccgtttctcagatctttttcaacaccggcactccagcagtgcacagcaagggcatctgctctgcatttcttcgcctgatccagtccaaccggagagagtgtttttatcggaggctattggcccagcttcttcaacctccattgtttctgctagaaagataaaaaatccctttcccctatcctataagagatcactttcttccctgtttgaggacagtgaaaccattggacgccgcttagaaacttcttgatatttctaaggggcgataaggcagggaatgagtacaaccaaggtgaagagacgtgtggggaagtatgagctcggtcggaccataggtgaaggcacattcgcaaaggtcaggttcgcaaagaacactgagacaggcgaaccggtagccatcaaggtcgtagataaggagaaggtcctcaagcacaagatggttgaacagattaagcgggaaatttcgacaatgaagttgatcaagcatcccaatgttgttcgcatatatgaggtgatgggaagtaaaacaaagatctacattgtgttagaatatgctacaggtggcgagctctttgacataattgctaaccatggtcgaatgagggaagatgaggccaggaggtacttccaacaattaatcaatgcagttgattattgtcac

SEQ ID NO: 39112 - protein, 127 aa, Panicum virgatum
  misc_feature: Ceres CLONE 1996970
  misc_feature (13)..(127): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated salt sensitivity
  misc_feature: Useful for making plants with modulated biomass
MSTTKVKRRVGKYELGRTIGEGTFAKVRFAKNTETGEPVAIKVVDKEKVLKHKMVEQIKREISTMKLIKHPNVVRIYEVMGSKTKIYIVLEYATGGELFDIIANHGRMREDEARRYFQQLINAVDYC

SEQ ID NO: 39113 - DNA, 717 bp, Panicum virgatum
  misc_feature: Ceres CLONE 1996974
  misc_feature: Encodes the peptide sequence at SEQ ID NO. 39114
gcaaaaccgcagctgtgggcggcggccgtccgttctccttccacagttccactcgctttccggcgggcgactggcctgcccgcctgcgcctcctttgcctttgcagttttgcttccgtcctcttccgcggttctgcctgaccgctcttctttataagcaccaaccgcgtggccttgccgccccgagtcgccacgaaaccgcaggggtcctgttgttccggctgagacgcgatccagtcccactgccgccatggcccccagcgtcgccgtggagaacctcaaccccaaggtcttaaaatgtgaatatgcagtacgtggggagattgtcattcatgctcagcgcttgcagcaacagctacaaactcaaccagggtctcttccttttgatgagatcctctactgcaacattgggaatcctcaatctcttggtcagaaaccagtgacattcttcagggaggttcttgctctttgtgatcatccatccttgttggaaaaagaggaaactaaatcattattcagtgctgatgctatttctcgagcaaaggagattcttgctgctattccaggaagagcaacaggtgcatacagtcacagccagggtatcaaaggacttcgtgatgcaattgctgctgggattgcgtcacgtgatggattccctgcaaatgcagatgacattttcgtaactgatggcgcaagtcctggggtgcacatgatgatg

SEQ ID NO: 39114 - protein, 155 aa, Panicum virgatum
  misc_feature: Ceres CLONE 1996974
  misc_feature: SWISSPROT Homolog: EC 2.6.1.2 Alanine transaminase
  misc_feature: Useful for making plants with modulated nitrogen use efficiency
MAPSVAVENLNPKVLKCEYAVRGEIVIHAQRLQQQLQTQPGSLPFDEILYCNIGNPQSLGQKPVTFFREVLALCDHPSLLEKEETKSLFSADAISRAKEILAAIPGRATGAYSHSQGIKGLRDAIAAGIASRDGFPANADDIFVTDGASPGVHMM

SEQ ID NO: 39115 - DNA, 1253 bp, Panicum virgatum
  misc_feature: Ceres CLONE 1996980
  misc_feature: Encodes the peptide sequence at SEQ ID NO. 39116
gagctgccgacgacggcgagtacccgccggcgattccacctctcccgccacctcatcccctcgcgcgcgtgatgggcagcctgctgcccgtgccctgacagatcgggtcctcctcaccgccctccccttccagatccttctaggcctctccagatcctcagagcgcgggcgcgcggggcagagatctcgccggagaaatggataagtccagcgctctcgagtacatcaaccagatgttccccacggaggcgtcattgtcaggcgtcgagccgctgatgcagaagatacagagtgagattcgccgagtggacgccagcatcctcgccgccgtccgacagcagagcaactcgggaaccaaggccaaggaagaacttgcggcagcaacaaatgctgttcaggaattaatgcacaagatacatgagataaaaacaaaggctgaacaaagtgaaacaatggttcaagaaatatgccgcgacatcaaaaagttggattgtgccaagaggcatataacaactacaataaccgctcttcaccgtcttactatgcttgtttccgctgttgagcaacttcaggttatggcgtcaaaacgacagtataaagaagcagctgcacagctagaggcagtaaaccagttatgcagtcattttgaagcttatagagatgtgcccaagataacagagctgagagagaaattcaagaacatcaagaaaatcctcaaatctcatgtattttcagatttctcaagcttgggaactgggaaggaaacagaagatcccatgctgttgcagcagctgtctgattcttgcttggtggttgatgcattggaaccatctgtaagggaggaactagtgaagaacttttgtagcaaggaactcacctcatataggcagatctttgaaggagcagaacttgccaagttagacaagactgaaaggagatatgcatggattaaacgccgactgcggtcaaatgaagatacctggaaaatatttccaccttcctggcatgttgactatctgctgtgtatccagttctgtaagattacaagggcccagcttgttgatatccttaataacctgaaagaaaagccagatgttgcaactttgttattggctttccagagaaccattgaatttgaagaagaattggcagagaaattcagtggtggaactgggactgctagaaataaagactcagcaagtgacaatgaagaggagggtggggaacacaataaaattgtttcagacatacgg

SEQ ID NO: 39116 - protein, 351 aa, Panicum virgatum
  misc_feature: Ceres CLONE 1996980
  misc_feature (1)..(351): Pfam Name: Vps53_N Pfam Description: Vps53-like, N-terminal
MDKSSALEYINQMFPTEASLSGVEPLMQKIQSEIRRVDASILAAVRQQSNSGTKAKEELAAATNAVQELMHKIHEIKTKAEQSETMVQEICRDIKKLDCAKRHITTTITALHRLTMLVSAVEQLQVMASKRQYKEAAAQLEAVNQLCSHFEAYRDVPKITELREKFKNIKKILKSHVFSDFSSLGTGKETEDPMLLQQLSDSCLVVDALEPSVREELVKNFCSKELTSYRQIFEGAELAKLDKTERRYAWIKRRLRSNEDTWKIFPPSWHVDYLLCIQFCKITRAQLVDILNNLKEKPDVATLLLAFQRTIEFEEELAEKFSGGTGTARNKDSASDNEEEGGEHNKIVSDI

SEQ ID NO: 39117 - DNA, 698 bp, Panicum virgatum
  misc_feature: Ceres CLONE 1996986
  misc_feature: Encodes the peptide sequence at SEQ ID NO. 39118
accggcgatagggagagacgacgccacaagaaaacaacaagaaatccgccgcggaattccggattaaaataaggtgtgttagattggaagttcaaacgataacttgctttaaggttcaagagcaaacgaagacatggagagggaagtcatggcctcctacgaaaccaagaaaaactgtgaagttagggtatttgagagttcagacgagatggcaacagatctggcagagtttatttcacaaatttcagaaatttctgttaaggaaagaggatactttgctattgctctctccggagggcctcttaccagacctatgcggaagctctgtgaagtaccatacaacaagacccttgattggtctaaatggtacgtcttctgggctgaagaacgtgcagtagcaaagaaccatgcagaaagtaactacaaattaacaaaggaagaatttctctccaaggtgcctattcttaatggtcatgtctactccatcaacgacaacgcaacggtggaagaggcagcaactgactatgaatttgtcatcaggcagctggtcaagattcgaacagttggtgtctcggagagcaacgactgtcccaaatttgacctcattcttctgaacattggtcctgatggtcatgtagcctcattgttccccaatcatccagctcttgagctgaaagatgactgggtcacctacatca

SEQ ID NO: 39118 - protein, 188 aa, Panicum virgatum
  misc_feature: Ceres CLONE 1996986
  misc_feature: SWISSPROT Homolog: EC 3.1.1.31 6-phosphogluconolactonase
MEREVMASYETKKNCEVRVFESSDEMATDLAEFISQISEISVKERGYFAIALSGGPLTRPMRKLCEVPYNKTLDWSKWYVFWAEERAVAKNHAESNYKLTKEEFLSKVPILNGHVYSINDNATVEEAATDYEFVIRQLVKIRTVGVSESNDCPKFDLILLNIGPDGHVASLFPNHPALELKDDWVTYI

SEQ ID NO: 39119 - DNA, 1092 bp, Panicum virgatum
  misc_feature: Ceres CLONE 1996989
  misc_feature: Encodes the peptide sequence at SEQ ID NO. 39120
atcagctgcctccgtcgccgaccgcgacgccgattccttctctcccccgccgcaccccgtcggcatctctgccgcattccttcccctccctccaaagctagctccgatccgggctcagctctctcatcggcgagggcgggctaccggctatggagagcgagcgtggagcgacgacggccgccgccgccccgtcgccacggaaggcgcagccggagaggtcccagctggctcgtcggcacgtccttcgcggcgcggcattcgccattgtaaccgccctgctcctctccgtgctgggacggccggggagcagagacgacgccgccagcagggagcggccgccctcctccacggcggacgtgtacgagcagggcgagctcacgccgctgcagaggcacgtcgccttcttcgaccgggacaaggacggcgtcatctacgcctccgagacctaccaagggttccgcgcgatcgggtgcggcgtgccgctgtccgccgccgccgccgtcttcatcaacggcggacttggacccaagaccataccggagaacgagaaggtaaacatccacaagggcaagcacggaagtgattctggcgtgtatgatgccaatggaaggttcgttcctgaaaagtttgagaagatcttcaagaagcatgcccgcaccaggcctgatgccctgacaggcaaagagctccaggagttgctcaaagcaaacagggaacctaacgactttaaaggatggttaggtggcttcacggaatggaaggtgctgtactacgtgtgcaaagataaggatgggtttctccacaaggacactgcaagggcagtctatgatggtagcctgttcgaaaggttggaggatgagaggaagtctaataaggactctactagctaagaagaaatgataagaagtccatagacgccctagtgtgaaattaaaggtttttgtaaattatggagtgtgtgtgtgtgtgtgtgtgtgtgtgtgtgtgtgtgtgtgtgtgtgaatcaataaattaatatcccaattttaattgactctatatatatgtttgtcgactgatcttttatgtaacaagaatctattattctcgccg

SEQ ID NO: 39120 - protein, 246 aa, Panicum virgatum
  misc_feature: Ceres CLONE 1996989
  misc_feature (71)..(236): Pfam Name: Caleosin Pfam Description: Caleosin related protein
MESERGATTAAAAPSPRKAQPERSQLARRHVLRGAAFAIVTALLLSVLGRPGSRDDAASRERPPSSTADVYEQGELTPLQRHVAFFDRDKDGVIYASETYQGFRAIGCGVPLSAAAAVFINGGLGPKTIPENEKVNIHKGKHGSDSGVYDANGRFVPEKFEKIFKKHARTRPDALTGKELQELLKANREPNDFKGWLGGFTEWKVLYYVCKDKDGFLHKDTARAVYDGSLFERLEDERKSNKDSTS

SEQ ID NO: 39121 - DNA, 706 bp, Panicum virgatum
  misc_feature: Ceres CLONE 1997013
  misc_feature: Encodes the peptide sequence at SEQ ID NO. 39122
acgccagtagcctccccgttccgcccgccgtcacctgcccctcttcctcctccggtcgccgcctcagcggtttaaggttcacctgcaggctacagccatgggtaaagagaagtcccacatcaacatcgtggtcattggccacgtcgactctggcaagtcgaccaccaccggccatctgatctacaagcttggtggtatcgacaagcgtgtgatcgagaggttcgagaaggaagccgctgagatgaacaagcggtccttcaagtacgcatgggtgcttgacaaactgaaggctgagcgtgagaggggtatcacaatcgatattgccctgtggaagttcgagaccaccaagtactactgcactgtcattgacgcccctggtcaccgtgacttcatcaagaacatgatcacgggtacctcccaggctgactgtgctgtccttatcattgactctaccactggtggttttgaggctggtatctccaaggatggccagacccgtgagcatgctctccttgctttcactcttggagtgaagcagatgatctgctgctgcaacaagatggacgctaccactcccaagtactccaaggcccgttatgatgagatcgtgaaggaagtctcctcctacctgaagaaggtgggatacaaccctgataagattgccttcgtccccatctctggttttgagggtgacaacatgattgag

SEQ ID NO: 39122 - protein, 202 aa, Panicum virgatum
  misc_feature: Ceres CLONE 1997013
  misc_feature (5)..(202): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMI

SEQ ID NO: 39123 - DNA, 1180 bp, Panicum virgatum
  misc_feature: Ceres CLONE 1997074
  misc_feature: Encodes the peptide sequence at SEQ ID NO. 39124
gtcgtccgtcggtttcgtttcatcacacccacgcgcgcatgactctgcagctcgtctcgagcctccccacgcggtgctcccgtctcgccgttccccacctccgaaggtaccggatccttctttgttcctcctgtcgcgaatccgattcctttcctccgtcgctgttcgatcgattctgcttcgaggttacacttctgaatcatcgtggatccgccgccggccctgcggcaaggtcggtccgcgagcgagcatgtcgtcgtccttctcgtcggtgccggcggaggacgcgtccatggagacggtggcgccccacgcgcccgtcacccgggagcggaggcttaaccccagcctgcaggagcagcttcccaagccatatctcgcgcgggctctggaggcggtggacccgagccacccgcaggggacgaggggacgcgacccccgcggcctgaccgtgcttcagcagcacgccgccttcttcgaccgcaacggcgacggcatcatctacccctgggagacgtttcaaggcctccgtgcaataggctgcgggctcccggtatcgttcttcggctctatactgatcaacctcctcctcacttttcccactcagcagggatggttaccttcccctttgctccccatccatatcaagaacatccacaagggtaagcacgggagcgattctgaatcctatgatactgaagggaggtttgatccatcaaagttcgatgctatatttagcaagtatggtcgaacgcatccggatgctttgacgttaggcgaggtgttctccatgcttaaaggaaaccgcaatatatatgattttgttggctgggtgtctgcagccggtgaatggctgttactctacagtgtggcaaaggataaggatggcctgttgcagcgagagactgtccgaggcgctttcgatggaagcctatttgagcgactgcaagaaaacaagaaatcctcctgagtgttgaatgagcccaatggattgttcagcccaagaaaaagggctgagagtacaaagctggaacttcgccattgggctgtagatgtaattatagaaaataagaaacgctaaagcattgtagaaaagaacttctatctttgaaataaggagaatcctacagggagagtcctctcgatttaagattaaatcgagagccctccaacttacctc

SEQ ID NO: 39124 - protein, 239 aa, Panicum virgatum
  misc_feature: Ceres CLONE 1997074
  misc_feature (61)..(234): Pfam Name: Caleosin Pfam Description: Caleosin related protein
MSSSFSSVPAEDASMETVAPHAPVTRERRLNPSLQEQLPKPYLARALEAVDPSHPQGTRGRDPRGLTVLQQHAAFFDRNGDGIIYPWETFQGLRAIGCGLPVSFFGSILINLLLTFPTQQGWLPSPLLPIHIKNIHKGKHGSDSESYDTEGRFDPSKFDAIFSKYGRTHPDALTLGEVFSMLKGNRNIYDFVGWVSAAGEWLLLYSVAKDKDGLLQRETVRGAFDGSLFERLQENKKSS

SEQ ID NO: 39125 - DNA, 722 bp, Panicum virgatum
  misc_feature: Ceres CLONE 1997077
  misc_feature: Encodes the peptide sequence at SEQ ID NO. 39126
cttcaataattgacacagcgcagagctctccatctccttccaccttccttggcagcaggtccggcgagggaatggatgcaccaccaattggaacaggcgacgactcgcaggtgccggccagggactggtcggagctgccgctggacgccctcgcgtcggtcttcgtcaagctcggcgccatcgagatcctgatgggcgcgggcctcgtgtgccgctcctggctccacgccgccaagctgcccgacctgtggcgatccgtggacatggcgcgccacaaggtggtggacgacgtcttgtacatattcggcgcctctcctgtgaagccaaagatcaaccgcgatgtcctctgcgccattgcaagggtcgccgtggaccgctcccgcgggcagctggagacgttcgtggccaagcggttcgttaccgatcaactcctggagtacatcggcgacaggtcgccggctctgaaggccgtcgtcctcgtgtcgtgctgcggcgtctccaaccaagggttcacgcaactggtggccaggtgccctctgctagaggacctcatgcttgtgttctgccccaagatcggcggccgcgacgtctacgaggctaccggccgggcatgcccacagctcaagcgcttcaggctgcgcaagagcccgttctgcttgtccgctggtaagtctggcggggaagtgctcgggtttgcggcgatgcacgagctgcggaccctc

SEQ ID NO: 39126 - protein, 216 aa, Panicum virgatum
  misc_feature: Ceres CLONE 1997077
  misc_feature (17)..(65): Pfam Name: F-box Pfam Description: F-box domain
MDAPPIGTGDDSQVPARDWSELPLDALASVFVKLGAIEILMGAGLVCRSWLHAAKLPDLWRSVDMARHKVVDDVLYIFGASPVKPKINRDVLCAIARVAVDRSRGQLETFVAKRFVTDQLLEYIGDRSPALKAVVLVSCCGVSNQGFTQLVARCPLLEDLMLVFCPKIGGRDVYEATGRACPQLKRFRLRKSPFCLSAGKSGGEVLGFAAMHELRT

SEQ ID NO: 39127 - DNA, 712 bp, Panicum virgatum
  misc_feature: Ceres CLONE 1997079
  misc_feature: Encodes the peptide sequence at SEQ ID NO. 39128
gattctcggctgccattccgttccatccatccattggctatttggctcccccactcctcaccactctgcttgctccgctgctctgctctgctctgccccaatcagcgagagctgctatccactgacccgccgcgagcgccaatggcggcggccgcggccctggcagcggccgtgctggcgctgtcatgcttcggcgagcccgcgacggccgcgacggcggaggcggaccggatcggcagcctgccggggcagccgccggtcaacttctccatgtactccgggtacgtcaccgtggacgcggccgcggggcgggcgctcttctactggctcatcgaggcggccggcgcgcccgcggagtccgcgccgctcgtgctctggctcaacggcgggcccgggtgctcctccgtcggctacggcgcgtccgaggagctcggcgccttccggatcaaccccgacggcaggtcgctctccaggaacccctacccctggaacaaagtggcgaacatgctgttcctggactcgccggccggcgtcggctactcctactccaacaccaccgccgatctgtacaccgccggtgacaacaagacagctcatgattcgtacaatttcttggtgaattggttggagcggtttccgcagtacaagcatcgcgatttctacatcacggagagagagctacgcaggtcactacgtgcctcaactgtctcag

SEQ ID NO: 39128 - protein, 190 aa, Panicum virgatum
  misc_feature: Ceres CLONE 1997079
  misc_feature (35)..(190): Pfam Name: Peptidase_S10 Pfam Description: Serine carboxypeptidase
  misc_feature: SWISSPROT Homolog: EC 3.4.16.6 Carboxypeptidase D
MAAAAALAAAVLALSCFGEPATAATAEADRIGSLPGQPPVNFSMYSGYVTVDAAAGRALFYWLIEAAGAPAESAPLVLWLNGGPGCSSVGYGASEELGAFRINPDGRSLSRNPYPWNKVANMLFLDSPAGVGYSYSNTTADLYTAGDNKTAHDSYNFLVNWLERFPQYKHRDFYITERELRRSLRASTVS

SEQ ID NO: 39129 - DNA, 1460 bp, Panicum virgatum
  misc_feature: Ceres CLONE 1997084
  misc_feature: Encodes the peptide sequence at SEQ ID NO. 39130
agccggctcaaaagcagcagcagccaccgcgcccgcaccacctcgcacctggcatcaccaccagcacaagcaaacaaattcacgcgctccgcgacctatcgctagccagcagcagctagacatcggccggcgatgaaccgcctgacgccggcgcaccaccaggggccgatgccgccgccggggacggggcagctggcgcggtacggctccgcgccgggctcgctcctggtggccatcgcagagtccgtcacccacggcggggaccacgccccgccgcctccctttagccggttctactccgccgagtcctccggcctcacctcctgcgagtccagctgccgcacggacggcggcagcgcccgaccgcgcgcgctcgagcgggcctacggcggctccggcgagatccgcgtgccgccgccgcagcagcagcagtcgctcgcgcccccggggccgccgcacgggctgctccgccacagcagctcccccgccgggctgctctcccgcctcacggccgacccacacggcatggctccggcgagtgggatgggcagctactcgcaggcgggcaccgacgccgcgatggcccacggccacaggcagctcagctcgcagtggagcttctccaggcaggacctcccgcagatctcggagatgggggtgacccccgacgtcggggagagcatcgtcgccggcgggtgcaacagctccagcgacggcggcggcgccgccgcgcagtcctcctcctacctctccaggaacttctccgtcagctcctgggacgacgccaactccatcatgttctcgcccccgaacaagaagcccaagctcgacgcggcggacgacatggtcaccagcttcagcaacatcgactcccagtttgggttgtcaaagtcgtcgctggagatgcccggcatggacgactacctgcagccgcagcaggactccgtcgcttgcagagttcgtgcaaagcgaggctgcgcgacacacccgcgaagcatcgctgagagggaaagaagaacaaggatcagcaagaggctgaagaagctgcaggatcttgtacccaacatggacaagcaaacaaatacgtcagacatgttggatcttgctgtagagtacatcaaagagctgaagggccaagttgagaagctaaaacacgatcaagaaaactgcttttgctcaggcaatcagaacagctgacagtggagaagcagatggacaaggtcttatgtggcaccgatatgattgttgagccccagtttttgcttcagaataactggctgcagcaatgcttaacatgtcaagtcgcttccatgactcagctttccctttcatggttgcactacggatacagtcaatgacttgaagactagaagatgacacttaggttatcataatttcctgtgaagcggtgtcttatgtgtaaaaaatcctccatttcagcatgaatgggattgctgttc

SEQ ID NO: 39130 - protein, 354 aa, Panicum virgatum
  misc_feature: Ceres CLONE 1997084
  misc_feature (285)..(333): Pfam Name: HLH Pfam Description: Helix-loop-helix DNA-binding domain
  misc_feature: The sequence is a functional homolog of SEQ ID NO 1257 in the 10/412,699 US patent application
  misc_feature: The sequence is a functional homolog of SEQ ID NO 176 in the 10/714,887 US patent application
  misc_feature: The sequence is a functional homolog of SEQ ID NO 176 in the 11/435,388 US patent application
  misc_feature: The sequence is a functional homolog of SEQ ID NO 196 in the 10/714,887 US patent application
  misc_feature: The sequence is a functional homolog of SEQ ID NO 196 in the 11/435,388 US patent application
  misc_feature: The sequence is a functional homolog of SEQ ID NO 174 in the 10/714,887 US patent application
  misc_feature: The sequence is a functional homolog of SEQ ID NO 174 in the 11/435,388 US patent application
  misc_feature: The sequence is a functional homolog of SEQ ID NO 194 in the 10/714,887 US patent application
  misc_feature: The sequence is a functional homolog of SEQ ID NO 194 in the 11/435,388 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
MNRLTPAHHQGPMPPPGTGQLARYGSAPGSLLVAIAESVTHGGDHAPPPPFSRFYSAESSGLTSCESSCRTDGGSARPRALERAYGGSGEIRVPPPQQQQSLAPPGPPHGLLRHSSSPAGLLSRLTADPHGMAPASGMGSYSQAGTDAAMAHGHRQLSSQWSFSRQDLPQISEMGVTPDVGESIVAGGCNSSSDGGGAAAQSSSYLSRNFSVSSWDDANSIMFSPPNKKPKLDAADDMVTSFSNIDSQFGLSKSSLEMPGMDDYLQPQQDSVACRVRAKRGCATHPRSIAERERRTRISKRLKKLQDLVPNMDKQTNTSDMLDLAVEYIKELKGQVEKLKHDQENCFCSGNQNS

SEQ ID NO: 39131 - DNA, 656 bp, Panicum virgatum
  misc_feature: Ceres CLONE 1997136
  misc_feature: Encodes the peptide sequence at SEQ ID NO. 39132
attcccatcccaccaccgcctctctcccattgcgttgcgcccggcccattccttcatccccaccggcaccggcaccggcaccggcagcgcaagaagaagaagaagatgaagctctccgtccagtccctggccaggaagctctccctcccgtccccgaagcggtcctggagtagcggcagcaagaaggacggcagcgggaagcgctccctgtcgcgcagcgaggcgccgtccttcgcgtcggcgtcctcctcctccgacgacgacacgctcgcgcgctcctccacgccgcggtccgtgctctcgctgtcccccgcagagatcccgcgccgggagctggaggccgtgctgcggcgcctcggccacggggagccctccgacgacgagctggacgccgtggccgccatggccgcgcagccggccgcgcccggcggggaggacgacctcatggaggcgttccgggtcttcgacgccgacggcgacggccgcatcaccgccgaggagctccgcgccttcatggaggccatcctcggcggcggcgccgagggctgcagcctcgacgactgccgccgcatgatcggcggcgtcgacgccgacggcgacggcttcgtcggcttccaggacttcgcgcgaatgatgatgaacgccaccaccgcccc

SEQ ID NO: 39132 - protein, 183 aa, Panicum virgatum
  misc_feature: Ceres CLONE 1997136
  misc_feature (112)..(140): Pfam Name: efhand Pfam Description: EF hand
  misc_feature (152)..(180): Pfam Name: efhand Pfam Description: EF hand
MKLSVQSLARKLSLPSPKRSWSSGSKKDGSGKRSLSRSEAPSFASASSSSDDDTLARSSTPRSVLSLSPAEIPRRELEAVLRRLGHGEPSDDELDAVAAMAAQPAAPGGEDDLMEAFRVFDADGDGRITAEELRAFMEAILGGGAEGCSLDDCRRMIGGVDADGDGFVGFQDFARMMMNATTA

SEQ ID NO: 39133 - DNA, 1330 bp, Panicum virgatum
  misc_feature: Ceres CLONE 1997147
  misc_feature: Encodes the peptide sequence at SEQ ID NO. 39134
aggatcccatctctcccacccaacctctccccaagcaggcgtcgcgctcccacctcgcctccggccgcgtcccacacctcgcgggccgctccggccccgcccgcaccggcggcccggccgcgccccacctcgcgcgccgccccagctctccccgcgccggcggccgcgccccacctgcgcctgcgccggcggcccggcccaaccctgtctccggccgcgctccgccgcgcctcccatggtttcgtcgcgcacccgccacatggacgcctcctcccctcccacctccatccccattggcggatgctaattgaattgacccactgctgatccgctcgaagcagccccataccgacaccaggccagtggtcgacacccgaggagagatgagaggaggagtcctcaccaagtccggcgacggcaagggtagcgcgactcgcgtataggttttgatctatcagctgtagacgcgagctttgtctttgcttgaagtagtttacagtataacgtagacgggttagcgttgttcctgaaatctgttggttcatggggagtcaaacaatggcatcacaggctgggggaggaggcgggggcggcagtggcggtgctggcgcagtgcaacgcgggcagatgcagaacctggcaagacaagggtctttgtatagccttacccttgacgaggtgcagagccatttgggagaacccctgcatagcatgaaccttgatgagttgctcaagagtgtctttcctgatggtctagaccatgatggtggcactaccagccagtacgagcagacctcaggcctcttgagacaggggagcatcaccatgccgcctgagcttagcaagaagacagtggatgaggtgtggaaaggcatccaggatgcaccgaagagaaatgtcacagagagtggtaggaggagacgagagcggcaaccaacacttggggagatgacgcttgaggatttcttggtgaaagctggggtcgttacccaaggatatctgaaggacttgaacgacgtaggcaatgtggagcaggttggtagtgctgggcctgttggtttgacagctggagtacagtggttagaccactaccagcaccagattacagctatcgagcctcatcagcatgggcaacacagcatgccaggtggttatatgccgagtcagttagcccttcagccactgaacgttgggccgggtgctattctggaatcatactctgatggccaaattacttcaccaatgatgggtggactttctgattccccgacacctggtaggaagcgtggtgccccaggagatgtggcggataagttgatggagagaaggc

SEQ ID NO: 39134 - protein, 257 aa, Panicum virgatum
  misc_feature: Ceres CLONE 1997147
  misc_feature: The sequence is a functional homolog of SEQ ID NO 1539 in the 10/412,699 US patent application
  misc_feature: The sequence is a functional homolog of SEQ ID NO 1541 in the 10/412,699 US patent application
  misc_feature: The sequence is a functional homolog of SEQ ID NO 1538 in the 10/412,699 US patent application
MASQAGGGGGGGSGGAGAVQRGQMQNLARQGSLYSLTLDEVQSHLGEPLHSMNLDELLKSVFPDGLDHDGGTTSQYEQTSGLLRQGSITMPPELSKKTVDEVWKGIQDAPKRNVTESGRRRRERQPTLGEMTLEDFLVKAGVVTQGYLKDLNDVGNVEQVGSAGPVGLTAGVQWLDHYQHQITAIEPHQHGQHSMPGGYMPSQLALQPLNVGPGAILESYSDGQITSPMMGGLSDSPTPGRKRGAPGDVADKLMERR

SEQ ID NO: 39135 - DNA, 1231 bp, Panicum virgatum
  misc_feature: Ceres CLONE 1997158
  misc_feature: Encodes the peptide sequence at SEQ ID NO. 39136
aaacccgagccggccgccggcgagatggctgggtcgtggtgatctccggcggtttgggggtagtgcggtgcaaggatggatttcgcggggatgaagcggcgggagctgcaggcgctctgcaagcggcacggcctccccgccggcggcaccaacgccgacctcgtcgcccgcctcgacgccgcgctctcgggggccgctggtgcggaagaggaggatgtggtcggagtaccagagaggaaggggtgtctgaagcgctcggtcggagatgctggcgaggcgaaaaaggtgacttttgcggtggaggaatcgagggggaggaggctgaggtctcgggtcgtctggtcgcccgtcgttgccaagacaagggcgaagcgtgctgaagctggtagtactaattctgctgctgatgctggaatttctgcaagggcaggtgaagatgttccagtgaggcggtccaggaggaattctttgactgctgccgaggccgaggaagtagaagaagccgttgctgttggcaggaaacgaaagccgaagagccaggagattgctgaggacgttgctgtcagtgctcagcctatagcttcttgcagagtcacgaggaggtcgagcttgtcaggaaccacggttctattgcctcctgctgttgagaagaagatagggagggggaaggcagcagatgttaaggataaacttgttactgaggagcaggctgctgaggctcaaggtttgtctgcagcggagccacctacagttgtggagagtaagaggagcaggaggaagggacctgatgtgcagaattcatcatggttggaagtattcgccaccaggaccacaaaatcccactcagtagaagctgttgtgatgccgcccccagtgattgagaacaagaggaagaggaagtcaggagatgcacaaccatatgtagagctgcgtccagttgcagaggtgcctagaaatgatgctcctgtcaccaggtctttgaggaacagggttgtccaggttaacaacagtattgtggaggaaactcacaccagccagcagccagaaagcaagttgcttccagttgcagaggtgcctagaaatgatgctcctgtcaccaggtctttgaggaacagggttgtccaggttaacaacagtattgtggaggaaactcacactaaccagcagccagaaaataagacgcggcctactagaccagctacgtgcaggaatcaacaggttgcatcttcta

SEQ ID NO: 39136 - protein, 385 aa, Panicum virgatum
  misc_feature: Ceres CLONE 1997158
  misc_feature (3)..(37): Pfam Name: SAP Pfam Description: SAP domain
MDFAGMKRRELQALCKRHGLPAGGTNADLVARLDAALSGAAGAEEEDVVGVPERKGCLKRSVGDAGEAKKVTFAVEESRGRRLRSRVVWSPVVAKTRAKRAEAGSTNSAADAGISARAGEDVPVRRSRRNSLTAAEAEEVEEAVAVGRKRKPKSQEIAEDVAVSAQPIASCRVTRRSSLSGTTVLLPPAVEKKIGRGKAADVKDKLVTEEQAAEAQGLSAAEPPTVVESKRSRRKGPDVQNSSWLEVFATRTTKSHSVEAVVMPPPVIENKRKRKSGDAQPYVELRPVAEVPRNDAPVTRSLRNRVVQVNNSIVEETHTSQQPESKLLPVAEVPRNDAPVTRSLRNRVVQVNNSIVEETHTNQQPENKTRPTRPATCRNQQVASS

SEQ ID NO: 39137 - DNA, 650 bp, Panicum virgatum
  misc_feature: Ceres CLONE 1997160
  misc_feature: Encodes the peptide sequence at SEQ ID NO. 39138
atctctctgtctgtatcagagcctccgctccgctcctctccgcctccgcctccgcctccgcctccacccccccccccccccccccacctccaccccgcccccgccgccgcaggaaggaaggatggaggcccctggctccccctacgcctcctcgccggaatccgccccgaagcgcgccccacgctcccctccgcagcagcagcagcatcagcagcagccctccgaggaaggagatgacaaggagaagccaacacatttgaggttcctggtgtctaatactgcagcaggatgtattattggcaagggtggatcaaccatcaatgactttcagtgccagtctggggcccgtattcagttatcacgtagccatgagttcttccctggtacaaatgaccgtatcatcatggtttctggaatgtttgatgaagtaatgaaggccatggagctaattcttgagaaacttttggctgagggtgaagaattcaatgaagctgaagctaggcctaaagttagacttgtagttcctaacagctcttgtggtgggataattggtaaaggtggatcaacaataaagtcatttattgaagaatcgcatgctggaatcaaaatttcgccacaggataacaactatgctggtttacatgacaggc

SEQ ID NO: 39138 - protein, 176 aa, Panicum virgatum
  misc_feature: Ceres CLONE 1997160
  misc_feature (45)..(110): Pfam Name: KH_1 Pfam Description: KH domain
  misc_feature (129)..(176): Pfam Name: KH_1 Pfam Description: KH domain
MEAPGSPYASSPESAPKRAPRSPPQQQQHQQQPSEEGDDKEKPTHLRFLVSNTAAGCIIGKGGSTINDFQCQSGARIQLSRSHEFFPGTNDRIIMVSGMFDEVMKAMELILEKLLAEGEEFNEAEARPKVRLVVPNSSCGGIIGKGGSTIKSFIEESHAGIKISPQDNNYAGLHDR

SEQ ID NO: 39139 - DNA, 677 bp, Panicum virgatum
  misc_feature: Ceres CLONE 1997174
  misc_feature: Encodes the peptide sequence at SEQ ID NO. 39140
atcccattccccttccttccagaggagagagagagagagagagagagagagagaagaaaagataagctcagctcaggctcagctcgcaagcaagtggagatgcggagcccacgactgcctggcgcgcgttccccacgcgtcccaccgcgcgctccgccgcgtctgccgcggctggcgcagcgccgccgccgcgccggccttcgcctcggcgcgcgccgccgcgggcgccaccgaggacctcgtctacctcctgcagttcggcaacccctccgccgccgccgacgacgacggggcgcctaaggacggcgccgacgcgccgccgcccagcgcgccggcctacggcgtcgccgtctacaacgtgaccacgggcgagtggcgccgggagcgcggcgtgccgcccgtgctccccgtcttcgcgcagtgcgccgcggtgggcacccgcgtggccgtgctcggcggctgggacccgcgcaccttcgagcccgtcgccgacgtgcacgtcctcgacgccgccaccggcgcgtggcgccgcgccgcgccgatgcggtccgcgcggtccttcttcgcgtgcgccgaggccggcggcaagatctacgtcgccggcgggcacgacaagcacaagaacgcgctcaagacggccgaagcctacgacgccggcgccgacgcctgggacccgc

SEQ ID NO: 39140 - protein, 225 aa, Panicum virgatum
  misc_feature: Ceres CLONE 1997174
  misc_feature (184)..(225): Pfam Name: Kelch_1 Pfam Description: Kelch motif
SHSPSFQRREREREREREEKISSAQAQLASKWRCGAHDCLARVPHASHRALRRVCRGWRSAAAAPAFASARAAAGATEDLVYLLQFGNPSAAADDDGAPKDGADAPPPSAPAYGVAVYNVTTGEWRRERGVPPVLPVFAQCAAVGTRVAVLGGWDPRTFEPVADVHVLDAATGAWRRAAPMRSARSFFACAEAGGKIYVAGGHDKHKNALKTAEAYDAGADAWDP

SEQ ID NO: 39141 - DNA, 677 bp, Panicum virgatum
  misc_feature: Ceres CLONE 1997184
  misc_feature: Encodes the peptide sequence at SEQ ID NO. 39142
ctcgctctcgcctccgcgccctagggtttcgccgccttgccgggtacgagagatgcagccgccgatgaacgggcagcagggcccgctcccgccgcagggttctggggccccggcgccgcctccgcagcagcaacaggcgccgccggcaccgtactaccagcagcagccgccgccgcagtactaccagccggggccgcccccgcagccgtggggccagcagcagcagtatcctcctccgccgcagcagtacgctccgccgccgcagcagtacgcgcccccgccgcagcagtacgctccgccaccaccccagcagtacgctcctccaccaccccagcagtacgcgcctccgccacagcagtacgcgccgccgcagcaatacagcaccgcgccgggaagcggcgagatcaggtctctttggatcggggatctccagtactggatggacgagaactaccttaacttccaagccttcgcgtccgtggcgtcgcagattgccaatgtaaaaattatacggaacaaacagagtgggctgtctgaaggttatggctttattgagtttcactcccgagctgctgcagaatatactctgatgaacttcaatgggcggatgatgccgaatgttgacatgacttttaagctaaactgggcttcagctggcgctggggataagcgtggag

SEQ ID NO: 39142 - protein, 208 aa, Panicum virgatum
  misc_feature: Ceres CLONE 1997184
  misc_feature: The sequence is a functional homolog of SEQ ID NO 536 in the 10/666,642 US patent application
MQPPMNGQQGPLPPQGSGAPAPPPQQQQAPPAPYYQQQPPPQYYQPGPPPQPWGQQQQYPPPPQQYAPPPQQYAPPPQQYAPPPPQQYAPPPPQQYAPPPQQYAPPQQYSTAPGSGEIRSLWIGDLQYWMDENYLNFQAFASVASQIANVKIIRNKQSGLSEGYGFIEFHSRAAAEYTLMNFNGRMMPNVDMTFKLNWASAGAGDKRG

SEQ ID NO: 39143 - DNA, 655 bp, Panicum virgatum
  misc_feature: Ceres CLONE 1997186
  misc_feature: Encodes the peptide sequence at SEQ ID NO. 39144
agaatcacgaaatactacaaagctgcaggacaggacttggaagtgaaatatttccatgcatttattgatggagtcgattttgtgtttatcgacgcacctctcttccggcaccgtcaaggtgacatatatgggggaaatagacaggaaattatgaagcgcatgattttgttctgcaaggttgctgttgaggttccttggcatgttccatgtggcggtgtgtgctatggtgatggcaatttggtgttcattgctaacgactggcacactgcactcctgcctgtttatctgaaagcatattacagagacaatggcataatgcagtacactcgctccgttctcgtcatacataacatcgctcaccagggtcgcggccctgtagctgaatacccgtacatggacctgcctgagcactacctccagcacttcgagctgtacgaccccgtcggcggcgagcacgccaacatcttcgccgcgggcctcaagatggcggaccaggtggtcaccgtcagccgcggctacctgtgggagctgaagacggtggaaggcgggtggggcctccacgacatcatccggtcccacgactggaagatgaacggcatcgtgaatggcatcgaccaccaggagtggagcccggaggtggacgtgcacctccggt

SEQ ID NO: 39144 - protein, 218 aa, Panicum virgatum
  misc_feature: Ceres CLONE 1997186
  misc_feature (5)..(192): Pfam Name: Glyco_transf_5 Pfam Description: Starch synthase catalytic domain
  misc_feature: SWISSPROT Homolog: EC 2.4.1.21 Starch synthase
RITKYYKAAGQDLEVKYFHAFIDGVDFVFIDAPLFRHRQGDIYGGNRQEIMKRMILFCKVAVEVPWHVPCGGVCYGDGNLVFIANDWHTALLPVYLKAYYRDNGIMQYTRSVLVIHNIAHQGRGPVAEYPYMDLPEHYLQHFELYDPVGGEHANIFAAGLKMADQVVTVSRGYLWELKTVEGGWGLHDIIRSHDWKMNGIVNGIDHQEWSPEVDVHLR

SEQ ID NO: 39145 - DNA, 1711 bp, Panicum virgatum
  misc_feature: Ceres CLONE 1997191
  misc_feature: Encodes the peptide sequence at SEQ ID NO. 39146
gacgagagcggagcctcggaaagcacacccacggcggccccagagaagcggcgaatcccggaggatcggcggaggagatgcttctcgaggagctgctctgctgccagatccaagagtggtacccggccttccgccgccactcgatccccaccgtcatcatcccgctccccgccgccttcctccgctacctcgccggccaagcggcctaccccgaccccgacgccggatccggcgccgacgaggagccgctcccgttcctcctccccgcgataacctccggccgccagcccttcgcgcccatccacgcccaccaccccgacccggactccctcctcaactcggagctcttcttcggatccagcaccgaggacgtctacgaccccgacgccgaccacccgcaccggccggagttcccggagctggaggcggccgtcgacgccgccatcgcggagctcggcggcgccgcgctccccaagctcaactggagcgcgcccaaggacgccaccttcatgtccgcggatggcacgacccggtgcacgtgcttcgccgaggttgccatgctgctccgcgcctccgattgtgtggcccacgacctcgcctcggcgcgccaatcgtgtgaggattttgtgcgcccggagggtgctcgacggaatgcccggaaagttagtgctagtgccgaggaagctgctacatcaaatgtcaatgtgattggcggcagcagcggcactggtgaagctccaagtgatgtggaggaccagacaaatgctgtggattgtgatgcggaagatgcccaggaagaagaaagtaatggggatgcttgggtggactatgggttccaatactatctcgccctccgcaagtggtacccaggcctccgtcctgagtcagagttcagatgcttcgtacgggaccggaagctggttgctgtgtcccagagagatgcatcagcttactacccatcactgcctggatggagttctgaggtgcaaccgaagattgaggttttctttgaggaagttattgagccacagtttggttcaaacaattatacatttgatgtgtatgtgacaactgatgggcgagtcaagctgatagatttcaatccatggggtggttataccttgccgctgctgtttacttgggaggagcttgaagaggagggcatagagcatgagctggagtttagagtggtcatgcatcagggtgcagtgaggccaggattgatgacagcaatgccatatgatatgctggattggggggaggggagtggctgggatgttttgctgaagaaggctgatgaagagctcgacagacagatgaactcactagatggtgcttcataatcgcgtttcaggaaaagatgtttggagtatgcagtatgtgcacaacttaaagtgatatctgctgattttcttaccagccacatactacagtcacctgcttttcttaagattgatatgcggtctcctgccactatgctgttctttatttccagttactcttatagcgctaggctgttagtgcagatcacctattatagccacatcgtgtcatgtattggttattcagttatagtctccaacataactaatatgcgttttagtttagttgagctagatggttagtacttgaatcttaagaaatgtatttgcagtgaaaatttgttggccgttctgctcagatgcaatgaatatccctcatctttcgttgc

SEQ ID NO: 39146 - protein, 421 aa, Panicum virgatum
  misc_feature: Ceres CLONE 1997191
  misc_feature (14)..(396): Pfam Name: D123 Pfam Description: D123
MLLEELLCCQIQEWYPAFRRHSIPTVIIPLPAAFLRYLAGQAAYPDPDAGSGADEEPLPFLLPAITSGRQPFAPIHAHHPDPDSLLNSELFFGSSTEDVYDPDADHPHRPEFPELEAAVDAAIAELGGAALPKLNWSAPKDATFMSADGTTRCTCFAEVAMLLRASDCVAHDLASARQSCEDFVRPEGARRNARKVSASAEEAATSNVNVIGGSSGTGEAPSDVEDQTNAVDCDAEDAQEEESNGDAWVDYGFQYYLALRKWYPGLRPESEFRCFVRDRKLVAVSQRDASAYYPSLPGWSSEVQPKIEVFFEEVIEPQFGSNNYTFDVYVTTDGRVKLIDFNPWGGYTLPLLFTWEELEEEGIEHELEFRVVMHQGAVRPGLMTAMPYDMLDWGEGSGWDVLLKKADEELDRQMNSLDGAS

SEQ ID NO: 39147 - DNA, 730 bp, Panicum virgatum
  misc_feature: Ceres CLONE 1997203
  misc_feature: Encodes the peptide sequence at SEQ ID NO. 39148
acccgaaggaacgcaccaaaacaaaccactcggagctcactaccccattccgttccctgaccaaaacccccaaaccccaccccagccgggccgccaagcccaagcccccccatggcggcgccgaccccgaccaccgccgccgccgccgccaccacccaccaccgcatcctcctcccgtccccgtccccgtccccgcgcggcgccctcgcgcctgccttcctccgcctgccccaccgcgagcaggcccacgcccgcgcccagcgcgcgcgcctccccgcgcccctcgcggccgcggcctccaccgcatcccccgaggcgccggcctcgggggccgtcccggggaagcccacggtgctcgtcgccgagaagctcggcgccgcggggctcgcgctgctgcgcgagttcgccaacgtcgactgctcctacggcctctcccccgaggagctccgcgccaagatctcgctctgcgacgcgctcatcgtcaggtccgggaccaaggtcggccgcgacgtcttcgaggcctccgggggcaggctccgcgtcgtcggccgcgcgggggtcgggatcgacaacgtcgacctcgccgccgccaccgagcacggctgcctcgtcgtcaacgcgcccaccgcaaacaccgtcgccgccgcggagcatggcatcgcgctgctcaccgccatggcgaggaacatcgcgcaggccgacgcgtccctcaaggctggaaaatggctgc

SEQ ID NO: 39148 - protein, 206 aa, Panicum virgatum
  misc_feature: Ceres CLONE 1997203
  misc_feature (81)..(204): Pfam Name: 2-Hacid_dh Pfam Description: D-isomer specific 2-hydroxyacid dehydrogenase, catalytic domain
  misc_feature: SWISSPROT Homolog: EC 1.1.1.95 Phosphoglycerate dehydrogenase
MAAPTPTTAAAAATTHHRILLPSPSPSPRGALAPAFLRLPHREQAHARAQRARLPAPLAAAASTASPEAPASGAVPGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLTAMARNIAQADASLKAGKWL

SEQ ID NO: 39149 - DNA, 580 bp, Panicum virgatum
  misc_feature: Ceres CLONE 1997203-R
  misc_feature: Encodes the peptide sequence at SEQ ID NO. 39150
acccgagatgcctattgattacattcaagttcagatcgccaatgtcgagtccaaatttcccagtgccatatccgagacgggagagatcactgtagaggggacggtgaaggatggtgtccctcatttaacaaaggttggagcattccaggtagatgtgagcttggaaggaagcctgatcctctgcaggcaggtcgatcagcctggcatgatcggggcagtaggaagtgtcctgggtgaggagaatgtcaatgtcagtttcatgagtgttggaagaatcgctcctcgcaagcatgctgtcatggcaatcggggttgatgaagaaccaagcaagagcacactgacaaagattggggagattcctgcaatcgaagagtttgttttcctcaagctctaggcgccaaatgtatgtttgaagttgcaagcatggtgtgcaattttgatgtagctagcaatctagaggacggatggttctcgttggaataagctttttaggggtatttttgtagtggtgctcttgaatttggtgcagtatcgatgtgtcttttgaacgtggtgtttatcaataagaagctctcttctg

SEQ ID NO: 39150 - protein, 130 aa, Panicum virgatum
  misc_feature: Ceres CLONE 1997203-R
  misc_feature (57)..(121): Pfam Name: ACT Pfam Description: ACT domain
  misc_feature: SWISSPROT Homolog: EC 1.1.1.95 Phosphoglycerate dehydrogenase
PEMPIDYIQVQIANVESKFPSAISETGEITVEGTVKDGVPHLTKVGAFQVDVSLEGSLILCRQVDQPGMIGAVGSVLGEENVNVSFMSVGRIAPRKHAVMAIGVDEEPSKSTLTKIGEIPAIEEFVFLKL

SEQ ID NO: 39151 - DNA, 690 bp, Panicum virgatum
  misc_feature: Ceres CLONE 1997209
  misc_feature: Encodes the peptide sequence at SEQ ID NO. 39152
aagcatccgccgccgtccgcccgcccgctgcgccgccgcagaggtctcatcctcgccttcctccgaagggcagccagagctcccagaagcacagccataagcaccgatcatggccgactacgagcaggagcaggagatggaggtggaggcgctgcaggccatcctcatggacgacatcaaggagatcgaccccagcgagagtgggatcgccaccaccgcccggtgcttccagatccttctctcccctcaggatgatgattttgacgagtctgcttatgttccagttcaactggctctgatctttgcgcataccgagaaatacccagatgaacctccactgctgaatgtcaaaagtgtgcgaggaattaaaccagatgatcttgcatccctgaaggaaaagcttgaccaggaggcaacagaaaatcttggcatggctatggtctatactctcgtttcatcagccaaagagtggctaagtgagaaatacggtcagaacggaggcgacgaggaacctgaagaaactgaagagaaagaagaggaggtcattgtaccccatggtgaagctgttactgtggagaggttcctggcctggagagaacgttttgaagctgaattggccctacagcgtgctaaacttatgccagattcagctcttacagccccaaaggaaaagaaactcacaggaagaca

SEQ ID NO: 39152 - protein, 193 aa, Panicum virgatum
  misc_feature: Ceres CLONE 1997209
  misc_feature (3)..(122): Pfam Name: RWD Pfam Description: RWD domain
  misc_feature: SWISSPROT Homolog: EC 2.7.11.1 Non-specific serine/threonine protein kinase
MADYEQEQEMEVEALQAILMDDIKEIDPSESGIATTARCFQILLSPQDDDFDESAYVPVQLALIFAHTEKYPDEPPLLNVKSVRGIKPDDLASLKEKLDQEATENLGMAMVYTLVSSAKEWLSEKYGQNGGDEEPEETEEKEEEVIVPHGEAVTVERFLAWRERFEAELALQRAKLMPDSALTAPKEKKLTGR

SEQ ID NO: 39153 - DNA, 552 bp, Panicum virgatum
  misc_feature: Ceres CLONE 1997209-R
tgttcggcttttcatggggtcgcggtcctcaaaacaaacaggcaccccagcaagataccaacagccagtattacggaaacaactactatggatacgaacagcagggctatgaaggctatggctacagtgcacccaatgcacaagactcgagcatgcaaaactattatggataccctggttatggcaactatgagcagcagtggcaacaggcagcacctcaaaagcagccaccgccagcacaaccagcacaggaggagcagcagcatcagcctccgccaccccagcagcagcagcagcagcaacccccgcagcagtgacgaccactgagggaatgattgcttttgtgcactttcggagcgctatcagcttagaggaatgtagagttacaactgcagttcgcttccaccatgaggagccctatatattagtggttatgcaattgcatggatgtggttgaacttgttcttagggaccagtgttatgtatgatgacactcctgatgttttcttctgaagatcttgattattgaagtacgttgtgtctttgagattg

SEQ ID NO: 39154 - DNA, 655 bp, Panicum virgatum
  misc_feature: Ceres CLONE 1997216
  misc_feature: Encodes the peptide sequence at SEQ ID NO. 39155
ctgtttctcccttctctcggactctcctttgctcttccttccctggcggcgacgactgggcgagcggcggcgccatttatcacgtcttcgacctgccctttcccggcgacgagcatcctcaaggcaaagatacttgattaaaactttaaaagtaggaggcccatggcatccacggcggtcaccggcggccaggtcctggacggctcgaaccaggcggtggcccgcgtgcagcagctcatcggcggcccggaatattgtcaagatgggtggagccggtgctgggaggaaggcgtgacgccgtgggaccttggccagcccacgccggccgtcgtcgagctcgccaagtccgggacgctgcccggcgacgccgccaccgtcctcgtcccgggatgcggtgcggggtacgacgtggtggcgctctccggccccggccgcttcgtcgtcggccttgacatcagcgagagcgccgttgccaaggccaaacagtggtcggcggcggcggccgacgccagcttgttcgccttcgtcgcggcggacttcttcacctgggagccgctggagctgttcgacctcatcttcgactacacattcttctgcgctttccacccgtcgatgaggccagcatgggcaaagcgaatgaccgacctgctgaagc

SEQ ID NO: 39155 - protein, 164 aa, Panicum virgatum
  misc_feature: Ceres CLONE 1997216
  misc_feature (31)..(164): Pfam Name: TPMT Pfam Description: Thiopurine S-methyltransferase (TPMT)
  misc_feature: SWISSPROT Homolog: EC 2.1.1.67 Thiopurine S-methyltransferase
MASTAVTGGQVLDGSNQAVARVQQLIGGPEYCQDGWSRCWEEGVTPWDLGQPTPAVVELAKSGTLPGDAATVLVPGCGAGYDVVALSGPGRFVVGLDISESAVAKAKQWSAAAADASLFAFVAADFFTWEPLELFDLIFDYTFFCAFHPSMRPAWAKRMTDLLK

SEQ ID NO: 39156 - DNA, 1528 bp, Panicum virgatum
  misc_feature: Ceres CLONE 1997225
  misc_feature: Encodes the peptide sequence at SEQ ID NO. 39157
accccaccccaccccacccccacccccgtcgcttcgtccccccattccttttggcgggagacaagcagcgcgccgcctccacttcccgcgcgaagcagcaaaccgaagaagaagccatggacggcggatcctcctcgccggcgagcccctcgtcgacggcagcgccgtccgcagcggagatggaggagtacgggaactggaagaagaacgcagcggtgctctacgacctcgtcatctcccacccgctcgagtggccgtcgctcaccgtgcagtggctcccctccaagtcgtcgacccgcggccaccggctcgttgtgggcactcacacctccgaccaggcccccaacagccttatggtcttggacgcggtgctcccgctcccgccccgcctcgcggcggccgccgctgcctcgggcggcgccgtcccggccccgtccgtgtccgtctcccgcgcggcgccgcaccggggcgaggtaaaccgcgcgcgctgcatgccgcagcggccctttacggtggccaccaaaacgtgcctggatgaggtccacgtgtaccatctcggcgacggcgacggcagcgagaaaagcggcgccgatgttgtgctacgggggcatgacgcggagggttatggtttggcctggagcccgatgaaggagggatggctgctgagcggctcgtatgataagaagatttgcctgtgggatcttgcctctgggagtggagctcctgttctggatgcccatcaggtgtttgaggctcatgaggatctcgttgaagatgttgcctggcacctgaaagatgacaatatatttggatctgttggggatgactgcaagttgatgatgtgggacctgcgtacaaacaaaccagaacaatctattgctgcacaccaaaaggaggtcaactctttgtcattcaatccatttaatgaatggatcttggctacagcatctggagatgcgacagttaagctatttgatatgcgaaaattatcgagaagcttgcacactttcgacagccatgagggcgaggtgtttcaggttgaatggaacccgaatttgggtactgtattagcttcatctgccgcagacaaaagagtgatgatatgggatgtcaacaggattggagatgagcagtcagaggaggacgctgatgacggacccccggagctgctgtttgtccatggaggccacacggccaagatatcagagctgtcgtggaaccccagcgagaaatgggtcgttgccagcgtgggtgaagataacatcctgcagatctgggagatggcggagagcatctacagcgatgactactcgctgcaggacaactgacgcatgcctcgccacataagatgagttagttgcctgttcagtggcaccaagcatactcggagggattgtgtctgcagttaacctgtggtaggatccaagagacattcattcattcctgagttgctatcgtccgtgcgaagatgatgactcgattaaattcgtatgatatctcagtttacctgtgtggatcttgtctgatc

SEQ ID NO: 39157 - protein, 403 aa, Panicum virgatum
  misc_feature: Ceres CLONE 1997225
  misc_feature (292)..(331): Pfam Name: WD40 Pfam Description: WD domain, G-beta repeat
  misc_feature (248)..(287): Pfam Name: WD40 Pfam Description: WD domain, G-beta repeat
  misc_feature (156)..(195): Pfam Name: WD40 Pfam Description: WD domain, G-beta repeat
  misc_feature (349)..(388): Pfam Name: WD40 Pfam Description: WD domain, G-beta repeat
  misc_feature (205)..(244): Pfam Name: WD40 Pfam Description: WD domain, G-beta repeat
  misc_feature: SWISSPROT Homolog: EC 2.3.1.48 Histone acetyltransferase
MDGGSSSPASPSSTAAPSAAEMEEYGNWKKNAAVLYDLVISHPLEWPSLTVQWLPSKSSTRGHRLVVGTHTSDQAPNSLMVLDAVLPLPPRLAAAAAASGGAVPAPSVSVSRAAPHRGEVNRARCMPQRPFTVATKTCLDEVHVYHLGDGDGSEKSGADVVLRGHDAEGYGLAWSPMKEGWLLSGSYDKKICLWDLASGSGAPVLDAHQVFEAHEDLVEDVAWHLKDDNIFGSVGDDCKLMMWDLRTNKPEQSIAAHQKEVNSLSFNPFNEWILATASGDATVKLFDMRKLSRSLHTFDSHEGEVFQVEWNPNLGTVLASSAADKRVMIWDVNRIGDEQSEEDADDGPPELLFVHGGHTAKISELSWNPSEKWVVASVGEDNILQIWEMAESIYSDDYSLQDN

SEQ ID NO: 39158 - DNA, 1163 bp, Panicum virgatum
  misc_feature: Ceres CLONE 1997227
  misc_feature: Encodes the peptide sequence at SEQ ID NO. 39159
aagatcgatcgacgatcagcaagcacttcgcgcgcccagatcaacagacgcatcttcccactcggagttgcagcgtccccttcgaagcatggatccgttcgcagggccccccgacaagcggcgggcgtttgacgacggcgggcagtccaacggcgttcagcgggaccggatgtgcaagcggtttgacacgcctgaggggtgcccctttggggacaggtgccgcttcagccatggggcggacgacccacgtttcaaaggagcggcgaactccaatcagaagcagccctgccaaaagtttttcagcacaaacggctgcccgtatggcgacacctgtcacttcacccactatgtgagcggcccgccccctcgcatcatcatcggcagcggccagtcatcggcagcggcggcagccccccttgctagttacagggcgccagagccggaccagggccgacaaaacatgaagacgcgcatgtgcaaaaatttccaggaggggaactgcacctttggcgagcggtgccacttcgcccacggcgcccaggagatgcgcgccaaccccgctcgcgccgcagccccgaccggattcacttccaccatggctcctgagggttcgggggtcaaggagttccccctgctgtggggagaatcaaccacagatgcggcgggcaacgtgactatgatggctacgatcacgttcccacaggaaatggccgggtcgatcattggcaaggggggccagaacgtgaggcagatccaggtcacgtcgggcgcaaaggtcaccctcaagcccagtccagccgaccccgccaacctgaaagatgtcgacattgaggggacgggcgccgctgtgcaatctgcggcgtcgctgattcagcgcacgctggcggataagctgaacaacccggggggcagccggcccggcgcaggagcggcttcgccgttcttcaagacgcgcatgtgcgagaagttcatgcagggggcgtgcacgttcggggacaagtgccacttcgcccacgggcaagcggatctgcggacgaggacagatcagccggctgcctatggggctcagccagctgcttatggagggcagccggctgcttatgggggcccggcggcttatcagtcgggtcctccgggtggggtcgcagcttattgagctgtag

SEQ ID NO: 39159 - protein, 355 aa, Panicum virgatum
  misc_feature: Ceres CLONE 1997227
  misc_feature (125)..(150): Pfam Name: zf-CCCH Pfam Description: Zinc finger C-x8-C-x5-C-x3-H type (and similar)
  misc_feature (24)..(50): Pfam Name: zf-CCCH Pfam Description: Zinc finger C-x8-C-x5-C-x3-H type (and similar)
  misc_feature (286)..(311): Pfam Name: zf-CCCH Pfam Description: Zinc finger C-x8-C-x5-C-x3-H type (and similar)
  misc_feature (198)..(261): Pfam Name: KH_1 Pfam Description: KH domain
MDPFAGPPDKRRAFDDGGQSNGVQRDRMCKRFDTPEGCPFGDRCRFSHGADDPRFKGAANSNQKQPCQKFFSTNGCPYGDTCHFTHYVSGPPPRIIIGSGQSSAAAAAPLASYRAPEPDQGRQNMKTRMCKNFQEGNCTFGERCHFAHGAQEMRANPARAAAPTGFTSTMAPEGSGVKEFPLLWGESTTDAAGNVTMMATITFPQEMAGSIIGKGGQNVRQIQVTSGAKVTLKPSPADPANLKDVDIEGTGAAVQSAASLIQRTLADKLNNPGGSRPGAGAASPFFKTRMCEKFMQGACTFGDKCHFAHGQADLRTRTDQPAAYGAQPAAYGGQPAAYGGPAAYQSGPPGGVAAY

SEQ ID NO: 39160 - DNA, 689 bp, Panicum virgatum
  misc_feature: Ceres CLONE 1997230
  misc_feature: Encodes the peptide sequence at SEQ ID NO. 39161
gaagcagaggctcatcaccctacccaagtacccatcctccgccgccgccgccgccgccgccatggccgcagcccccaccggcggccccgctatcaccatgtcctcctcctcctccctctctccgtcgccgttctctctcaaggccagccaccgccgacccgccgggagaatgcctgacaccgtccgctgcgtcagtagcccgccggccgccgatacagcttacaagactagtgtcccgcgcaatgcaaacatgaccaagctccaagcaggatatctgtttcctgagatagccaggagaagagcagctcatttgctgaagtaccctgatgctgagattataagccttgggataggtgacactaccgagcccattcctgacgtcataacaaatgccatggcagagagagcacatgccttatcaacaattgatggctacagtggttatggagctgagcaaggtgaaaagaaactaagggcagcaattgctgcaacctactatgcggaccttggtattgaagattcagacatatttgtctctgatggtgccaaatgtgacatttctcgcctccaggtcctttttggatctaatgtgacaattgcggtccaagacccatcataccctgcatatgttgattcaagtgttatcatgggccaaaccgacttatatcagcaagatgttcaaagtatgg

SEQ ID NO: 39161 - protein, 209 aa, Panicum virgatum
  misc_feature: Ceres CLONE 1997230
  misc_feature: SWISSPROT Homolog: EC 2.6.1.83 LL-diaminopimelate aminotransferase
  misc_feature: Useful for making plants with modulated nitrogen use efficiency
MAAAPTGGPAITMSSSSSLSPSPFSLKASHRRPAGRMPDTVRCVSSPPAADTAYKTSVPRNANMTKLQAGYLFPEIARRRAAHLLKYPDAEIISLGIGDTTEPIPDVITNAMAERAHALSTIDGYSGYGAEQGEKKLRAAIAATYYADLGIEDSDIFVSDGAKCDISRLQVLFGSNVTIAVQDPSYPAYVDSSVIMGQTDLYQQDVQSM

SEQ ID NO: 39162 - DNA, 1389 bp, Panicum virgatum
  misc_feature: Ceres CLONE 1997256
  misc_feature: Encodes the peptide sequence at SEQ ID NO. 39163
gcggcagcacagatcgccatctcgctccagctccacccacaccactgcacagtaactaccaccagtccacacgacgccggcgcggcctcctccctccctcctcaaagattcgattcgtgtcttctccctcctcctcctcccacatggccggcgacctgcgccaccgccgcgcgccggcggaggacgggggcgagagcgcctcctcagccggggagggagccgccgccagcggcaaggatggggcgggggagccgagggggaagagggaggcgctggggtggctcgaatggggccgcggctggatggccatcgtgggggagttcctcttccagcgcatcgccgccagccacctcgccaacccgctcgagctgcccccgctcgagggcgtctccatcatcgtcaccggcgccaccagcggcatcggcctcgagatcgcaagacaactcacacaggccggggcacatgttgtgatggcagttaggagacccaaggtggcacaagagttgattcagaaatggcagaatgaaagttcagaaacaggagctccactaaatgctgaggtgatggaacttgacctgctttccctcgattcggttgtcaaatttgctgatgcttggaatgctcgtatggcacccttacacgtgttgatcaacaatgctggaatcttcgctataggagagccacagcgtttttcaaaggatggtcacgaagagcacatgcaagtaaaccatcttgcacctgcattactggcgatgttgcttataccttcccttctccgaggttctccctgcagaattgttaatgtcaattcaattatgcacactgtaggctttgttgatgctgaggatatgaacttgagaaagaggaaatatagaagttggctgggatattcaaatagcaagttggcacagataaaatttagcagcatgcttcataagagaatccctgcagaagctggcatcaacattatttgcgcttctcctgggattgtcgacacgaatgttgcaagagatcttcctaaggttgttgtagctgcctatcatttgattccctacttcatatttgatgctcaagaaggttctaggagtacaatatttgcagcatctgacccccaggttctggaatactgtgagatgctgaagtctgaagactggcctgtttgcgcttgcattaattacgattgtaatccaatgaatgcatctgaagaggcacacaaccttgaaacttcgcagttggtttgggagaaaacacttgagatgattggccttccgccagatgccctggagaagctcatcgctggggaatccattcagtgccgttatggacaacaggaggcataatagaaatcgcacagatccaaatcgaaaaatggtgggtttgttcctgttc

SEQ ID NO: 39163 - protein, 398 aa, Panicum virgatum
  misc_feature: Ceres CLONE 1997256
  misc_feature (82)..(243): Pfam Name: adh_short Pfam Description: short chain dehydrogenase
  misc_feature: SWISSPROT Homolog: EC 1.3.1.33 Protochlorophyllide reductase
MAGDLRHRRAPAEDGGESASSAGEGAAASGKDGAGEPRGKREALGWLEWGRGWMAIVGEFLFQRIAASHLANPLELPPLEGVSIIVTGATSGIGLEIARQLTQAGAHVVMAVRRPKVAQELIQKWQNESSETGAPLNAEVMELDLLSLDSVVKFADAWNARMAPLHVLINNAGIFAIGEPQRFSKDGHEEHMQVNHLAPALLAMLLIPSLLRGSPCRIVNVNSIMHTVGFVDAEDMNLRKRKYRSWLGYSNSKLAQIKFSSMLHKRIPAEAGINIICASPGIVDTNVARDLPKVVVAAYHLIPYFIFDAQEGSRSTIFAASDPQVLEYCEMLKSEDWPVCACINYDCNPMNASEEAHNLETSQLVWEKTLEMIGLPPDALEKLIAGESIQCRYGQQEA

SEQ ID NO: 39164 - DNA, 1383 bp, Panicum virgatum
  misc_feature: Ceres CLONE 1997264
  misc_feature: Encodes the peptide sequence at SEQ ID NO. 39165
aatttccctcggccaccgaggccgcgaacagctcaagaaaagtagcagcagcaccccgcggcggcgacgagtaaccaaccgggccacgccattgccagtcgcccggccgcctacgagccctgcctcgcgcccttgcccggccaccgcgccttccttctccctcccgctgcgagttctctcgcgcagcccgaatccgcggggtggtaccgcttcttctgagttctttctcggcggcgcgccatggaggagacggggaagagggtggtgaggaccgtgcgggtgcggaacatctcagatctggcgacagagcgggaggtgcgcgagttcttctccttttccggtgaaatcaaacacgtcgacatcagatttgacggtacggggaggacggcctacgtgacattcaaagatcccaaagccctcgagattgcccttctcctatcgggagcaacaattgtggatcaagttgtgaacatagccccagctgaagattacatctacatcccagttactgaacagcaacttttggtcaatgaggtgacaagtacaagttcagctcctaatgcagaattggagtactcctctccagaggccaatgccagccccaatagccatatctatgtgagcaaggctcatgatgtcatgacaaatgtgattgcaaagggttcagcaatgagacaagatgctgtgaacaaggctaaagcatttgatgagaaacatcagttgagagctaatgcatcagcaaggatcaattcctttgataagcgtgttggcctttcgcagaagataaacaatgggatatcagttgtcaatgaaaaggtgaaatcggtagaccaaaggttacatgtttctgacaaaacaatggctgctttgctggctgcagagcgtaagcttaatgatacaggctctgctgtgaaaaccaacaggtatgtgtctgctggaacgagctggctgaatggtgcttttagcaaggtcgccatggctggtcatgtcgctggctcaagaaccagagagaagttccaattagcagtgacaaatctaacagccaaaggccctgccgttgttgcttgagcttgctttggtggttatggaagctcttcttcatgaggaaaatctatttgaagtccttgagcaagcatctccctttgattgcgtggacagtgtggacagtaactgtatttcacttttgtcttgtcctttttccttgggtaggctattgagtaaatcttctgaggtttggtatatagaggagctcatattttggtatttttagaacacttcattcttttagtgttgatgttaaattgattataggtgatagtgatattgtattgacttggtgtggattctgatcgtcattgattcctattcttatgtgattctccc

SEQ ID NO: 39165 - protein, 275 aa, Panicum virgatum
  misc_feature: Ceres CLONE 1997264
  misc_feature (12)..(78): Pfam Name: RRM_1 Pfam Description: RNA recognition motif. (a.k.a. RRM, RBD, or RNP domain)
MEETGKRVVRTVRVRNISDLATEREVREFFSFSGEIKHVDIRFDGTGRTAYVTFKDPKALEIALLLSGATIVDQVVNIAPAEDYIYIPVTEQQLLVNEVTSTSSAPNAELEYSSPEANASPNSHIYVSKAHDVMTNVIAKGSAMRQDAVNKAKAFDEKHQLRANASARINSFDKRVGLSQKINNGISVVNEKVKSVDQRLHVSDKTMAALLAAERKLNDTGSAVKTNRYVSAGTSWLNGAFSKVAMAGHVAGSRTREKFQLAVTNLTAKGPAVVA

SEQ ID NO: 39166 - DNA, 1209 bp, Panicum virgatum
  misc_feature: Ceres CLONE 1997277
  misc_feature: Encodes the peptide sequence at SEQ ID NO. 39167
gacactactttcctctcctctctcccatcgacaccttccctcgccctcatggcctcagagcctatagagtgccaggttctggtgctgagggtgtccattcactgtgaaggatgcaagaagaaggtgaagaaagtgctccaaaatgttcatggcgtgctccgatgcgacatcgatgcccggagcaacaaggtcgtggtcacggcctcgacgaatctcgaccccaacatcctcgtcgcgaagctgcgcaagtccggcaagcaggccgagccgtggccagagcagccgatgccgcctgcggatagccaaggccaagagaccaagaaccaaaacgacgagcaaagcaaacctacggagaagcccggtccggacaacgccgaggccagcgcggcagagccaagcaatcctcagccgtcgatggagcccaacgccggtgagaccccgaagccggctccagaaagaaaagaggcctccaacgccaacgccggcgatgaggtagaagggaagcagcaacccaaagaggcgaaacagcagcagccggtcaacgccagggtgacggtggagtacgaccgcggcggtgacaacagctacatgagccgcatgccggcgccacagcccgtcatgagctacaacatggcacggccgagccccatcgcgtcctactacgcgaccccaccggcaccggcgccggggccgtcgcaaggctacattgacgagcaccacgccccttcttactacggtcggtcctcgccgtacgacgagcagccttactactacccaactcagccatcgccgtaccgcaatgatcaccactatcagcctgcttcgtcgacggaggactactactacagcgcgccgccgcagagaagcgccttctcgccgccccgggacgggtacggcgacatgttcaacgacgagaacgccaattcgtgcaccgtgatgtgaagcaacgaacgaagctactcgagctagtcttatttattactgttagtatgactactgtatatgttagaactagtagtacaagctaccgatgtaccagcagtcagcactactcgggcttcatgggatcagctggtcttgagtgcttagatgcaacagaggagagatgcatgtgaggccgtgaggggctaatgcaacagctctggtgtgttcaccagagcaattttgtatcttcaaattcatcgagaactagtatgtgacagaattagc

SEQ ID NO: 39167 - protein, 297 aa, Panicum virgatum
  misc_feature: Ceres CLONE 1997277
  misc_feature (12)..(74): Pfam Name: HMA Pfam Description: Heavy-metal-associated domain
MASEPIECQVLVLRVSIHCEGCKKKVKKVLQNVHGVLRCDIDARSNKVVVTASTNLDPNILVAKLRKSGKQAEPWPEQPMPPADSQGQETKNQNDEQSKPTEKPGPDNAEASAAEPSNPQPSMEPNAGETPKPAPERKEASNANAGDEVEGKQQPKEAKQQQPVNARVTVEYDRGGDNSYMSRMPAPQPVMSYNMARPSPIASYYATPPAPAPGPSQGYIDEHHAPSYYGRSSPYDEQPYYYPTQPSPYRNDHHYQPASSTEDYYYSAPPQRSAFSPPRDGYGDMFNDENANSCTVM

SEQ ID NO: 39168 - DNA, 642 bp, Panicum virgatum
  misc_feature: Ceres CLONE 1997284
  misc_feature: Encodes the peptide sequence at SEQ ID NO. 39169
aacccagccaagcccacagggattgaatattcgtagcaagcagcctccggcccccgcccctttttagttcctttgctgctcctcgatttgattgcttgcgttcatcctcgacctcgattgattcctccctgaggcgaaggcaggcaggcaggcaggctggtcaccatgggatctaaggcacctttcttcctcttgctcctcttgctgctcgtcgcccgggcacctgcacaagccagggatcctgctgttttaattgatcatcatgcaattgagctcccagatcacagccctgtcgacaaggaacatattcctgtccatctcaagagcagcagcccgatatgctctgcttgtgaaaacttagcgagtggtgctgtcacttatctaagtgagaaacaaacacaagataagatcatggaattacttcatcatgcttgttcgcagtcattctccttggaacagaagtgtgttgaattgatggactcctatgcaactctgctgtttgccaagatttcagagatcaagccagaagagttctgcaaacagtatggcctgtgcagggataccacctttttctctggtgtgggtagtgacagcacttgtgtgttttgccaccaccttcttgatgaaattatgtccaaactg

SEQ ID NO: 39169 - protein, 158 aa, Panicum virgatum
  misc_feature: Ceres CLONE 1997284
  misc_feature (56)..(95): Pfam Name: SapB_1 Pfam Description: Saposin-like type B, region 1
  misc_feature (97)..(130): Pfam Name: SapB_2 Pfam Description: Saposin-like type B, region 2
MGSKAPFFLLLLLLLVARAPAQARDPAVLIDHHAIELPDHSPVDKEHIPVHLKSSSPICSACENLASGAVTYLSEKQTQDKIMELLHHACSQSFSLEQKCVELMDSYATLLFAKISEIKPEEFCKQYGLCRDTTFFSGVGSDSTCVFCHHLLDEIMSK

SEQ ID NO: 39170 - DNA, 649 bp, Panicum virgatum
  misc_feature: Ceres CLONE 1997291
  misc_feature: Encodes the peptide sequence at SEQ ID NO. 39171
aacgttccggaaccttcgagggaccttccgcaggcgaggcctcgctcccccgcccggatctccccgttccccctcggcggggctggggctcgggagaagagagcaggggagggagggaggatgctgagcgtggttcgggtgcacctgccgtcggagatcccgatcgtgggctgcgagatcacgccctatgtgctgctgcggcggcctgacggtgcagtctccaccgacgacgtgcccgaaaccgcgcccaccgatggccagttcatgcggtacagatggtatcgcatacagagcgatcggaaagttcctatctgcagtgtacatccaatggaacaagcaacaattcagtgcctcggttgtctcaagtcaaaaatacctgttactaagagctaccactgttcagctaaatgcttctctgatgcatggcagcaccacaaggttttgcatgagcgagctagtagtgctttaaatgaaaatggagctgaagaagaggagttatttggtagatttggctgtggtggttctggagttctaagtactgctgggtctggttcattgtcaaattttggacagagccctagtgttagtaatgggcctgtgcctttgtatccctcgggcactgataagaactctggagagacttggtttg

SEQ ID NO: 39171 - protein, 176 aa, Panicum virgatum
  misc_feature: Ceres CLONE 1997291
  misc_feature: SWISSPROT Homolog: EC 3.4.11.18 Methionyl aminopeptidase
MLSVVRVHLPSEIPIVGCEITPYVLLRRPDGAVSTDDVPETAPTDGQFMRYRWYRIQSDRKVPICSVHPMEQATIQCLGCLKSKIPVTKSYHCSAKCFSDAWQHHKVLHERASSALNENGAEEEELFGRFGCGGSGVLSTAGSGSLSNFGQSPSVSNGPVPLYPSGTDKNSGETWF

SEQ ID NO: 39172 - DNA, 695 bp, Panicum virgatum
  misc_feature: Ceres CLONE 1997312
  misc_feature: Encodes the peptide sequence at SEQ ID NO. 39173
cctcgttgagagagtcgtcccccccgcgtgctctccgcctgcggcctctgtatcccgcaaccaaaaactaccaaaaaaattagaaatccccaaatccgcgagatctatcagtatcgagcgacttaccaatccgattgctagggtttagatccgattttttcgaaaaaactgaaaaaaatttggtcgaggggaggaggaggaggcgatggccgcgcaagtggcggcggcggtggcgaacgggagcgcgggcgctgtccccgcggtggtgtcgccgggagcggtcggcgtggcgcagcccctcccgaccacgtcgctctacgtcggcgacctggaggggtccgtctcggattcacagctgtacgagctcttcagccaggcggggcaggtggtgtcggtgcgcgtctgcagggacgtcacctcgcgccgctcgctcggatacgcctatgtcaacttcagcaaccccctggatgctgcaagagcactggaattgttgaactttgctctgcttaacaacaagcctatccgtgtgatgtattcaaatcgtgacccaagcagccgcaggagcggatctgcaaacattttcatcaagaatcttgacaaggcaatagacaataaaactcttcacgagaccttttccacatttggtaccattctctcatgtaaagttgccatggatgaagtgggccaatccaaag

SEQ ID NO: 39173 - protein, 163 aa, Panicum virgatum
  misc_feature: Ceres CLONE 1997312
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAQVAAAVANGSAGAVPAVVSPGAVGVAQPLPTTSLYVGDLEGSVSDSQLYELFSQAGQVVSVRVCRDVTSRRSLGYAYVNFSNPLDAARALELLNFALLNNKPIRVMYSNRDPSSRRSGSANIFIKNLDKAIDNKTLHETFSTFGTILSCKVAMDEVGQSK

SEQ ID NO: 39174 - DNA, 1252 bp, Panicum virgatum
  misc_feature: Ceres CLONE 1997314
  misc_feature: Encodes the peptide sequence at SEQ ID NO. 39175
agatcacaccgcctttccgcagcctttccctggcccctctgtcctctgtctccctcctctctcgcacacggcacacagctctctctcttctctctctctggcgctgaatcttgtgagagtgagaggtggaagggggtagcttccatcgttttcgctgcagattttggctgctgcgcggcgtcctctgcggcctgtgattctgtcccccgtgcttcaccaccaacccaacccaagaggggaggctgatgccctgtccctgaactgaactggagagacagcacagtccggaatatgtttggtttctcgcggcgccgggtgaaacttggaaggttgaagggtgaccataatgattctttgaatagctccaggagtcttggtggccccacgaaacagctcagcctacctaatggggatgacgctgctacaacatcggtgagcggccgcgcagatgatctttcctaccgctgctcttcagatactttcgatctcgacagtcgttctttcaatatttctgaaaactggactgtgttgtccacagagggagacaaacctattcctcgtttctatcatgcagcggccattgtaagtagcaagatggtagtgtttggtggtgattctggtcgtcacttattaaatgatacaaagatactcaatttagagaagcttagctgggattctgcaccgcctaaagttcggccatcaccaagtggacgttctaccaagttgccagcctgcagaggtcattgtctggttccatgggaaaatagtgtcattcttgttggaggtaaaactgagcctgcttctgatcgtttatcagtatggattttcaatactgaaacagaactttggtcccttgttgaagccaagggtgatatccctgcagctcgaagcggccacacagtgatcagagccggtgctagattgatactttttggcggcgaggacacaaaaggaaagaaacgacatgaccttcacatgtttgatctcaaatcatcaacatggcttccattgaactataaaggcgctggaccttctccgagatccaatcatgtcgctgcactgtatgatgataggatcctcctgattttcggaggccactcaaaatcgaagacccttaatgacttgtattctttagattttgagacaatggtgtggtcaagagcgaagactcatggtcatcacccatcaccccgagcaggttgcagcggagctctgtgtggaaccaagtggtacatagctggtggcgcaagca

SEQ ID NO: 39175 - protein, 320 aa, Panicum virgatum
  misc_feature: Ceres CLONE 1997314
  misc_feature (89)..(134): Pfam Name: Kelch_2 Pfam Description: Kelch motif
  misc_feature (249)..(295): Pfam Name: Kelch_2 Pfam Description: Kelch motif
  misc_feature: SWISSPROT Homolog: EC 3.1.3.16 Phosphoprotein phosphatase
MFGFSRRRVKLGRLKGDHNDSLNSSRSLGGPTKQLSLPNGDDAATTSVSGRADDLSYRCSSDTFDLDSRSFNISENWTVLSTEGDKPIPRFYHAAAIVSSKMVVFGGDSGRHLLNDTKILNLEKLSWDSAPPKVRPSPSGRSTKLPACRGHCLVPWENSVILVGGKTEPASDRLSVWIFNTETELWSLVEAKGDIPAARSGHTVIRAGARLILFGGEDTKGKKRHDLHMFDLKSSTWLPLNYKGAGPSPRSNHVAALYDDRILLIFGGHSKSKTLNDLYSLDFETMVWSRAKTHGHHPSPRAGCSGALCGTKWYIAGGAS

SEQ ID NO: 39176 - DNA, 719 bp, Panicum virgatum
  misc_feature: Ceres CLONE 1997317
  misc_feature: Encodes the peptide sequence at SEQ ID NO. 39177
gtgaggaggaggagagaggagggcgcgtcctgctgtggtccttgttcgttgctcccctccgctttccgtgatgtcgtcaccgagcaagcgccgcgagatggacctaatgaagctgatgatgagcgactacaaggtggagatggtgaacgacgggatgcaggaattcttcgtcgaattcaaggggccgaccgaaagtatctatcaaggtggtgtctggaaggttagggtggaattgcctgatgcgtacccttacaaatccccttccattggcttcatcaacaagatttatcacccgaatgttgatgaaatgtctggttccgtctgtttggatgtcataaaccagacatggagcccaatgtttgatctggtaaatgtttttgaagtgttccttccacagcttttactgtatccgaatccttctgatccattaaatggggaggctgctgcattgatgatgcgtgaccgccctgcgtatgaacaaaaagtgaaaggtaatgtgattcagcaaaatccctgattgtctttgccttttgggtacatactctatacttatggagtgtgaactgtgaacccacattagggtgttctcttgcaacctcgctcttttgtgcaccaaaacagcatgaaaagtctgattgtctttcataatgcttgcacgcattagtcaattgcaaacttctctcaagcctaacatgttcaaattatactacaatacaaac

SEQ ID NO: 39177 - protein, 139 aa, Panicum virgatum
  misc_feature: Ceres CLONE 1997317
  misc_feature (1)..(134): Pfam Name: UQ_con Pfam Description: Ubiquitin-conjugating enzyme
  misc_feature: SWISSPROT Homolog: EC 6.3.2.19 Ubiquitin--protein ligase
MDLMKLMMSDYKVEMVNDGMQEFFVEFKGPTESIYQGGVWKVRVELPDAYPYKSPSIGFINKIYHPNVDEMSGSVCLDVINQTWSPMFDLVNVFEVFLPQLLLYPNPSDPLNGEAAALMMRDRPAYEQKVKGNVIQQNP

SEQ ID NO: 39178 - DNA, 1305 bp, Panicum virgatum
  misc_feature: Ceres CLONE 1997318
  misc_feature: Encodes the peptide sequence at SEQ ID NO. 39179
tttttttggcgaacaactccgccaccagataagcttggatccagggattcccggcagcaagacggcgggcagagcggctccttctcgtgcagccagcgcaccgcagcgagcgtgcccagaaaccctcctcctcctccccctccagcttcgacggaagctttccgctgaaccccccaatcccatgctcaaggtttagtccgggcttcaaggtttctgctgggattgcacaatagccatgtggaggttaaaacagttgatgcccaaagagcaacctgctggccttgagggccgcaacatcgatgtcggtaacgtcaaggtgcatgtccgggaagccatcgccgagggcgggttctcgtgcgtctatgccgcaagggacatggtgaacccggccaagcagtacgccctgaagcacgtgatcgtccaagacgaggagtcgctcgagctggtccggaaggaaatcacggtcatgcagtcgctcaaggggcacccgaatgtggtcacgctcgtctcgcacgcgatactggatatgggccgggcaagggaggcactgctggtcatggagttctgcgagaagtcgctagtttcggtgttggaaggtagaggtgccagttactttgatgaggagagggtggcactgatcttccgggatgtttgcaacgctgtatttgcgatgcactgccagacaccgccaattgctcacagggacctaaaggctgaaaatgttcttcttggtgctgacggggcatggaagttatgtgattttggcagtgtgtctacaaaccataagcgctttgataaacctcaggagatgggcattgaagaggatattatcaggaagcacaccactcctgcatatagagctccagagatgtgggacttgtacaggagggaggttatcaatgagaaagtagacatatgggctcttggatgtctcttgtatcgaatctgctactttaaatcagcttttgatggagaatcaaaacttcaaatacttaatgggaactatcgtatcccggagttaccgaagtatagtgcatcgattacaagtttgatccaagacatgcttaattcttctccagatgccagaccggacattacacaggtatggttccgtgttaatgaattacttccgttggagctgctaaaggatttacctgatggatcaccttctggatcagcatttgagtcacatactgccgtggatgaagtgccaaccagactgcctcagaggagctcaccttcaccctcaagagagaacgtgaagagtaccatagaatcttccaaccagaaggcacaaggtacttc

SEQ ID NO: 39179 - protein, 356 aa, Panicum virgatum
  misc_feature: Ceres CLONE 1997318
  misc_feature (28)..(292): Pfam Name: Pkinase Pfam Description: Protein kinase domain
  misc_feature: SWISSPROT Homolog: EC 2.7.11.1 Non-specific serine/threonine protein kinase
MWRLKQLMPKEQPAGLEGRNIDVGNVKVHVREAIAEGGFSCVYAARDMVNPAKQYALKHVIVQDEESLELVRKEITVMQSLKGHPNVVTLVSHAILDMGRAREALLVMEFCEKSLVSVLEGRGASYFDEERVALIFRDVCNAVFAMHCQTPPIAHRDLKAENVLLGADGAWKLCDFGSVSTNHKRFDKPQEMGIEEDIIRKHTTPAYRAPEMWDLYRREVINEKVDIWALGCLLYRICYFKSAFDGESKLQILNGNYRIPELPKYSASITSLIQDMLNSSPDARPDITQVWFRVNELLPLELLKDLPDGSPSGSAFESHTAVDEVPTRLPQRSSPSPSRENVKSTIESSNQKAQGT

SEQ ID NO: 39180 - DNA, 607 bp, Panicum virgatum
  misc_feature: Ceres CLONE 1997318-R
cacttggacagacaaagacaaagaatcggatgccgatccatttgcttttggtcaagagggttttaaggctgatccctcaggagctgtactttctaagttatcaaatttaggaaatacctctcagcccattgataaccttaatgatgaaggaaagaaagacgactcctaccagccagctgggtggactgggttttagttttactacctcgattcatggtacaatatgccaaaagatgtggtcctctgtgtattatatgaattatgtggagctaggattgatcaaaatgagtcagagtacatatggccttggtgatattgcatacagaagagcccacctagaaatgtctgcactgatttaggtatgtccgtcgacgcttttgtacaattgttctggagcttaattctcatcatgtagcatccagttgtaacatatagtacacatgtatgttgtcatcttcaaataattgttagatgttagaaatacgaaaatggctttctccatagacagtatggtgttatatcaatttctataacaaacttttccacgtgctgtatttactataagtatccattgccaagtcagataaagtagtttccatttgctggc

SEQ ID NO: 39181 - DNA, 1297 bp, Panicum virgatum
  misc_feature: Ceres CLONE 1997323
  misc_feature: Encodes the peptide sequence at SEQ ID NO. 39182
agccgccgactctgttctgcccctctcctctccctccaaattccttaaaccctagcagcggcgcccgccaccgcgacggcgccgtcgacgacgacgaggaggaggagcgcgggtgtagggctccggcgacttctctgagcatggcggcgagccatggcgcggggacgctcaagtccacctccatcaacggggtcaagctctactcgctcaccggcaaccgctacgtcgccccctgggttctcgccaagaagaagcgcgcgctccgcaaggaccaagagtatcagcggaggttggatttgatccatgacctgaggtttgagactgccaccaccaagatcaagttgacgcctgatgaccagttcgtgatcgcctcaggtatctaccccccgcaagttaaagtctatgagctgaaggaattgtccatgaagtttgagaggcacatgatttcagaaattataaatttccagatccttggtgatgactattccaaacttgcgtttttgtgtgctgatcgttctgtaaatctgcatgcaaagtatggaagccattatagtttgagaattccaagaatgggaagggacatggcctacgattgctggtcttgcgatttgctatgcgctgcttcatcaccagatttgtacagaatcaacttagagcagggacgattccttgcttctctttcctcccaatcgcctgcaataaatgtggttacacgaagtaaggtccatgggcttgtcgcttgtggtggtgaggatggtgcggttgagtgctttgatatgaggaaaaggtcttctgttggcagaattaatattccagctgtttcttctgaagattatggtcaggaggtcacatctttgcaatttgacgaagatcaaggataccttatggcattagggagcagtacaggaaagatatcaatatatgatttgcgcatgtcttctcctctgctagttaaggatcacatgtacagtagtccaatactaaatatcaagtggcaccagacacttaattctactgagcctaaacttatcaccgctgataagcacatagtgagagtttgggatcctaatacgggaaataacatgactagcattgaaccagacggtggtgctatcaatgatgtctgcatcttccggaatagtggtttaatgctattagctctggataatagccagatacctgcccactttattcctgcacttggccctgctccaaagtggtgctcacatcttgataacctaactgaggagatggaagagaaagctgatagcacggtgtatgatgaatacaagtttct

SEQ ID NO: 39182 - protein, 385 aa, Panicum virgatum
  misc_feature: Ceres CLONE 1997323
  misc_feature: Useful for making plants with modulated biomass
  misc_feature: Useful for making plants with modulated flowering time
MAASHGAGTLKSTSINGVKLYSLTGNRYVAPWVLAKKKRALRKDQEYQRRLDLIHDLRFETATTKIKLTPDDQFVIASGIYPPQVKVYELKELSMKFERHMISEIINFQILGDDYSKLAFLCADRSVNLHAKYGSHYSLRIPRMGRDMAYDCWSCDLLCAASSPDLYRINLEQGRFLASLSSQSPAINVVTRSKVHGLVACGGEDGAVECFDMRKRSSVGRINIPAVSSEDYGQEVTSLQFDEDQGYLMALGSSTGKISIYDLRMSSPLLVKDHMYSSPILNIKWHQTLNSTEPKLITADKHIVRVWDPNTGNNMTSIEPDGGAINDVCIFRNSGLMLLALDNSQIPAHFIPALGPAPKWCSHLDNLTEEMEEKADSTVYDEYKF

SEQ ID NO: 39183 - DNA, 564 bp, Panicum virgatum
  misc_feature: Ceres CLONE 1997323-R
  misc_feature: Encodes the peptide sequence at SEQ ID NO. 39184
gatgaacgacacgctgaagcatttctaaagagcgtctccctatctaatgaggatgctgttcccctagaggataggatagctgctctggaaaagaaacagaactccaaagcacttgatgcggtcaagtatggacctggtggttcaagagagatctcattcatctctagaagcggaagaaggcacaaggaagaattacctagcgatgatgaaggaccaaaggatttcaagaggcgaggcgtacaatccctggggttgaagcagggcaaagctgagttctatatgtttggtggaagtcgtggcagaggaaggggtggcgccagagggagaggtggtcgtgggagaggcggcagaggtaggggcaggggcagaggatgagctaatttggtctcgagatgattttggtaaacgtagaaatggtgatatttcccctgagtttactcacacaagtctaaaatgtgctgagatgtaatccattgcaagagtacaaactgacagtacacgccgtgattctaaagtgtattccattacaatgggcaagagctatagcagtgtgtacggtgcatc

SEQ ID NO: 39184 - protein, 124 aa, Panicum virgatum
  misc_feature: Ceres CLONE 1997323-R
  misc_feature: Useful for making plants with modulated biomass
  misc_feature: Useful for making plants with modulated flowering time
DERHAEAFLKSVSLSNEDAVPLEDRIAALEKKQNSKALDAVKYGPGGSREISFISRSGRRHKEELPSDDEGPKDFKRRGVQSLGLKQGKAEFYMFGGSRGRGRGGARGRGGRGRGGRGRGRGRG

SEQ ID NO: 39185 - DNA, 660 bp, Panicum virgatum
  misc_feature: Ceres CLONE 1997324
  misc_feature: Encodes the peptide sequence at SEQ ID NO. 39186
cgcttcagtgagccagccagccagtaggcgcggcggcgagcggcgccggcccgtcattgtccagtgggcgaagagctccggcggcggtggccatggctcgcctccgctgcgcgctcgtgctggcgctcctcctcgcgcggctgcccggcgacgccatcgccgggcgcgggcaccacggccccgccgcgcacgactacagggacgcgctcgccaagtccatcctcttcttcgagggccagcggtcgggcaggctgccgccgtcgcagcgcatgtcctggcgccgggactcgggcctcaaggacggcgcctccgccacggtggacctcgtgggcgggtaccacgacgccggcgacaacgtcaagttcgggttcccgatggcgttcagcatgacgatgctggcgtggagcgtggtggagttcggcgggctcatgaaggccgagctgcagcacgccagggaggccgtccgctggggcgccgactacctgctcaaggccacggcgcacccggacaccatctacgtccaggttggcgacgccaccaaggaccacgcgtgctgggagcggccggaggacatggacaccccccgcaccgtgtacaaggtggaccccggcacccccggctccgacgtcgccgccgagacggccgccgcgctcgccgccg

SEQ ID NO: 39186 - protein, 189 aa, Panicum virgatum
  misc_feature: Ceres CLONE 1997324
  misc_feature (34)..(189): Pfam Name: Glyco_hydro_9 Pfam Description: Glycosyl hydrolase family 9
  misc_feature: SWISSPROT Homolog: EC 3.2.1.4 Cellulase
  misc_feature: Useful for making plants with altered carbohydrate content
  misc_feature: Useful for biocontainment applications
  misc_feature: Useful for making plants with altered cell wall content and/or composition
  misc_feature: Useful for making plants with modulated nitrogen use efficiency
  misc_feature: Useful for making plants with altered lignin content
MARLRCALVLALLLARLPGDAIAGRGHHGPAAHDYRDALAKSILFFEGQRSGRLPPSQRMSWRRDSGLKDGASATVDLVGGYHDAGDNVKFGFPMAFSMTMLAWSVVEFGGLMKAELQHAREAVRWGADYLLKATAHPDTIYVQVGDATKDHACWERPEDMDTPRTVYKVDPGTPGSDVAAETAAALAA

SEQ ID NO: 39187 - DNA, 687 bp, Panicum virgatum
  misc_feature: Ceres CLONE 1997328
  misc_feature: Encodes the peptide sequence at SEQ ID NO. 39188
cacatcttctccagccaagcagctccagcctgatcagagcctgaccgatctccggcgacactagctagccgtggacatggcgtcgccgatgatcaccctcgccccgcagtcacagtgcaaccagttccgggagtacagccccagcccctggggtgacttcttcctcaaccatgccacatgcactccatcacagctcttgacaatgaaggagagggcacaggtaaaggaggaggaggtgaggaggatcatactggaaagctttgcctcctccgacctggctcagaagctggagctcgttgacactctacaaaggataggggtggactaccactacaagaaggagatcaatgacctactttgttctatctacaatgacgaggatggaggttctgatgacctctatgtcacctcattgaggttctatttgcttaggaagcatggatacaccgtctctgcagacgtgtttgagaagtttagggacaagcaagggaacatttcaagtgacgatgtcagctgcttgctaatgttgtatgatgctgcacatgtgagaactcatggggaggagatactcgacgacatgatcactttcaacaagagccgcctccaatctttgacgatgaaaaatttggagccagagctggcagaggaagtgcgatgcacattggagacaccacggttcaggcgggt

SEQ ID NO: 39188 - protein, 203 aa, Panicum virgatum
  misc_feature: Ceres CLONE 1997328
  misc_feature (25)..(203): Pfam Name: Terpene_synth Pfam Description: Terpene synthase, N-terminal domain
  misc_feature: SWISSPROT Homolog: EC 4.2.3.13 (+)-delta-cadinene synthase
MASPMITLAPQSQCNQFREYSPSPWGDFFLNHATCTPSQLLTMKERAQVKEEEVRRIILESFASSDLAQKLELVDTLQRIGVDYHYKKEINDLLCSIYNDEDGGSDDLYVTSLRFYLLRKHGYTVSADVFEKFRDKQGNISSDDVSCLLMLYDAAHVRTHGEEILDDMITFNKSRLQSLTMKNLEPELAEEVRCTLETPRFRR

SEQ ID NO: 39189 - DNA, 1192 bp, Panicum virgatum
  misc_feature: Ceres CLONE 1997331
  misc_feature: Encodes the peptide sequence at SEQ ID NO. 39190
acaggcacacccaaaccctagctagcaatcccgatcccaccccaacccaatccgccccgcccacaaagtcatgcgagatcacccgacatcctagcccccgaaccctagcagatatcagcagatccagatatgagcaccagcctctcacctctcgactcctcgccggcggctgaggtccccctcgccccgggcttccgcttccaccccaccgacgaggagctcgtctcctactacctccgccgccgcgtcctcggccgccgcctccgcgtcgacgccatcgccgaggtcgacctctaccgcctcgagccctgggacctcccctccctctcccgcatccggagccgcgatgcccagtggtacttcttcgcgcgcctcgaccgcaaggtcgccggcgccggcgccggcggccggggaggcccggggaacaggaacaaccgcgccacgccgcggggatactggaagaccaccggaaaggaccgcgaggtctaccaccgcggcaagcccgtcgggatgaagaagacgctcgtcttccacgccggcagggcgcccaagggggagaggagcaactgggtcatgcacgagtaccgactccttgacgccgacgggccccaggatctgcacgtggtgtgtaggatcttccagaagcatggttctggaccacagaatggagcacagtatggtgcaccatacatggaagaggaatgggaggaagaagatgatgctattgagaatgcacctgctagtggcacatctgctggaatggctacattcacgtgtgctgcggatgaggagtcgaatgaggatgagaatggatattgtaaaaccaatgagcttgctcaggcccatggaatgctcagctctccagagatggcccctctcaaagctcaaggttccaaagacaccagtgaaggaagctgtgctgacggtgttatttctctggaggagattatgcaggaacccttgtctgcagagaacataggtagatctgaagggcagaatgccactgatgataacttcagtgttgacgacttattatctgcatgcccaacgaaagataatgactatgtaggtcaggatggcactctgaattggagttacccagcagatggcgattgcacacattggcctttgagggcatatagtaatcagaattatgccaatggtactcttagtgctgaggagttctttgaca

SEQ ID NO: 39190 - protein, 354 aa, Panicum virgatum
  misc_feature: Ceres CLONE 1997331
  misc_feature (18)..(155): Pfam Name: NAM Pfam Description: No apical meristem (NAM) protein
MSTSLSPLDSSPAAEVPLAPGFRFHPTDEELVSYYLRRRVLGRRLRVDAIAEVDLYRLEPWDLPSLSRIRSRDAQWYFFARLDRKVAGAGAGGRGGPGNRNNRATPRGYWKTTGKDREVYHRGKPVGMKKTLVFHAGRAPKGERSNWVMHEYRLLDADGPQDLHVVCRIFQKHGSGPQNGAQYGAPYMEEEWEEEDDAIENAPASGTSAGMATFTCAADEESNEDENGYCKTNELAQAHGMLSSPEMAPLKAQGSKDTSEGSCADGVISLEEIMQEPLSAENIGRSEGQNATDDNFSVDDLLSACPTKDNDYVGQDGTLNWSYPADGDCTHWPLRAYSNQNYANGTLSAEEFFD

SEQ ID NO: 39191 - DNA, 602 bp, Panicum virgatum
  misc_feature: Ceres CLONE 1997337
  misc_feature: Encodes the peptide sequence at SEQ ID NO. 39192
acgacgcccgcgcccgacccctcgtcttcctcctcttcgccgcgccacgctaactgcatgggcgccggctccggcgcgtccggccgcgtgctcgagtgggaggccggcctccccgacgcctccgagctgacgccggtctcgcacccgctcgtcaccccggcgctcgccgccgcgttccggatcaacatcgcgggcggcgccttcccccccgccgccgcctcccccctcgacgactccgccctcgcgcacgactcccccacctcccacctgtccttccactgccacgaggaggaggaggacgtcgaggaggaggagggggagtgggaggccgaggacgccgcctccgggagcggcgcgtgccggggcgggagggccgggaagaaggcgaggatggtgtggaccccggagctccaccaccggttcgtcgaggcggtggcgcacctcggcgacaagggcgccgtgcccaaggccatcgtgcgcctcatgaacgttgagggcctcacccgcgagaacgtcgccagccacctccagaagtaccgcatctacctcaagcgcacgcgcagcccccccacgcggcagccgccgcctccgtccttcctgac

SEQ ID NO: 39192 - protein, 181 aa, Panicum virgatum
  misc_feature: Ceres CLONE 1997337
  misc_feature (111)..(161): Pfam Name: Myb_DNA-binding Pfam Description: Myb-like DNA-binding domain
  misc_feature: The sequence is a functional homolog of SEQ ID NO 1233 in the 10/666,642 US patent application
  misc_feature: The sequence is a functional homolog of SEQ ID NO 1992 in the 11/479,226 US patent application
  misc_feature: The sequence is a functional homolog of SEQ ID NO 1232 in the 10/666,642 US patent application
  misc_feature: The sequence is a functional homolog of SEQ ID NO 1999 in the 11/479,226 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MGAGSGASGRVLEWEAGLPDASELTPVSHPLVTPALAAAFRINIAGGAFPPAAASPLDDSALAHDSPTSHLSFHCHEEEEDVEEEEGEWEAEDAASGSGACRGGRAGKKARMVWTPELHHRFVEAVAHLGDKGAVPKAIVRLMNVEGLTRENVASHLQKYRIYLKRTRSPPTRQPPPPSFL

SEQ ID NO: 39193 - DNA, 632 bp, Panicum virgatum
  misc_feature: Ceres CLONE 1997356
  misc_feature: Encodes the peptide sequence at SEQ ID NO. 39194
aagatctcatccccctcctctcgcccacctcgatcacccccgcgggtatcggagcatggcgtcagcggcggtggtggacgccggcgacgcgccggagcccacggtgcagaacctcctcgaccaggacaccctcaagtgggtcttcgtcgggggcaagggcggcgtcggcaagaccacctgcagctccatcctctccgtcctcctcgcctccgtccgtcagtccgtgctcgtcatctccaccgaccccgcgcacaacctcagcgacgccttccagcagcgcttcaccaaattccccaccctcgtccgcggattcaccaacctctacgccatggtaagcgccaaaaacatgaggaaattcttccgtcttttccccccgccttacgtttccaatccacactcttctcgcgcggtcatcgtcacttaactcgattccaccctattcggtggtctttgtgaggatgggatgggcaggctgtgtgtcgtggtcattggatggcaaagtagcttcaccgaatttcggggggaggttagtagggttgtatggaagaggagaagaagtatggaggatagaaaagtctgattgagaagagctagacatttacctagaccaggctatacggacaggaaagtta

SEQ ID NO: 39194 - protein, 122 aa, Panicum virgatum
  misc_feature: Ceres CLONE 1997356
  misc_feature: SWISSPROT Homolog: EC 3.6.3.16 Arsenite-transporting ATPase
MASAAVVDAGDAPEPTVQNLLDQDTLKWVFVGGKGGVGKTTCSSILSVLLASVRQSVLVISTDPAHNLSDAFQQRFTKFPTLVRGFTNLYAMVSAKNMRKFFRLFPPPYVSNPHSSRAVIVT

SEQ ID NO: 39195 - DNA, 1244 bp, Panicum virgatum
  misc_feature: Ceres CLONE 1997357
  misc_feature: Encodes the peptide sequence at SEQ ID NO. 39196
ggtcacatcgcttctcttcccctccggaggaccttatcgccgtctcgccctcgctccttcgccgaccccttgcgccatgcattcgccggcgccgcccccgcccaccaacacgccgtcccgggctcccgtcgttccggctgcccgccaccgccgccagcggccgaagccgccttcctccccgtccgttcccgacgctgagcagccgccggacgccctcgcccgcatcctccgcaccgaggccgccgtctcgggcgtctcccgcaaggccgcggccgcgcggcagcagtccacccgcctctggccccgcgccgtcctcgaggccctcgactccgccgtcgccgcctgccgctgggagtccgccctcgaggttccctcccgtttccgttagctttgtttgcccctcttccccagggcgggctggtgtgctggtcccaacgatgcttacggctctcctgcttgcgctagatcttcgagctgctgcggaagcagcactggtacgagccgaggtcgcagacctacgcgcggctgctgatgatgctcggcaagtgccggcagcccggcccagccaccgccctcttcaaggcgatgctctcggagcggctccggccgacggtggacgtgtacacggcgctcgtcggcgcgtacggctacagcggcctgctggaggaggcgctggccaccatcgaccagatgaaaggtgctgctgattgcaagccggatgggtacacgttctctgtcctcatagattgctgcgctaagtcgcgtcgcttcgatctgattcctgctcttcttgatgagatgtcgtacctggggcttgaatgcaattctgttattcacaatgcgataatcaacgggtacggtaaagccggcatgcttgaggagatggagagtgcactttccattatgcttgagagtgggaacaatgtgcctgacatttacacgatgaactctatcatctgggcttatgggaacaatgcaaggacaaatgaaatggagaagtggtacaatgagtttgagttgatgggtattgagccagataccaagacgtttaatatcatgatcaagtcctatggtaaggctggcatgtatgacaagatgatgtcgatattcaaatatatgaagaaacgcttcttctctccgaccacggttaccttcaacatagtaatagaatgttttgggcgtgctggcaacattgaaaagatggagtactacttccggcttatgaaaattcagggtgtgaaacc

SEQ ID NO: 39196 - protein, 237 aa, Panicum virgatum
  misc_feature: Ceres CLONE 1997357
  misc_feature (171)..(205): Pfam Name: PPR Pfam Description: PPR repeat
  misc_feature (100)..(134): Pfam Name: PPR Pfam Description: PPR repeat
  misc_feature (136)..(170): Pfam Name: PPR Pfam Description: PPR repeat
  misc_feature (65)..(99): Pfam Name: PPR Pfam Description: PPR repeat
MMLGKCRQPGPATALFKAMLSERLRPTVDVYTALVGAYGYSGLLEEALATIDQMKGAADCKPDGYTFSVLIDCCAKSRRFDLIPALLDEMSYLGLECNSVIHNAIINGYGKAGMLEEMESALSIMLESGNNVPDIYTMNSIIWAYGNNARTNEMEKWYNEFELMGIEPDTKTFNIMIKSYGKAGMYDKMMSIFKYMKKRFFSPTTVTFNIVIECFGRAGNIEKMEYYFRLMKIQGVK

SEQ ID NO: 39197 - DNA, 591 bp, Panicum virgatum
  misc_feature: Ceres CLONE 1997357-R
ggggctcgctttcagtactcgaacatgatggtcgcgcgcacacaagcagattgcagatctgccaccgcgctgatctggggatgagttcacacttgccgcggcagcgagcttcatgacgaagaagcacgtgctcttacttcatgccgggggtgacagcaagagccaagagggttccctgggcgaaccccatggggaaggctttcctgcccctgccttacctggccggggacaatcctgatggacccgttacacttctttcgatcacattctcgcgatttcatcaagcgcaaggtgggatcttcataatgacaggggatgttctcccctgctttggtgcctcaaacctagttcttcctgaagatgctgcttgcattgtgacggtgcccaccactctggatgttgccgctaatcatggagtggttgtagcgtcaaaggatggcgggattgatcgggagaactattctctctgtctggttgataatctcatgcagaagccaacagtgagcgagcttgtagagggccatgccatcctggatgatgggagagcattacttgacacaggaataatagcagcaaggggtaaagcatggc

SEQ ID NO: 39198 - DNA, 702 bp, Panicum virgatum
  misc_feature: Ceres CLONE 1997361
  misc_feature: Encodes the peptide sequence at SEQ ID NO. 39199
gttctgacttctctgtttctctcgatcccctcccccatcctgccagcctccccgccggccaccgctctccgccgccgccgccgccgccgccgccgcccttggcctccagctagttaggcgatatccgtcctcctaccaggttcagttcctctggcgaaacaagccgtgcagacgggagcaagagcgaggagacgagaggagggatgcagcagctgcagccgaagcagatgcactgggtgagggccgactcctccgacttcgggggcgaccgcccctccccccgcagcgggcacacggcggtgagcattggcaagtccaaggtgatcttcttcggcggattcgccgacaagcgcttcctctctgacgtctccgtctacgacgtcgagaataagctatggtactcgcctgagtgtaccgttaatggatcggatgggcaggcaggcccgagcccaagggcgtttcacgtagctgtcgtgattgactgcaacatgttcatatttggtggccgttctgggggcaagcggttaggtgatttttggatgctagacaccgacctatggcagtggtcggagatgactggctttggtgatttgccgtcacctcgggagtttgctgctgcttcagccataggaaatagaaaaattgttatgtatggtggttgggatggcaaaaaatggcttttagatgtatacatcatggaca

SEQ ID NO: 39199 - protein, 166 aa, Panicum virgatum
  misc_feature: Ceres CLONE 1997361
  misc_feature (83)..(128): Pfam Name: Kelch_1 Pfam Description: Kelch motif
  misc_feature: SWISSPROT Homolog: EC 3.1.3.16 Phosphoprotein phosphatase
MQQLQPKQMHWVRADSSDFGGDRPSPRSGHTAVSIGKSKVIFFGGFADKRFLSDVSVYDVENKLWYSPECTVNGSDGQAGPSPRAFHVAVVIDCNMFIFGGRSGGKRLGDFWMLDTDLWQWSEMTGFGDLPSPREFAAASAIGNRKIVMYGGWDGKKWLLDVYIMD

SEQ ID NO: 39200 - DNA, 1162 bp, Panicum virgatum
  misc_feature: Ceres CLONE 1997367
  misc_feature: Encodes the peptide sequence at SEQ ID NO. 39201
actggcgaaatatttctagtcgccccctccttcaaccttcagatctggccactcccgcacgcccagtctcctaaaccctactcatctctcttgccatcgccatggccgggaggcgccctgccccggcggccctcatcgtcctcctcctcgccgcggccttcgctcccatctcctccgccgtccgcccagtctccgacgcgcacagatccgcggccgccgagctcttcgccccctccgccgacggatccttcggcgatttggagaggacgtatgaggcggtgaggacgttccagatactcgggttggagaagtacaagagtgtgactgggaaggcgtgcaagtttgccgcggataagttggccgcccccgcttcgtccgctacgaaagatctgttccacgcggcccggatcagcggcgttctcggatgcagtgttgatgccggcgtgtatgatggtgttgtcgcgaggctcaaggcagtgattaaggacaccaactccctgctggagttctactattccgtgggaggtctgcttagcatcaaggaacaaggacacaacgttgttctatctgatgcagagagcacatttcatgccattaaggcacttagccaaagcgatgggagatggcgttatgacactaacagtgctgaatctagcacatttgctgctggtatcgcactagaagctttggcaggtgttgttgctctagcagatgctgaagttgatccatccatggtaggagtggtaaaaaatgacattgtgaagctgtttgacactatcaagagttatgatgatggaaccttctactttgacgagaagcatattgatgctactgaatacaagggccctataatgacatctgcttcagtagtacggggtgttacctcttttgcaactgttgctactgggaaattgaatatccctggtgagaaagtacttggcttgggaaagttctttcttggtatagggctccctggtagcgcaaaggactgttttaatcagatcgagtctttgtcattcctggagaacaatagggtcttcattcctttgatactgtcacttccttccaaagtatttttcattgacttcaaaagaccagcttaaggttgaagtcacaacagtttttggatctgctgcccctccgctcaaagtgaatcttgtac

SEQ ID NO: 39201 - protein, 333 aa, Panicum virgatum
  misc_feature: Ceres CLONE 1997367
  misc_feature (6)..(333): Pfam Name: Ribophorin_II Pfam Description: Ribophorin II (RPN2)
MAGRRPAPAALIVLLLAAAFAPISSAVRPVSDAHRSAAAELFAPSADGSFGDLERTYEAVRTFQILGLEKYKSVTGKACKFAADKLAAPASSATKDLFHAARISGVLGCSVDAGVYDGVVARLKAVIKDTNSLLEFYYSVGGLLSIKEQGHNVVLSDAESTFHAIKALSQSDGRWRYDTNSAESSTFAAGIALEALAGVVALADAEVDPSMVGVVKNDIVKLFDTIKSYDDGTFYFDEKHIDATEYKGPIMTSASVVRGVTSFATVATGKLNIPGEKVLGLGKFFLGIGLPGSAKDCFNQIESLSFLENNRVFIPLILSLPSKVFFIDFKRPA

SEQ ID NO: 39202 - DNA, 1271 bp, Panicum virgatum
  misc_feature: Ceres CLONE 1997371
  misc_feature: Encodes the peptide sequence at SEQ ID NO. 39203
gccgctgcagcactaatcgtcgccccattttcaagaggcaagagcatcctgtatgtgaaaacaaacgccaaccattttcttcttcttcttcctcctctctcaagtggctggcctacttcctcttcctagcaagtactagtagtgtgctacaagttgcaagcaaagagagatatttaggaaagcatcggatcacatcctctcatccattatattcatattccggcatccatcgatcatcgatcctttgtccgttttccaccactgttagttggtcatcagtgactgacgacgcgaccggaagggtgccggcccaaccatcccagcccaaggttgcttgctcgatccgtcccttgcaaagccggccggccatggagaaggagatcaatccgccgccgcagggggccgagcctcaggtgacggacaccacttcatcaccaacagaagagaaccctggaccgtccgaccaacgacggccgcggccgcatctctgcatcgacatcccggcgtcaagcctgcccggcgatcacctcccgacgccgacggaagccgacatcaccccaaccccgacgggttcttccaccaccaccaacaccagaaggagcagcatccccatcacgcccagcaacagcaggaacggtaagccgcccctgcgctcgccgtccttgatgctgaggcagacggtcaagagcctcctgcccctggggagcttcaagtcgtcggtcaagttcttcaactccaaggtcatggccaggacgtcctcgcttcccctggacgacgttgcaggacaccatcaagccgttgacaaatcttcaacaagttcttgtaccgccaccgagcctgtacttcacatctgccgctcgcagtccctccccatgaacatgaagaaattcaacgccaagagcttcaagaggatggactcgctaggcggcatgtaccgtgtagttccatcgacgccgagagctccagctgcaagcaatgtcgttcctgacatagtcccttcttcagagtcaggggtcgccggcgaagacgacggcgaggacattccggaggaggaagccgtgtgccggatctgcatcgtcgagctgtccgaaggcagtgacaccctcaagctggagtgctcctgcaagggtgagcttgctctggcacacaaggactgtgccatgaagtggttcaccatcaagggcaccaggacctgcgaggtgtgcaagcaggatgtgcagaacctcccggtgactctgctacgtgttcagagcctgcagcgcgagccgaat

SEQ ID NO: 39203 - protein, 300 aa, Panicum virgatum
  misc_feature: Ceres CLONE 1997371
  misc_feature (232)..(279): Pfam Name: zf-C3HC4 Pfam Description: Zinc finger, C3HC4 type (RING finger)
MEKEINPPPQGAEPQVTDTTSSPTEENPGPSDQRRPRPHLCIDIPASSLPGDHLPTPTEADITPTPTGSSTTTNTRRSSIPITPSNSRNGKPPLRSPSLMLRQTVKSLLPLGSFKSSVKFFNSKVMARTSSLPLDDVAGHHQAVDKSSTSSCTATEPVLHICRSQSLPMNMKKFNAKSFKRMDSLGGMYRVVPSTPRAPAASNVVPDIVPSSESGVAGEDDGEDIPEEEAVCRICIVELSEGSDTLKLECSCKGELALAHKDCAMKWFTIKGTRTCEVCKQDVQNLPVTLLRVQSLQREP

SEQ ID NO: 39204 - DNA, 555 bp, Panicum virgatum
  misc_feature: Ceres CLONE 1997371-R
gagggtgcggcggatggcgcctcctgctcctgccatggccagccgtgatcgccgagcacgcgcagctcagcagcaggctccggcgtctgatcaaccttccggccagtcttcagttgccggcggcggacagcacgacaccgtcgctgctagcgatgttgagaaccccgccctccctcaggcatagaacatgtatattgtataactgtataagcagttcttttctagatagtatatacagagtatatgtgtagcagttgtagtatacctgctgagaggttgggggccttatttcactgtataaatggtagaacagaccaagtctgaattttgttttttaagggagaagagatcacaatctcaatccaagttccatttttttcttcttcttttgcagcatgtaatgtaataagtagcgtagcagcactgaaaagaatctgtgctgatgtccttctctatcagcatgtacagatgcatgcatactaccttgtgaaaggaatcagtatgcagtactgcagtttatggtatgtaaggtcgttagacgtttcagtgcgtacc

SEQ ID NO: 39205 - DNA, 1079 bp, Panicum virgatum
  misc_feature: Ceres CLONE 1997373
  misc_feature: Encodes the peptide sequence at SEQ ID NO. 39206
cccgccaccacacctccttccgctcgcccgccgcggccatggcggccaccgccgcggccgccgtctccttctccctcccctccgccccgcgcggcctcgggcctcgccggcgccggcgccgcgcgccttccctcctccgcgcggcctctaccgccgcgccgccgtccccggacctctccattcagctctcgccgcgcgcgtcccctcccgcgccggccaacggcgcctcgacagcggccgggccccccgtggccgcctccttcgcccgcgaccgcgccgaggacctgcaggccgaggcccgggccatggcccgcgccgccggggccaccgtctacagccccgagctcctcgccgcccgctacgggtcccgtcccttcaaggtggcgctgagggcggcggaggtgctgtccaagctgggggccttcggggtcaaggtgctgctggacgagcggagcggggactcgtcctcggcgaagcgccgagccagggcggtggagctgcggactatcctcaccaggctcggcccgacgttcgtgaagatcgggcaggggctgtccacgcgccccgacctctgcccggcagagtacctcgaggagcttgccgagttgcagrattcacttcccacatttccggatgaagaggcatttgcgtgtattgagagagagcttggcttcccacttgattcgatttactcgacaatatcaccttcccccattgcagctgctagtttaggtcaagtttacaaggcacggttgaaatattctgggaagctggtagctgtcaaggtgcaaagacctggtattgaggatgccatagggcttgatttttatctactcaggggccttggctttttaataaataaatatgttgacattgtaaccagtgatgttgttgccctcatggatgaatttgctcgaagagttttccaagagctcaactatgtccaggaaggccaaaatgcaagaaggtttaagaagttatatgctgataagcaagatgtattggtgcctgacatattttgggattacacaagtgcaaaggttctgactatggagtggattgagggtgtgaaattaaac

SEQ ID NO: 39206 - protein, 346 aa, Panicum virgatum
  misc_feature: Ceres CLONE 1997373
  misc_feature (208)..(327): Pfam Name: ABC1 Pfam Description: ABC1 family
  misc_feature (192)..(192): Xaa is any aa, unknown, or other
MAATAAAAVSFSLPSAPRGLGPRRRRRRAPSLLRAASTAAPPSPDLSIQLSPRASPPAPANGASTAAGPPVAASFARDRAEDLQAEARAMARAAGATVYSPELLAARYGSRPFKVALRAAEVLSKLGAFGVKVLLDERSGDSSSAKRRARAVELRTILTRLGPTFVKIGQGLSTRPDLCPAEYLEELAELQXSLPTFPDEEAFACIERELGFPLDSIYSTISPSPIAAASLGQVYKARLKYSGKLVAVKVQRPGIEDAIGLDFYLLRGLGFLINKYVDIVTSDVVALMDEFARRVFQELNYVQEGQNARRFKKLYADKQDVLVPDIFWDYTSAKVLTMEWIEGVKL

SEQ ID NO: 39207 - DNA, 1258 bp, Panicum virgatum
  misc_feature: Ceres CLONE 1997382
  misc_feature: Encodes the peptide sequence at SEQ ID NO. 39208
gtgtcaacatggccgcgtcgcggagtcatcggtcgtcaggacatcatgcgacggcgacttgtagcgccgggcagtgacacctgccgctactgacatacggatacagttcgccggtttgttcggcgtgattaaccggtgtgaatttttcgcatgggatttcgcttttgacatgtgatttttgaaagtttaaaccttgcctcttcagtcttcagctcgttgcgagaccaaactctgttaaatctctgtgtactgaatttctacatttgctcaacggcttgtgttagatttgacttcttttggagcgcgggagttttagaaatgaaaacttatggagatgtctaattttttatgaaatttgcctaggagtacattcttgtcgttaatggttgatgtgcagttgtgcacaatacgctgagtagctgacaaacgtgcctgcagcgccgcaatccttcatcggcatcaactacggcgacgtggcggacaacctcccgccgccgtcgtccaccgcgcgcctcatccagtccacgaccatctccaaggtccgcctctacggcaccgacccggccgtcgtctccgccttcgccggcacggggatctccctcctcctcggcgccgccaacggcgacatcgccaacctcgcgtcctcccccgccgcggcagccgcttgggtcgccgcgcacatcccggcctcgtcgccggcggtctccaccgtctccgtcggcaacgaggtcctcttcgccgacgcatcgctcgcctcgcagctcgtcccggccatgcagaacctgtacagcgcgctgccgcccaactccagcatcaaggtctccaccgtgcacgccatggacgtgctcgcgagctccgacccgccgtcctccggcgcgttcaagccggagctcgacgcggcgctcgactcggtccttgcgttcctgagcaagaccggctcgccgttcctcatcaacccgtacccctacttcgcctacctcagcgacccgcggccggagacgctggccttctgcctgttccagcccaacgccgggcggccggacgccgggtccgggctcacgtacaccaacatgctcgacgcgatgctagacgccgtgcgcgcggcgctggacgccaagggctacaaggacgtggagatcgtcgtcgccgagaccgggtggccgcacaagggcgaccccgacgaggccggcgccacgccggagaacgcgcgcgcgttcgtgtcgggcctcgtgtcccacctgcggtcgctgggcgggac

SEQ ID NO: 39208 - protein, 161 aa, Panicum virgatum
  misc_feature: Ceres CLONE 1997382
  misc_feature (1)..(161): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
MQNLYSALPPNSSIKVSTVHAMDVLASSDPPSSGAFKPELDAALDSVLAFLSKTGSPFLINPYPYFAYLSDPRPETLAFCLFQPNAGRPDAGSGLTYTNMLDAMLDAVRAALDAKGYKDVEIVVAETGWPHKGDPDEAGATPENARAFVSGLVSHLRSLGG

SEQ ID NO: 39209 - DNA, 473 bp, Panicum virgatum
  misc_feature: Ceres CLONE 1997382-R
  misc_feature: Encodes the peptide sequence at SEQ ID NO. 39210
cgctacttcgggctgttccagaccagcctcaccgagacgtacccgacagggctggtccggaacggcacggccgggctggggccggccgtggcgccggcgcaagcaccaacgtcgtcggtgcagccggcgccggcgctgccaaagccagggcagcagccacaggtgactccagcgcagcaaggctcggcagcggtggcgggggcgggggcttccagcccctgcgcgccggggactgcgacggcgaggggagctgccgtcgcttgcccccgtcatagttccgcccaatcgtctcgcactttctcagtgctaactatcattgctggccttttgtgcccagctttgcagatgttaatatgacctttctctttagaagcttttcccagccaatgtattatgtaatatggaggcaacttttgtatttcagtgtgtggctccttcacaatccaagcaacacgtcaagatttcaattttcc

SEQ ID NO: 39210 - protein, 118 aa, Panicum virgatum
  misc_feature: Ceres CLONE 1997382-R
  misc_feature: SWISSPROT Homolog: EC 3.2.1.39 Glucan endo-1,3-beta-D-glucosidase
RYFGLFQTSLTETYPTGLVRNGTAGLGPAVAPAQAPTSSVQPAPALPKPGQQPQVTPAQQGSAAVAGAGASSPCAPGTATARGAAVACPRHSSAQSSRTFSVLTIIAGLLCPALQMLI

SEQ ID NO: 39211 - DNA, 1292 bp, Panicum virgatum
  misc_feature: Ceres CLONE 1997408
  misc_feature: Encodes the peptide sequence at SEQ ID NO. 39212
cccccgtctctctatttctcccctctctctctctctctctctctctctctctctcgcagtcgctgccgcatctctgctctcccaatcgccgctcccctccttccctctcagcgcagcaggtgcggggggcagggacggacggacgggggccgccgcagctccgcgccggcgcggaggctgggggcgcggccgctcaactccggcgcgggggtcagggcgggcccccattggcgcggggcgccgccgctcccggaggccgggcctccgccgcggctccccctcggcggcgctcgatctgctaggtttcggtggagggatcgggcctgagaggagggtgattgccatctccagctcatttacagtaattcgggcctactcccatgtccaaatcgggtatgggtcacggatgcagcaactgtcggaaggggcgcagcctgcagatctgaaagccacctggtttcctttgctcagttgacctgagtgaatggcattgcttgccgctgtttgactgtcattacttcctgtttgatgtctgttcaagaaatctagcatgaggtgatgtgctcagaggacttttagttcttgctgctgttctgtgttgaataacccggaagctcgaagggaagtggatcacattcccactctgttgttgttaacttcttggtctggcttggataacctcaacctggaggctggaggagatcaaatccagttcctgccctggtaacaaggtgctcctaggggagggcatcatgacctatttccctgaggaggtggtggagcacatattcagcttcttgctgtcgcacagtgacaggaacacggtctcactcgtgtgcaaggtttggtatgaggttgagaggctgagccggcgagctgtgtttgtggggaactgttacgcagtgcgccctgagcgcgtagtgctgcggtttcccaatgtaagggcactgacggtgaaggggaagccgcactttgcagacttcaaccttgtgccacctgattggggtggctatgcggggccatggattgaggcagcggcaaggagctgtgtggggcttgaggagctacggatgaagcggatggttgtgtcggatgagaaccttgagctgctagctcggtcattcccaagattcaaggccctcgcccttatcagctgcgaggggttcagcaccgatgggctagctgctattgcgagtcactgcaagctcctgagggagttagatttgcaggaaaatgacgttgaggaccatgggcccagatggctctcctgctttcctgattcctgcacttcg

SEQ ID NO: 39212 - protein, 179 aa, Panicum virgatum
  misc_feature: Ceres CLONE 1997408
  misc_feature: Useful for making plants with altered carbohydrate content
MTYFPEEVVEHIFSFLLSHSDRNTVSLVCKVWYEVERLSRRAVFVGNCYAVRPERVVLRFPNVRALTVKGKPHFADFNLVPPDWGGYAGPWIEAAARSCVGLEELRMKRMVVSDENLELLARSFPRFKALALISCEGFSTDGLAAIASHCKLLRELDLQENDVEDHGPRWLSCFPDSCT

SEQ ID NO: 39213 - DNA, 581 bp, Panicum virgatum
  misc_feature: Ceres CLONE 1997408-R
caatgtggagatcatgaatgaactagatggaagcagtgagatggaggaaaaccatggtgacgacctctctagagtggataagttatatgtttaccgcacaactgctggagcaagggatgatgcaccaaattttgttaaaatcctatagagctagctgcgagtagcctggtatcttctcaccctaaaagatggtcggtggaatccggcatgcccggggccgcggcagcagtggtaagttcctgaaccaaatccccacctttgcagggtcaggaaaagccacactggtgtgcgcccttttcttggagcaccatggccgggatccatcatcatcatcctctgtaccaccgcccctgctcaactttcagtgcccggtcggatggccactgaggcccttcatcacataaatcctgtgcattggagaggaccggacctgaccaactttttttgttcacctttcgcaccccctgtaatctgtagtgtaccatttgcttctgacattggcacagtggattgtgttggcagccctgctgtagcgttctgtttgctccagtgaatgcagtgcgtggaataatttgcggttt

SEQ ID NO: 39214 - DNA, 690 bp, Panicum virgatum
  misc_feature: Ceres CLONE 1997412
  misc_feature: Encodes the peptide sequence at SEQ ID NO. 39215
gatgccttcgcggccccattcccctgccactactactagttgccttgctcgcctcccacccctcctctcgccccagccctcgcttccgcctcccctccctccccctcctcttcccttcccttcccttccccactcccacttcccaaccctggatccaaataccaagctatcccagaaccgaaaccgaggcgcgcaagcaattattagctggctagctaggagtgtagctccgagatcatgaagcgcgattaccaagacgccggcgggagcggcggcgacatgggctcctccaaggacaacatgatggcggcggcggcgggggagcaggatgaggaggtggacgagctgctggccgcgctcgggtacaaggtgcgctcgtcggacatggcggacgtcgcgcagaagctggagcagctcgagatggccatggggatgggcggcgtgggcggcgccggcgccgccgccgatgacgggttcgtctcgcacctcgccacggacacagtgcactacaacccctccgacctgtcgtcctgggtcgagaacatgctgtccgagctcaacgcgcccccgccgccgctcccgccagcgccgccggctccgcggctcgcgtccacctcgtccaccgtcacgggtggcgccaccgccggtggagggtactttgatctcccgcccgccgtcgactcgtccagc

SEQ ID NO: 39215 - protein, 150 aa, Panicum virgatum
  misc_feature: Ceres CLONE 1997412
  misc_feature: The sequence is a functional homolog of SEQ ID NO 1 in US patent 7268272
  misc_feature: The sequence is a functional homolog of SEQ ID NO 68 in the 10/666,642 US patent application
MKRDYQDAGGSGGDMGSSKDNMMAAAAGEQDEEVDELLAALGYKVRSSDMADVAQKLEQLEMAMGMGGVGGAGAAADDGFVSHLATDTVHYNPSDLSSWVENMLSELNAPPPPLPPAPPAPRLASTSSTVTGGATAGGGYFDLPPAVDSS

SEQ ID NO: 39216 - DNA, 677 bp, Panicum virgatum
  misc_feature: Ceres CLONE 1997433
  misc_feature: Encodes the peptide sequence at SEQ ID NO. 39217
actgagcgggctcccaagcttcccaaaccatggcggcggcgaacctgctctcgcgctccctcctccccgccctaaaccctagcccgtccggccaccggaaccgcggcagcgccgcggccgccgtctccttcccccgcccccgccgccacggccgcctgtcctcggtgcgcgcctccgtctccacggcctccccgtccccgccgccgcagccagcggcggcggcgccgaagcactgcttcagccgcggcgccgacgggtacctgtactgcgagggggtgcgggtggaggacgcgatggcggcagcggcgcggagccccttctacctctacagcaagccgcaggtcctccgcaacttcgccgcctaccgcgaggcgctccaggggctccgctccgtcgtggggtacgccgtgaaggccaacaacaacctccccgtgctgcgcctcctgcgcgagctcggctgcggcgccgtgctcgtcagtggcaacgagctccgcctcgcgctccaagcgggattcgagcccaccaggtgtatatttaacggaaatgggaagacattggaagatctcaagttagctgctgagagcggggtatttgtaaatgtggacagcgaatttgatttggagaatattgtcagagctgcaagggctacaggaaagagagtgcctgttttgcttaaa

SEQ ID NO: 39217 - protein, 215 aa, Panicum virgatum
  misc_feature: Ceres CLONE 1997433
  misc_feature: SWISSPROT Homolog: EC 4.1.1.20 Diaminopimelate decarboxylase
  misc_feature: Useful for making plants with modulated biomass
MAAANLLSRSLLPALNPSPSGHRNRGSAAAAVSFPRPRRHGRLSSVRASVSTASPSPPPQPAAAAPKHCFSRGADGYLYCEGVRVEDAMAAAARSPFYLYSKPQVLRNFAAYREALQGLRSVVGYAVKANNNLPVLRLLRELGCGAVLVSGNELRLALQAGFEPTRCIFNGNGKTLEDLKLAAESGVFVNVDSEFDLENIVRAARATGKRVPVLL

SEQ ID NO: 39218 - DNA, 619 bp, Panicum virgatum
  misc_feature: Ceres CLONE 1997439
  misc_feature: Encodes the peptide sequence at SEQ ID NO. 39219
ccccgagttccgaccacctcgctccgcggccgcggccgcgccccaaaccccgcaaaaccctaaccggccagccccacgccggccaccgccgccaccgccatgccgaccgctccccaccgcctcgccgccttcctcccgctcctgctcctcctggcctccgcgccccgccccgcggcccccgcctccaccgaccgcgcggcgctcctcgccttccgcgccgccctcgcgccgccctcccgcgccgcgctcgcctcctggcgcggcccgctctcgccgtcctggcgcggcgtctcgctccacccggacgccgcgcccgcgcccgggcccgccgccgccccctccgtcgccgagctcgtgctccgggggctcaacctcaccggcgcgctcccggcgggggcgctcgcgctcctccgccgcctccgcgcgctcgacctctccgccaacgcgctctcgggggaactcccctgctccctcccgcgctcgctcgtctcgctcgacctctctcgcaacgcgctcacgggggccgtcccgacctgcctgccgtcctcgctccccgcgctgcgcgccctcaacctctccgccaacttcctccgcctcccgctctccccgcgggctctcc

SEQ ID NO: 39219 - protein, 173 aa, Panicum virgatum
  misc_feature: Ceres CLONE 1997439
  misc_feature: SWISSPROT Homolog: EC 2.7.11.1 Non-specific serine/threonine protein kinase
  misc_feature: Useful for making plants with modulated yield
MPTAPHRLAAFLPLLLLLASAPRPAAPASTDRAALLAFRAALAPPSRAALASWRGPLSPSWRGVSLHPDAAPAPGPAAAPSVAELVLRGLNLTGALPAGALALLRRLRALDLSANALSGELPCSLPRSLVSLDLSRNALTGAVPTCLPSSLPALRALNLSANFLRLPLSPRAL

SEQ ID NO: 39220 - DNA, 1175 bp, Panicum virgatum
  misc_feature: Ceres CLONE 1997442
  misc_feature: Encodes the peptide sequence at SEQ ID NO. 39221
gcggcggcgaggagggctccacgacggagaccagtgcgtgtgggtgggcgggcgggctcatcttttatcgtgcgcccgcactgagcggatcgctgctcccaaatcgcagaccccagggcgcgcgttgcttccccggcgcagcgcaggatgtcggactcgcaggccgtcgccggcggcgagtcgcccgccgagctgctgctccgcgcggcggcgatggtgcccgcggagcgctacgcgctcgccgccgtcgccgtcgtgtcggtcttcctgtaccgcctcctcgagctccacgtcatcggcgacgccctccgcggctttcggggcggccgcgtcgagctcaccttccacccggcctcggagatctaccaccgcgtcgcgtccaagtgccgctccctccacggcaggtacctggcgacaccatggctggcaagcccgcatctgcagacattgttcctcggcatctctgggaggcctccatcattcacgtacaagagacaactgtacacagtccgggatggtggaaccattgctctggattggcttcttgcctctgatctggaagatgcagacggttttatttctaaagatgattcaacacctcttgtagttgtggttcccggattaactagtgattctgctgctgcttatgtaaaacacttggtttattctatagcaagcaaaggatggaatgttgtcgtaagcaaccacagaggtcttggtggtgtgtccattacttcagattgtttctacaatggcggttggactgaagatgtccgagaggtcattaattacctccatcacagatacccacagaccccactgttctgcattggtacaagcataggtgccaatattgtggtcaagtatcttggagaagaaggcgaaaatactcccgtggctggagcagcgtctatttgttctccatgggatctgttgattggtgacagatttatttcccgcaagtttgtgcaacgtatttatgacaaagcacttgcaattggtctgaagggctatgcaaagctacatcaacctatcttggcccgacttgcaaattgggaaggtattaaaaagtcacgatctatccgggaattcgaccaccatgctacctgtgttgttgcaagatatgagacggtggatacctactaccgccggtgcagcagtgctagttatgttgg

SEQ ID NO: 39221 - protein, 342 aa, Panicum virgatum
  misc_feature: Ceres CLONE 1997442
  misc_feature: SWISSPROT Homolog: EC 2.3.1.84 Alcohol O-acetyltransferase
MSDSQAVAGGESPAELLLRAAAMVPAERYALAAVAVVSVFLYRLLELHVIGDALRGFRGGRVELTFHPASEIYHRVASKCRSLHGRYLATPWLASPHLQTLFLGISGRPPSFTYKRQLYTVRDGGTIALDWLLASDLEDADGFISKDDSTPLVVVVPGLTSDSAAAYVKHLVYSIASKGWNVVVSNHRGLGGVSITSDCFYNGGWTEDVREVINYLHHRYPQTPLFCIGTSIGANIVVKYLGEEGENTPVAGAASICSPWDLLIGDRFISRKFVQRIYDKALAIGLKGYAKLHQPILARLANWEGIKKSRSIREFDHHATCVVARYETVDTYYRRCSSASYV

SEQ ID NO: 39222 - DNA, 542 bp, Panicum virgatum
  misc_feature: Ceres CLONE 1997442-R
gggctcaccttctgaccatgaggttggagtacagttaagtaacggggtggatggcagacaacagttagaagtatctggcgagaaacagaatgaacacgtcagtggatcagggaacgaaagccctgctggttcagcaaatcggcaaggagatgacatctacagtaataagcttcatgagataattgctcccgtcaagagatccataaaccaactgacacggcaccaagggaggtcaatctggttgcttgcctacattgcttttgtaacatcatggccgctcctcggctccctagcttttatcacctttcggaagaagttcagaaatccattgcgagctaaatgactaacaggataaacaaaccctacttgtattgatttcgactgcgtcattcaaaacattagaaacctgaaggcctgtacatccatttgatttgttcagttacgcctatatgtccaggatataagctgtcctgctcatggtacatgtacacatccaaataatttcacttgcgtcacgaagaaaagcttgtattcatctgctc

SEQ ID NO: 39223 - DNA, 539 bp, Panicum virgatum
  misc_feature: Ceres CLONE 1997450-R
  misc_feature: Encodes the peptide sequence at SEQ ID NO. 39224
acgaatcgccaatatggttataactgccaagagattgatggcatcatctctacaaggctagctactgagaacgacgctagcaggcgattgaaatctgaattccttattcaatttgatgggctgtcatcgaaccaagatgaattagtaattgttatagagcaaagtatacttcttaccattcagatcaaggagcaatgtgctttcactatttgttgccacaaaacagaagcagaaccatgtcacatcctagaatattaacagaattaactccaccataggaaacaatacaatgttttccttcttaaaaggttggatataagatgtaaaattcgccagtgcctagagcactgagtcaaattggaaaaaggttaggaacgggacaaccattcatcattccagggaatttaccttcagcactgcctattctggagatataataagcagtagcgtttttgtacaaatatttgtactattatatatgcctaataatatatggacatacaacgctaatgctatgttcatatgtattaatgatgttc

SEQ ID NO: 39224 - protein, 85 aa, Panicum virgatum
  misc_feature: Ceres CLONE 1997450-R
  misc_feature: SWISSPROT Homolog: EC 3.6.4.3 Microtubule-severing ATPase
TNRQYGYNCQEIDGIISTRLATENDASRRLKSEFLIQFDGLSSNQDELVIVIEQSILLTIQIKEQCAFTICCHKTEAEPCHILEY

SEQ ID NO: 39225 - DNA, 1390 bp, Panicum virgatum
  misc_feature: Ceres CLONE 1997450
cccagtttaccatatttggtcctattgcttatggatctacagagacatatgtgtgctcatctatttgttctgctaacaacgatttttcgtttgattttctgctgtccaggttgccatacttgccacgcctgtttatagagctgcctacataacaacggccgctgctataagcagattagccattaacttcaattccattcttaaaaaaaaatggaaacaatgctatgcttgcaagcgtatgatgctttttttagccttgtctgtacacattgcaaattgttgatcgggtactacttgctatccttgtattatttgcttcacagtgggagattgcctactccactgagtatcacactcgagttgttcagctcttctggatcgatcttatcattcctggtaatacactaccgcacttcttcctactttctgtcatttcctattgtgttcttcgtttccgtagtgccaaattggtgcgctaattttcatgccatcttgccgagtattttcggtaggctgtgtttactttattttttaagtaaagataaagcagacatatagctatatatgtaaccatatctcaagcatgagtgtctatatatatgtttagtgaattggcaataacaattggcacattgtctcatacttatatactgaaagctattttcttagttgcgagaaccaacatcacacgtataatacttaactctttcctgtgccctttaaattgcaacttctgtaccaactcaggattagattccattttttcttcccctttgctcagaacgtacccatgaacccatgacttgcagtggtggtaagccaccttctattagattaattaacttgcctctctaacctttccattttgatgtattttttattcacttttcctcatcttttattttccttgcctttttttatactgttttgtacagtagtccccaagaagcagagctggaacacgtgccatccttacaaatacatcatgttcataaacaggcctctaattgcactactccatgctgcggcttctgtatactgtttacaacggcaatacgcatttgttatcacaaagattggaagacgactccacagtcctatgtggtgccgaattggagttggagctcctcacgccgcgccatgaacttttttttctaggagcctgcatatttatatcttactacagcatatgaaaaagcatgcctcaaagtacttttgttcctccagattgtttaccatcttaaaattacctacaattattacaatggagaaattattttatagagagataacaactgaacatgtcccagtattccgatcaaaatggcttccactaaaaggtaatccacttttcccatgctaccttccaccccacagcttggggaacttc

SEQ ID NO: 39226 - DNA, 666 bp, Panicum virgatum
  misc_feature: Ceres CLONE 1997455
  misc_feature: Encodes the peptide sequence at SEQ ID NO. 39227
cttctcccattcttcttctcttccctctcttcacggctccgcccgcccaggcccttcacgcgcctcgcctcccgcaccgtgctgtaactccactccactcagatccaaccaaccctccgcccccaccgccaacaccagcaccatgccgccgctccgcgtggcggcggcggcgctcgccctcctgctctcctgctgctgcctcacgtcggccgagcccgacgccgacaaggcggcgctgctcgccttcctcgcgggggtgggccgcggcgccgccgcccgcgcgcgcatcaactggcccgccaccccgcgcgcctgcgccgcccgcgggagcggctggaccggggtcacctgcagcgccgacggcgcccgcgtcgtcgcgctgcacctcccgggcctcggcctctcgggccccgtcccgcccggcacgctcgcccgcctcgacgcgctgcagctgctcagcctccgcgccaacagcctctccggccccttccccgccgacctcctcgccctccccgcgctcgccggcctccacctccagcgcaacgccttctccggccccgtccccgcggggctcgccggcctccgcgccctccaggtgctcgacctctcctacaaccgcttcgacggcgccatccccgccgcgctctccaacctcacccacctcgt

SEQ ID NO: 39227 - protein, 174 aa, Panicum virgatum
  misc_feature: Ceres CLONE 1997455
  misc_feature: SWISSPROT Homolog: EC 2.7.11.1 Non-specific serine/threonine protein kinase
MPPLRVAAAALALLLSCCCLTSAEPDADKAALLAFLAGVGRGAAARARINWPATPRACAARGSGWTGVTCSADGARVVALHLPGLGLSGPVPPGTLARLDALQLLSLRANSLSGPFPADLLALPALAGLHLQRNAFSGPVPAGLAGLRALQVLDLSYNRFDGAIPAALSNLTHL

SEQ ID NO: 39228 - DNA, 677 bp, Panicum virgatum
  misc_feature: Ceres CLONE 1997457
  misc_feature: Encodes the peptide sequence at SEQ ID NO. 39229
acacaccgacgcagaaacacaccgacctcggctcacatatccgcgccggcacggcggcgcagcaccgcgccaccgcctctcggagaatcgaagccgtctgggcggggcgcgatggatctgctgaagcgggagctggagaagaagcggaaggcggcgtcggccgacttcggcgggaagagcttcgtgcggcggtcggagctggagcagaagcagctccagaagcgccgcgacgagcaacgccagctcctcgccaaggccggcgcatctgcgccgccccccgattccgccgcaggcgcagcgggctccgaccccagcaaccccgacgccgcggcccaggcgacggcggggaaccctaaccctagctcctccacctccgcggcggcggcctccgtcccgcccgccctcgcgccgaagaagaccacgcaggaggaggcgctgctatccgaggagcgccgcatcgacgagctcgacctcccgcggcacgaggtggtgcggcgcctccgcgtgctgcgcgagcccgtcacgctcttcggggaggacgacgacgcccgcctcgcgcgcttcaagctcattctcaagtccggcgtcatagatgacatcgatgacatcgacatgaccgaggggcagaccaacgacttcctccgcgacatgatcgagatgcgcaagcggcaaaagtc

SEQ ID NO: 39229 - protein, 188 aa, Panicum virgatum
  misc_feature: Ceres CLONE 1997457
  misc_feature (126)..(155): Pfam Name: PRP4 Pfam Description: pre-mRNA processing factor 4 (PRP4) like
MDLLKRELEKKRKAASADFGGKSFVRRSELEQKQLQKRRDEQRQLLAKAGASAPPPDSAAGAAGSDPSNPDAAAQATAGNPNPSSSTSAAAASVPPALAPKKTTQEEALLSEERRIDELDLPRHEVVRRLRVLREPVTLFGEDDDARLARFKLILKSGVIDDIDDIDMTEGQTNDFLRDMIEMRKRQK

SEQ ID NO: 39230 - DNA, 658 bp, Panicum virgatum
  misc_feature: Ceres CLONE 1997461
  misc_feature: Encodes the peptide sequence at SEQ ID NO. 39231
gccaattatggatagccagcagccagcgggggaggactgaggccgctcgccattgctcccatttgagcttgtcctacctggtgtagcttagcaacctgttcagcaaaatgaggccttcagatgacagggcgcagctctcaggctttgaacaatcagaagaatcaacacttgatgtggaggggcattgctaccaccaacagtcattcccttgttctccatcaatgcaaccaattgcttctgggtgcacacacacagagaatagcgcggcatacttcttatggccgacatcaaacctacagcattgtacggctgaggggcgcgcaaactactttggcaacctttcaaaaggactccttcccaagtctggcaagttgccaaagggccagcaagcaaatagcttgcttgacttgatgactataagagctttccatagcaagatattacgctgttttagccttgggacggcagtgggatttcgcatcaggaaaggggttctgacagatatccctgctattcttgtctttgttgctcgcaaggttcacaagaaatggcttaatccgacccaatgccttcctgcaatcgttgagggtccaggaggtgtttggtgtgatgttgatgttgttgaattctcgtactatggtgcaccagctcaaactcc

SEQ ID NO: 39231 - protein, 183 aa, Panicum virgatum
  misc_feature: Ceres CLONE 1997461
  misc_feature: Useful for making plants with altered protein content
MRPSDDRAQLSGFEQSEESTLDVEGHCYHQQSFPCSPSMQPIASGCTHTENSAAYFLWPTSNLQHCTAEGRANYFGNLSKGLLPKSGKLPKGQQANSLLDLMTIRAFHSKILRCFSLGTAVGFRIRKGVLTDIPAILVFVARKVHKKWLNPTQCLPAIVEGPGGVWCDVDVVEFSYYGAPAQT

SEQ ID NO: 39232 - DNA, 458 bp, Panicum virgatum
  misc_feature: Ceres CLONE 1997469
  misc_feature: Encodes the peptide sequence at SEQ ID NO. 39233
ctccgcccccaaaactctccttctcgatttcaaaaaaaaaaaaaactctgcttctcggcagcaatgccggagcctctatcctctacggcggcgagcgggggcggcggtcgccttaggaacgccttccgcggagtgctgtgcgccttcaccctcctcctcatcggcgtcatcgcattttcgatccgcctcttctcagtgatcaagcacgacagcgttatccacgagttcgatccctacttcaactaccgcgtcactcagtttttgtcaaagaatggaatctatgaattctggaactggtttgatgaccgaacatggtttcctctggggcgtgttattggcgggactgtctatcctggtttgacactaactgctggcgcaatatggtggttgctaaactcccttaatatcccattgtcggtggagaccgtctgtgtgttcaccgctccaatcttctcagc

SEQ ID NO: 39233 - protein, 131 aa, Panicum virgatum
  misc_feature: Ceres CLONE 1997469
  misc_feature: SWISSPROT Homolog: EC 2.4.1.119 Dolichyl-diphosphooligosaccharide--protein glycotransferase
  misc_feature: Useful for making plants with altered carbohydrate content
MPEPLSSTAASGGGGRLRNAFRGVLCAFTLLLIGVIAFSIRLFSVIKHDSVIHEFDPYFNYRVTQFLSKNGIYEFWNWFDDRTWFPLGRVIGGTVYPGLTLTAGAIWWLLNSLNIPLSVETVCVFTAPIFS

SEQ ID NO: 39234 - DNA, 714 bp, Panicum virgatum
  misc_feature: Ceres CLONE 1997481
  misc_feature: Encodes the peptide sequence at SEQ ID NO. 39235
aaaaaacgcaggggccagccaacggcagagaaaaccctcttcctcctcgtcgccacacgcactctttctctccctcgatcgatccatctcaagcggcggcggcggcggcgaggacgggctcgagtccccgtctgcagcgcgtaacggtgaaggctctgcttgcacgtcgccggcgcggtccatctgggagacagcaccctcttctctctccgctccgtcgcgcagatcggacccatcaatggcccacaatcgccagatggggtatgcaacggagtgcagctctgatgagtcatcagaactaagtgaaacagacattgatgactatgctgagaagtcgtacttggacctgaagtctggcaagcttgtggcaaggctggccagtgacaggttcaggtgtccattctgtccaggaaagaagaagcaggactaccgttacaatgagctgcttcagcatgctgttggggtgggagcatccaaccgtgctgcaaaggttaaggcaaatcaccaggctctggccaaactcctcaaagaggaccatgctgatgcagcagccacattggcaccacgacaggctcttgcactgagtaaccctccaaagccagtgaaagatcaggaagtgtttgtttggccgtggatgggtatcctcacaaatgttccggtcgaacaaacacaggggggtgggagccatactgttgaagcagttagctgaattcc

SEQ ID NO: 39235 - protein, 156 aa, Panicum virgatum
  misc_feature: Ceres CLONE 1997481
  misc_feature (53)..(93): Pfam Name: zf-XS Pfam Description: XS zinc finger domain
MAHNRQMGYATECSSDESSELSETDIDDYAEKSYLDLKSGKLVARLASDRFRCPFCPGKKKQDYRYNELLQHAVGVGASNRAAKVKANHQALAKLLKEDHADAAATLAPRQALALSNPPKPVKDQEVFVWPWMGILTNVPVEQTQGGGSHTVEAVS

SEQ ID NO: 39236 - DNA, 594 bp, Panicum virgatum
  misc_feature: Ceres CLONE 1997504
  misc_feature: Encodes the peptide sequence at SEQ ID NO. 39237
ccaccattgctgctgacctcctccaaattgtcttcttttccccccgctacctggctctccagatcgagtcccgggtcaggcgctctccacccccccccccccctgacccagcgccatgacccactacaccatgcatgcaaccatcaactacgccgcgctgccgcccacgtcgctgctggagctccccctcccgtacctcccgccgcctccgccgccgccgttatcgctcccgccgttgctttcgccgccgccaccaccggcggcggcggcggcgtccactgatgcggggttccagagcaggatcagccccagcgtcctcctcatcatcctgatcttggccgtcatcttcttcgtctccggcctgctgcacctcctcgtccggttccttctccgcccggcgccgcgggacgccggcgacgcgtacgggggcgacgccaacgccaccgcgttccaggggcagctccagcagctgttccacctccacgacgccggcgtcgaccagtccttcatcgacgcgctgccagtgttcctctacggagccatggtcggcgctggcgggaaggaccccttcgactgcgccgtctgcctctgcaa

SEQ ID NO: 39237 - protein, 159 aa, Panicum virgatum
  misc_feature: Ceres CLONE 1997504
  misc_feature: The sequence is a functional homolog of SEQ ID NO 1939 in the 11/479,226 US patent application
MTHYTMHATINYAALPPTSLLELPLPYLPPPPPPPLSLPPLLSPPPPPAAAAASTDAGFQSRISPSVLLIILILAVIFFVSGLLHLLVRFLLRPAPRDAGDAYGGDANATAFQGQLQQLFHLHDAGVDQSFIDALPVFLYGAMVGAGGKDPFDCAVCLC

SEQ ID NO: 39238 - DNA, 1264 bp, Panicum virgatum
  misc_feature: Ceres CLONE 1997510
  misc_feature: Encodes the peptide sequence at SEQ ID NO. 39239
ggcacgcacggcaccgagaccagcaagcagcaaccccttccttggcctggctcctcctcgcccggcccgtccccaaccggactctgcaatccacgagctcctcccctcccacccacctcccccgccctcgcgcctcctgcccctgctccccgcctccacccaccggcacctccggcgaccccaccccacccgcctcctcctcctcctcgcaaggccgcggcaccaacccggcgtcccctcgcggcgacggcgcgcgactgttccgttccccctcgcggcgagtaacggaggagggctggagccatgagcgggggagtggagctggagaccccgccgggtagcagcaggagcgggggcaccacgccagtcggcggcaagccgccgcggcaccacctcacgtccatccgccactgcgccagcagcgcacgcatcgccgcggcctccgccgaattcgagctggattcggggacgctgagcttgatctcgcccacagacatgcgtccgggcttcttgcccgtcttccggtcagggagctgcgcggacatcgggcccaaatcgtacatggaggacgaacatgtctatgtcgacaatctcgtcgagcacctcggactgcgtggcccgggcatccatgcccctggtgccttctatggggtgtttgatggccatggtggtacagatgctgcctgttttgtccggaagaatatactgaagttcataaccgaggattgccacttccccaacagcatggagaaggcaatcagaagtgcatttgtgaaggctgaccatgcaattgcagattcccattctcttgaccgtaattctgggaccacagcattgacagtctttatatttggcaggttagttctgatgttaatacttcaaaatgtatgatttagcaatttattgtcacttcattaagttattattcaatattattacgttgctatacagctatgatgcttatatttgctatttaatagcatacggcaacaaagatgagtaaaacatttgaaattaatggctctctgcaattcttttgttggatcaggttactttgttgatgacaacttacctttacaagaggaactgataattaaacccatgttcacagatttataaatcggtagattcgcttcctttcgttctgacagttcctctacatttattgcctcaacctccatatcacatctgtacataaaggttatttgctgtaccaagctgttcttggggccttatgtcctttattggttgataggtttcgaca

SEQ ID NO: 39239 - protein, 195 aa, Panicum virgatum
  misc_feature: Ceres CLONE 1997510
  misc_feature: SWISSPROT Homolog: EC 3.1.3.16 Phosphoprotein phosphatase
MSGGVELETPPGSSRSGGTTPVGGKPPRHHLTSIRHCASSARIAAASAEFELDSGTLSLISPTDMRPGFLPVFRSGSCADIGPKSYMEDEHVYVDNLVEHLGLRGPGIHAPGAFYGVFDGHGGTDAACFVRKNILKFITEDCHFPNSMEKAIRSAFVKADHAIADSHSLDRNSGTTALTVFIFGRLVLMLILQNV

SEQ ID NO: 39240 - DNA, 574 bp, Panicum virgatum
  misc_feature: Ceres CLONE 1997510-R
  misc_feature: Encodes the peptide sequence at SEQ ID NO. 39241
gttagacttaccgaggaagatgagttcttgataataggctgtgatggcctttgggatgtgatgagcagccagtttgctgtgtccatggtaaggaaagagctgatggcgcacaacgatccgcaacggtgctcacgagagcttgtccaggaagcgctcaggcgggactgttgtgataacctaactgtagttgtcgtgtgcttctcagtggacccaccccctcaaattgagatcccgagattccgggtacgaagaagcatctcaatggaagggctgcatacactgaagggagcccttgacagtaatgtctgagctctaaaatatacctttgctcgcaacttttgttgtatgatgagtcttctctttcttgttgtctgttaaagttttgttccggccattgggtttcgagatatagatctcggaataagtctggtagagttactttgaaagaaattttgaagaggtgtaggctaattaatgatttttgttgaggcaatgacttatctgtaccggctgccatttgattgttgattgttcacaatgtaatcaagcaattaaccgacattgttgtcctggt

SEQ ID NO: 39241 - protein, 102 aa, Panicum virgatum
  misc_feature: Ceres CLONE 1997510-R
  misc_feature: SWISSPROT Homolog: EC 3.1.3.16 Phosphoprotein phosphatase
VRLTEEDEFLIIGCDGLWDVMSSQFAVSMVRKELMAHNDPQRCSRELVQEALRRDCCDNLTVVVVCFSVDPPPQIEIPRFRVRRSISMEGLHTLKGALDSNV

SEQ ID NO: 39242 - DNA, 1349 bp, Panicum virgatum
  misc_feature: Ceres CLONE 1997516
  misc_feature: Encodes the peptide sequence at SEQ ID NO. 39243
gtaatgtaatactcccacatactccagatttgtttggatcgtgatgaaaggaaggatcgctgctccgcctccaattccaattccaattcctccgtagcatccacaaatcaaacctcaatggcgatctgaaccaaccttccagaaccatccggaagttcgtatggatcgaatcctcaagtccgccagggagtcgggctccctcaacctctccaatcgctccctcagggagatacccaaggaggtatacaacaacttggacacaggcagccaggatgagaaatggtgggagggagtggacctccagaagctcatactggctcacaataatcttgaagtgctaacagaagaccttagaaatttgtcttcacttgttgtgttaaatataagccacaacaagatatcttcccttccagcagctattggagacctgccattgctaaaatcgctggatgcatctttcaatcaaataaacactctgcccgaagagattggtctggctactgcattagtcaaggttgatctctcaaataattgccttaccgagcttccagctagccttgccaaatgtccggacttgttggaactcaaggcatcaaacaacaccatatcaagaataccagatgcacttgctggctgttccaagttaagtaaattggatctagagggtaacaagcttgtcactatttctgaaaacatgtttgcatcctggacaatgctcacggagctaaatcttgcaaaaaatctgcttacaaccaccccggatagtatcggagcacttcctaaacttattcgcctggacatgcatcagaataaaataacatcaattcctccttccataaagggttgctcttctcttgctgagctctatatgggaaataacttattgtcttcaataccagctgatattggcacactatcaaaattaggaatacttgatctccattctaatcagctaaaggagtaccctgttggagcatgcaacctcaaactatctttcctcgacctatcgaataattcattatctggtctaccagctgaactaggtaaaatgactaccctcagaaagcttctgcttactggaaatcctatgagaacacttaggagttcattggtttctggatcaacaactgcattactgaagtatctgcggagtcggctttcatctgacgaggaaggatctggaagcacaagcatcccgacaaaagatgaccaaattgctgcagcaaggcgattgtccttatcttcaaaggaattggacttgagcggtcttggtgtgaccaatgtaccggcagcggcgtgggagacaagcgatgtggtcaaattggatctttctaaaaattcaatagaag

SEQ ID NO: 39243 - protein, 396 aa, Panicum virgatum
  misc_feature: Ceres CLONE 1997516
  misc_feature: SWISSPROT Homolog: EC 2.7.11.1 Non-specific serine/threonine protein kinase
MDRILKSARESGSLNLSNRSLREIPKEVYNNLDTGSQDEKWWEGVDLQKLILAHNNLEVLTEDLRNLSSLVVLNISHNKISSLPAAIGDLPLLKSLDASFNQINTLPEEIGLATALVKVDLSNNCLTELPASLAKCPDLLELKASNNTISRIPDALAGCSKLSKLDLEGNKLVTISENMFASWTMLTELNLAKNLLTTTPDSIGALPKLIRLDMHQNKITSIPPSIKGCSSLAELYMGNNLLSSIPADIGTLSKLGILDLHSNQLKEYPVGACNLKLSFLDLSNNSLSGLPAELGKMTTLRKLLLTGNPMRTLRSSLVSGSTTALLKYLRSRLSSDEEGSGSTSIPTKDDQIAAARRLSLSSKELDLSGLGVTNVPAAAWETSDVVKLDLSKNSIE

SEQ ID NO: 39244 - DNA, 541 bp, Panicum virgatum
  misc_feature: Ceres CLONE 1997516-R
gagcgaggaacgaaagcaattctcaagtacctcaaagaaaaattgcccgctgaataatgtctcagagaacaaattgtcgtgggactcgggcaataatatgtttcttggccactgtatcttttatttaagtcttgcaattttccggtgtgaattctgcggaatctggatcttgcgcgagaagtgagcgagttgccgtatgggcgttgtggtcaatatttgtgtgtgtttgcatcatccctttcgtttgcatcattgaagctagtgtgtctgcccactctttatgaatcggtggtacaacgagacgcggcagaagacgagaagagatgttgcagatgagattagatggcagacgtgagacggcatggttctgaaaggtacacagaagggtcgtgtctatttcaacattctataagttgagcacgccagtgtctttcatgtgttgcgcagtgaaaacaatgtgtttttcaggtgttgtacgtcaacaataatttttgtggaattttgaacggcttctagtgcatgtatgggaactgttaacctg

SEQ ID NO: 39245 - DNA, 1341 bp, Panicum virgatum
  misc_feature: Ceres CLONE 1997522
  misc_feature: Encodes the peptide sequence at SEQ ID NO. 39246
aaagccgcatcaaaatgatccaacccctccatcgcttcccccgcacggccgcacccgcaccgcaaatcctctcctgctagccctcgccacccccgcctcactcgaaccgcaccgcgccccaaaccctagcgcagccgcggtgggaggcgcaccgctccaatccaaccccaatagcttcggccccgattctcctgccacccccctcaaaccccggccgcccttctccgcctccgccgtcctctgtaatttttcgaattctgtattgggaatatttgtggtgcttttttggttgtttgtttcaggagcgcgtgtcctcggaggattcgcggcggctgggctagggttttggcgtctcggtcaagggtgcgccatctgctccgtgggatctcccggaaccaggattgctgtcagtcaccatgtcatcatatcctgtgctaaacaaccgaccaattgatcagtggagagttactgatctgaaggatgaactccgtaaaagaaggcttcctgtcaagggtttgaaagaggaacttgtgaggcgactttttgaatccattcagagtgaaaaagcagctgatgaagctgatgaagacgcgggagcgaatgcagatgatcagttgcctgatgccaatgctagtgaacaaactacagttaccatcacagaagttcatcatgaaacagtggttcatgtcagtcagcaagttgaagttcctatccccagtgttgatgttgaagcttccttaaatgagacctcagctgccaaaggagaagaacctgaatcaattgctggaggaaatttagctttcgaagaagtgcaaccgcatactgaaagtaataatgagcctattcttgagaagacctcagatgctgacaccaatgaggcagtcatagtcaatgatgcaatcagtaatgaagtgaagtcagacttggccacttctgaaatcaagtctgatgccactaaagcaacaaaaattcaagaacatgaatcagcaccagcacctgcagatgctagccatatggataccgatgttgtcacagctgcaccagtaagtgatgatggggagaaactggcacccatggatgatttgggtggcaaagtgccaatgtatgatgaagaacacaaagattctgatatcatggacgaggaacgcgagcccatcgtgtcaaaaccaaataatcaggtacctgaggttagcccagatttagggtctcaaattaagtgtgagtcgatttctagtgatctatcaactaacaaaaagaataatatagaagataacttgaatgctaataattttgatttagaactagaggttaagccgaagatggttgaaccatcatccggca

SEQ ID NO: 39246 - protein, 308 aa, Panicum virgatum
  misc_feature: Ceres CLONE 1997522
  misc_feature (12)..(46): Pfam Name: SAP Pfam Description: SAP domain
MSSYPVLNNRPIDQWRVTDLKDELRKRRLPVKGLKEELVRRLFESIQSEKAADEADEDAGANADDQLPDANASEQTTVTITEVHHETVVHVSQQVEVPIPSVDVEASLNETSAAKGEEPESIAGGNLAFEEVQPHTESNNEPILEKTSDADTNEAVIVNDAISNEVKSDLATSEIKSDATKATKIQEHESAPAPADASHMDTDVVTAAPVSDDGEKLAPMDDLGGKVPMYDEEHKDSDIMDEEREPIVSKPNNQVPEVSPDLGSQIKCESISSDLSTNKKNNIEDNLNANNFDLELEVKPKMVEPSSG

SEQ ID NO: 39247 - DNA, 496 bp, Panicum virgatum
  misc_feature: Ceres CLONE 1997522-R
aagccagagcctcctgttgtgacactcgatgatctctttaggaagacacagtcatccccgaggatctactacctgcctttgtcagaagaggaggtggcagccaagctcgccgcacaagggaaagggaaaaaggaataagaggcattggtctccatttctcgtctctagtgtcgtggaacatgaagacatgactttgtgaggcgatcacagcagctggcaggtgcaactgctgcagtccatttgaaataacaggcggtgctgagtgctgtggcaaggagtagttgtagggttgttatgtgaaagactagtgtagaagcagcagcagcttgtatttcctgcagaaggtagttttgattgggttccgtctagaccgtctgagttacttgtttaattatgctgtcaggtattgttgagacgcttggttagttgtctgggggaaaatactgttaagatgcttggtttagttttttttttctgtcttcagcgtcgatattgc

SEQ ID NO: 39248 - DNA, 1146 bp, Panicum virgatum
  misc_feature: Ceres CLONE 1997525
  misc_feature: Encodes the peptide sequence at SEQ ID NO. 39249
agtgcagtgtgcgttgctgctgctctccgactagccgttgcgcccattcctctgctctgctctgctctgcccacttcattcttcctcctcccctctcttctccatccacgcaactctttgcaattcccctggctggcctgcttccatctcattccaaatccaccaccatgctgctgctcttcctcttcctcctcctgctcgctccgccgcctaccgctaaagccgccgcccaccaccaccaccccgccggcgacggcgtcgtcatctcccaggccgactaccagggcctccaggccatccgccacgacctctccgacccctacggcctcctccgctcctggaacgactccggcctcaccgcctgctccggcgcctggctcggcatcaagtgcgtcctcggcagcgtcgtcgccatcacgctcccctggcggggcctcggcggcaccctctcccagcggggcctcggccagctcacccgactccgcaggctcagcctccacgacaacgccatcgcgggccccatcccggaatccctcggcttcctccccgacctccgcggcctctacctcttcaacaaccgcttctccggcgccctcccctcctccatcggcgcatgcctcgcgctccagtccttcgacgccagcaacaaccgcctcaccggcgccatcccggccgccatcgctaactccaccaagctcatccgcctcaacctcagccgcaacgcgctctctgctgacatccccgccgaggtcctcgcctccgcctccctcctcgtcctcgacctctcctacaacaacctctccggtcccatccccgacgcattcgcagcctccaccaactccccttcttccaagctcctcaacaacaacaaggaggccatcaccggggcataccagctcgccttcctcagcctcgcgcacaactccctcgacgggcccatcccggactcgcttgcaaagctcaccaagctccaggacctcgacctctccgccaacaacctcaacggcaccatccccgccaacctcaccgccacgctccgctccttcaacgtctcctacaacaacctctccggcgccgtgccagccgccctcgcccgcaagttcggggagcccgcattcaccgggaacatccagctctgcggctact

SEQ ID NO: 39249 - protein, 326 aa, Panicum virgatum
  misc_feature: Ceres CLONE 1997525
  misc_feature (34)..(76): Pfam Name: LRRNT_2 Pfam Description: Leucine rich repeat N-terminal domain
  misc_feature: SWISSPROT Homolog: EC 2.7.11.1 Non-specific serine/threonine protein kinase
MLLLFLFLLLLAPPPTAKAAAHHHHPAGDGVVISQADYQGLQAIRHDLSDPYGLLRSWNDSGLTACSGAWLGIKCVLGSVVAITLPWRGLGGTLSQRGLGQLTRLRRLSLHDNAIAGPIPESLGFLPDLRGLYLFNNRFSGALPSSIGACLALQSFDASNNRLTGAIPAAIANSTKLIRLNLSRNALSADIPAEVLASASLLVLDLSYNNLSGPIPDAFAASTNSPSSKLLNNNKEAITGAYQLAFLSLAHNSLDGPIPDSLAKLTKLQDLDLSANNLNGTIPANLTATLRSFNVSYNNLSGAVPAALARKFGEPAFTGNIQLCGY

SEQ ID NO: 39250 - DNA, 744 bp, Panicum virgatum
  misc_feature: Ceres CLONE 1997535
  misc_feature: Encodes the peptide sequence at SEQ ID NO. 39251
aaaaagcctccggtctggtggatcgcctcctcgcccgcccctccgctgcgcccgcgcccctctctctgctcctccgcgcattcttgggttccatcgacaacaaagaagatctaagacacctgctcgcagctcggcctagctagtccggactccggatctcaaccaccacctaccatatcctattttacgggttcaactgctagcttatcagcatggctgaggaaaccaccaatgacactcaggtggcccaagaaaatgaggttgctcccaatgatgaggcggtccaagcagatgaattggtccaagctgaagatatggctcaagctgatgagttgatacaaggcgaagaaatcaatcaaggtgatgagttgactcatggtgacgatttcatgcaaggaaatgagttggtcgttgctgaggaaacgacccctcggactggaaccagacggaggagaaagaagtccttggtatgggagcacttcactattgaggaagtcgctggaggggccacacgggcatgctgcaatctctgtaagcaaacctttgcttacagctctggctcaaagattgctgggactagccatctcaagaggcacatcaccttgggttcttgtcctaagataaagaatcaagagcagaggctggcactgccttcagcaggaggtactgacaatgatggtgagggaactgtggagcggcgaactaagagacgatacagatatactggttatgcaaatgctgctt

SEQ ID NO: 39251 - protein, 177 aa, Panicum virgatum
  misc_feature: Ceres CLONE 1997535
  misc_feature (84)..(135): Pfam Name: zf-BED Pfam Description: BED zinc finger
MAEETTNDTQVAQENEVAPNDEAVQADELVQAEDMAQADELIQGEEINQGDELTHGDDFMQGNELVVAEETTPRTGTRRRRKKSLVWEHFTIEEVAGGATRACCNLCKQTFAYSSGSKIAGTSHLKRHITLGSCPKIKNQEQRLALPSAGGTDNDGEGTVERRTKRRYRYTGYANAA

SEQ ID NO: 39252 - DNA, 1258 bp, Panicum virgatum
  misc_feature: Ceres CLONE 1997540
  misc_feature: Encodes the peptide sequence at SEQ ID NO. 39253
atctttcttcccacctccccttcccattcccctcgtgctcctcccgtcaccacctctcttccccctccctctcaagtcccaacccccccgtctcgtctcattcacttgtgaatgagacgaccaggaggaattcttcttcctccctcagcgtcttctcaccagcgtttcgcggaccaagcgaagaaaattcgggcgcagacaaacaataatactaaaagaaccagtctttgcttcgcagcttcttggttggtgacccagcaccagcggaggagtgggggagaaaaaatatcagccgagctcccaactttgaccgcagccgccgccgccgtgctcgctgcgtagccccgcagccgtctcttcccggatcggagctcccctccctgggacaccgccggccgcctccccttggatcagctcggcctccgcaagataggcgaggtcctgctgcattgcagcaatgaggtgcctgcctttcttgcatggagaggtcaaagaggatgatcctgtcaccatgtctgcatctgtacggtccctgagcacaacatcaacggagcgtgatgtccgctctggttcagacttcacctccttgaatgcatccgacatgagcgccgagtcaataaggaggacgcagtaccccagcttcactgaccggccatctaacctgagggtgttctccttctctgaattgaagagtgccacacgcaacttcagccggtcactcatggttggtgagggtggctttggctgtgtgtacaggggcatcatcaagacatctgacgaacctagtgaacgaatcgagattgctgttaagcagttgaatcgtaaaggacttcaggggcagaaggagtggttaacagagatgaatgtgcttggaattgttgaccatccaaacctagttaaactaataggctactgcgctgatgatgatgagcggggagtacaacgcctcctagtgtacgaatatatgcctaatggaagtgttgacgatcacttgtcgagtaggtcaacttcaactctatcatggcctatgagactgaaagtagctcttgattctgcccggggactgaagtatctgcatgaagaaatggaattccaggtcatttttcgagatctgaaaacatctaacattctgttggatgagaactggaacgccaaattgtcagacttcggtttggctaggcatggaccaacagaaggtctgacccatgtctccacagcggtagttggaactctaggctatgcagcgcctgagtacatg

SEQ ID NO: 39253 - protein, 266 aa, Panicum virgatum
  misc_feature: Ceres CLONE 1997540
  misc_feature (84)..(265): Pfam Name: Pkinase_Tyr Pfam Description: Protein tyrosine kinase
  misc_feature: SWISSPROT Homolog: EC 2.7.11.1 Non-specific serine/threonine protein kinase
MRCLPFLHGEVKEDDPVTMSASVRSLSTTSTERDVRSGSDFTSLNASDMSAESIRRTQYPSFTDRPSNLRVFSFSELKSATRNFSRSLMVGEGGFGCVYRGIIKTSDEPSERIEIAVKQLNRKGLQGQKEWLTEMNVLGIVDHPNLVKLIGYCADDDERGVQRLLVYEYMPNGSVDDHLSSRSTSTLSWPMRLKVALDSARGLKYLHEEMEFQVIFRDLKTSNILLDENWNAKLSDFGLARHGPTEGLTHVSTAVVGTLGYAAPEY

SEQ ID NO: 39254 - DNA, 599 bp, Panicum virgatum
  misc_feature: Ceres CLONE 1997540-R
  misc_feature: Encodes the peptide sequence at SEQ ID NO. 39255
tccccatcatcatcgacccgaggttggaggggcactacaacctcaagtccatgacaaagctggccaacgtggcgaaccgctgcctggtccggatgccaaagtcccggccgaagatgagcgaggtgtacgagatagtccagaagatcgtcgacagcatcgagaccggcccaccgcagccgcctctgcactaccatggctcggtctctgagccaggcgcgaagcggaccaagaaaggatcgctgaagagaaggctccaggagttcaaattcggttgccggaatgtcgtgtggcggagctggaagcctgagatcgtaaagaccttctgagacgaccgtaggctccttgctgtaaggatagctgtgcataggtatgagggctgttcctctgtgtgttttccgttcgggcgagttgaaacctgtgtgattcacctggtcctgaacaacacagtgcgtgagctgcaagatggtgatcgattaggcaggcccccttgtgtttttcagtgcagtgccgggtgataccaacttacgaactgctttgtttctgcagtgtaattcctggcctttcttttttctgttatgaagtcggggttctgattcagc

SEQ ID NO: 39255 - protein, 107 aa, Panicum virgatum
  misc_feature: Ceres CLONE 1997540-R
  misc_feature: SWISSPROT Homolog: EC 2.7.11.1 Non-specific serine/threonine protein kinase
PIIIDPRLEGHYNLKSMTKLANVANRCLVRMPKSRPKMSEVYEIVQKIVDSIETGPPQPPLHYHGSVSEPGAKRTKKGSLKRRLQEFKFGCRNVVWRSWKPEIVKTF

SEQ ID NO: 39256 - DNA, 638 bp, Panicum virgatum
  misc_feature: Ceres CLONE 1997541
  misc_feature: Encodes the peptide sequence at SEQ ID NO. 39257
aattcgaagttcaaacacactctactccaagctcggctatctgagcagaggctcggacatgaccaagaagctcacctccgccatggccgggaagcaggattttcgcaaggcgcaattcgacgatcagggtattcacggaggcggcaagaagagcgcggcggggctcgggggcagcaggctgatctcccacgagcaggaggacgccatcatcgtcgcggcgctgcggcacgtggtgtccgggtacagcacgccgccgccggaggtcatcacggtggcgcgcggcgaggcgtgcggggtctgcggcatcgacgggtgcctcgggtgcgacttgttcttcggggcgcccgcggaggtggcgagttcttccggcgcggggcgggtggcggcgccggcggcaggaggggagcagcagcagcagcagcagaggccgcggcggcggaggaagatgaacatgtaccgcggcgtgcggcagcggccgtggggcaagtgggcggcggagatccgcgacccgcggcgcgcggcgcgcgtgtggctgggcacgttcgacaccgcggaggcggccgccagggcctacgactccgccgcgctcgagttccgcggcccgcgcgccaggctcaacttcccggcccgcggcgacg

SEQ ID NO: 39257 - protein, 193 aa, Panicum virgatum
  misc_feature: Ceres CLONE 1997541
  misc_feature (131)..(182): Pfam Name: AP2 Pfam Description: AP2 domain
  misc_feature: Useful for making plants with modulated biomass
  misc_feature: The sequence is a functional homolog of SEQ ID NO 34 in the 10/225,068 US patent application
  misc_feature: The sequence is a functional homolog of SEQ ID NO 348 in the 10/374,780 US patent application
MTKKLTSAMAGKQDFRKAQFDDQGIHGGGKKSAAGLGGSRLISHEQEDAIIVAALRHVVSGYSTPPPEVITVARGEACGVCGIDGCLGCDLFFGAPAEVASSSGAGRVAAPAAGGEQQQQQQRPRRRRKMNMYRGVRQRPWGKWAAEIRDPRRAARVWLGTFDTAEAAARAYDSAALEFRGPRARLNFPARGD

SEQ ID NO: 39258 - DNA, 1308 bp, Panicum virgatum
  misc_feature: Ceres CLONE 1997549
  misc_feature: Encodes the peptide sequence at SEQ ID NO. 39259
aaaggcggggcacatccatctctaatctctcggccagcctcggcgacgacgcaaagggagggggcgtgagaggcgccgcccggcccttggcagttcttcttcgtctcgtcgggcacttccaaggcccatgccctatattggattcgacgtttgcgattgattgagttgggatggcttgtcgcctcattagccccgcggcggcgtgccgaggctgcggtttcgttaacgccggctttctcggcgccgtctcctccttccattatcaaaccttgccatcgtgctcaacctcatccaagcggggatcatcggtgaagaattgctttagcttccgtgctcatttaaggaaagagggttcacgttggataaggtccgagcctttcttgtcagtaaatagtgcaaagtttgtcggcaagaggacatcctgttcagttgcaacagagccgcctcctgctgcaaccgaaaaaccagagatggattctcccaaggagatattcttgaaagattacaggaaacctgattatttgtttgacaaggtggatttgcaatttcaacttggtgaagaaaagaccatagttacatctaaaatagttgtatctcctggtgttgaaggaagcatctcagctccacttgttcttcatggctgtgacctgaagctgttatcgatcaaagtcaatggcaccgagctaaagggcgaagagtatacagtcgattcacgccatctgacagtttcaacaccgcctgctggtgtattcaacttggaaattgttacagaaatatatcctcagctaaacacatctttggaggggctgtacaagtcaactggtaacttttgcactcagtgtgaagcagaagggttccggaagattacctactttcaggatcgtccagatgttatggcaaaatatacttgccgcattgaagctgataaaactttgtatccagtattattgtccaatggcaatcttattgagcagggagacctcgagggtggaaaacactttgcattgtgggaggatcccttcaagaaaccaagctacctgtttgctctagttgctggtcagttgggatgccgggaggattcatttgttacatgctccggccgcaatgtaacactcagaatttggactcctgcccaagatttgccaaaaacagcacatgctatgtattctcttaaagcagcaatgcagtgggatgaggaggtctttggtcttgagtatgatcttgatttgttcaacattgtcgttgttcctgatttcaatatgggagcaatggagaataagagcttaaatatatttcaatctagacttg

SEQ ID NO: 39259 - protein, 379 aa, Panicum virgatum
  misc_feature: Ceres CLONE 1997549
  misc_feature (112)..(377): Pfam Name: Peptidase_M1 Pfam Description: Peptidase family M1
  misc_feature: SWISSPROT Homolog: EC 3.4.11.2 Membrane alanyl aminopeptidase
MACRLISPAAACRGCGFVNAGFLGAVSSFHYQTLPSCSTSSKRGSSVKNCFSFRAHLRKEGSRWIRSEPFLSVNSAKFVGKRTSCSVATEPPPAATEKPEMDSPKEIFLKDYRKPDYLFDKVDLQFQLGEEKTIVTSKIVVSPGVEGSISAPLVLHGCDLKLLSIKVNGTELKGEEYTVDSRHLTVSTPPAGVFNLEIVTEIYPQLNTSLEGLYKSTGNFCTQCEAEGFRKITYFQDRPDVMAKYTCRIEADKTLYPVLLSNGNLIEQGDLEGGKHFALWEDPFKKPSYLFALVAGQLGCREDSFVTCSGRNVTLRIWTPAQDLPKTAHAMYSLKAAMQWDEEVFGLEYDLDLFNIVVVPDFNMGAMENKSLNIFQSRL

SEQ ID NO: 39260 - DNA, 481 bp, Panicum virgatum
  misc_feature: Ceres CLONE 1997549-R
ctcttgctaaggctcagctggagatgattgtgtcggccaatggtctctcagagaatgtgtacgagatagcttccaagagcttggcagattagtttggggggtttggtcaaggaaatgaattggacatggcagtgggggtagcaactgcaaagcgtgcgtaactgaaatgggtatcttcatctattggcatgacgccgagtggggtactagtgataataaataaataaacatgcctgctttggaatgaagtttcacgtaactcgtaaaatggcatggtgatgcctgggttggtaggcgctgctcttgttggaattactgtcagaaaacatgtgtggggctgatgttcgttcgggtcttgtggctggctgggggtcccggaaacctggatagttgttgtaaggtttggagctttccagccttgccagaatggttttttctaaacacgatgtgccaccagatttcctgtttgttggttttttcg

SEQ ID NO: 39261 - DNA, 651 bp, Panicum virgatum
  misc_feature: Ceres CLONE 1997567
  misc_feature: Encodes the peptide sequence at SEQ ID NO. 39262
acttcgaaacatttcgaaatccccaaccccgaccgcccgacgcctcgaaacttttcccgcccggagcctccaaaccctagccccatctccggccggcgacgcctccccggcggccggcgagatgcacatcaaggaggtaacactcgaggggttcaagtcgtacgcggggcggacggtggtgtcggggttcgacccgctgttcaacgccatcaccgggctcaacggctccggcaagtccaacatcctcgactccatctgcttcgtgctcggtatcaccgacctccgccaggtccgcgccgcctcgctccaggagctcgtctataagcagggtcaggcgggggtcaccaaggccaccgtctccatcgtcttcgacaactccgaccgctcccgctccccgctcggctatgaggactcgcccgagatcaccgtcacgcgccagattgtagttggtggacggaacaaataccttatcaatggccatcttgcccaaccttcccgggtgcagacccttttccactcagtgcagcttaatgtaaacaatcctcattttctaattatgcaagggcgcataacaaaagtgctcaacatgaagcctccagaaattttgtccatgttagaagaggcagcgggaacacgaatgtatgaaatgaa

SEQ ID NO: 39262 - protein, 176 aa, Panicum virgatum
  misc_feature: Ceres CLONE 1997567
  misc_feature (2)..(175): Pfam Name: SMC_N Pfam Description: RecF/RecN/SMC N terminal domain
MHIKEVTLEGFKSYAGRTVVSGFDPLFNAITGLNGSGKSNILDSICFVLGITDLRQVRAASLQELVYKQGQAGVTKATVSIVFDNSDRSRSPLGYEDSPEITVTRQIVVGGRNKYLINGHLAQPSRVQTLFHSVQLNVNNPHFLIMQGRITKVLNMKPPEILSMLEEAAGTRMYEM

SEQ ID NO: 39263 - DNA, 1237 bp, Panicum virgatum
  misc_feature: Ceres CLONE 1997573
  misc_feature: Encodes the peptide sequence at SEQ ID NO. 39264
acgggcgcctcgctgcttgggttgggagcagctactgcaagggccacgacgacgagaagggcaacaagaagcccgcctcgccggcggcaggcacaagcctgaccactgcaagcgcctgctctgcgagcagaacctactcacttccgtcgttcgactttttatgtcgggcgcagccgatgccgccgccgccgccgcagtccgtcgactcctagtcaccggcgtacgcccgaacaaccacctcccaccgctcgcagtgaagctcctccacggccgcctcctccgcctcgacctcctcaccgacctcttcccgctcctcctccgcgccgtcacctcctccggcctgcacctccacgccctccgcattcactccctcctacacaacccctcccacctcaccttccccttcgcgctcaaggccgcctcccgcctgcccgaccctctcccagccggcgcgcaactccatggccaatccctcaagctcccgtaccactccaatccccacgtcctcacatccctcctcagcctgtatgcaaaatgcggccgtctgcacgacgcccagcgggtgttcgacgaaatgctccagcccagcaccgtttcttggaccgcgctcatcaccgcctacatggacgctgggcgcttccaggaagccgtcggcgttgcgaggaatgagttcgcgagtggcatgcgtccagacggcttcacggccgtgcgggtacttactgcatgtgctcgtgtcaccgatttggtgaccggtgaggcggtgtggaggttggcagagcaggaggggatcgctgggagcgtgttcgtggccactgcggcgttggacttgtatgtcaagtgcggcgagatggagaaagctagagagatgtttgacaggatgcaggacaaggatgcggtggcttggagtgctatggttgggggttacgcctccaacggattaccacgagaggctctggaactattctttgcaatgcaggcagagggaatgcggccggattgctacacggtagttggggcactatcagcgtgcacaaggttgggtgcattggatttgggtcggagggcagtcgggatgttgcgctgggatgagtttcttgacaatccagtcctgggtaccgcactgatcgatatgtatgccaagtgtgggagcacgggtgaggcatggacagtgttccagcagatgaggaagagagacatcgttgtctggaatgcgatgatcttggggcttggtatgact

SEQ ID NO: 39264 - protein, 358 aa, Panicum virgatum
  misc_feature: Ceres CLONE 1997573
  misc_feature (246)..(280): Pfam Name: PPR Pfam Description: PPR repeat
MSGAADAAAAAAVRRLLVTGVRPNNHLPPLAVKLLHGRLLRLDLLTDLFPLLLRAVTSSGLHLHALRIHSLLHNPSHLTFPFALKAASRLPDPLPAGAQLHGQSLKLPYHSNPHVLTSLLSLYAKCGRLHDAQRVFDEMLQPSTVSWTALITAYMDAGRFQEAVGVARNEFASGMRPDGFTAVRVLTACARVTDLVTGEAVWRLAEQEGIAGSVFVATAALDLYVKCGEMEKAREMFDRMQDKDAVAWSAMVGGYASNGLPREALELFFAMQAEGMRPDCYTVVGALSACTRLGALDLGRRAVGMLRWDEFLDNPVLGTALIDMYAKCGSTGEAWTVFQQMRKRDIVVWNAMILGLGM

SEQ ID NO: 39265 - DNA, 428 bp, Panicum virgatum
  misc_feature: Ceres CLONE 1997573-R
  misc_feature: Encodes the peptide sequence at SEQ ID NO. 39266
tgaggtggtgatgtttgacattgaagacgaagagaaggagcatacgctagtgcatcacagcgaaaagatagccattgcatttagccttcttactactaagccaggcgagaccataagagtcaccaaaaacctccgggtttgcagtgactgtcacactgccatcaaactcatctcgaggataaccaatcgtgaaattattgttcgagataataatcgatttcattgcttcagagatggtcattgctcttgtaatgactactggtagtatacagacaacttcctgatgcagttttgagcagcagggaaagttgaaagcatcattgtcattttgatgtaaaactgtagtcaggctagagttgtaattggagcataggagaggtagactataaggcaggctaacactgcaatgttatattttttttcctcct

SEQ ID NO: 39266 - protein, 87 aa, Panicum virgatum
  misc_feature: Ceres CLONE 1997573-R
  misc_feature: SWISSPROT Homolog: EC 2.7.4.3 Adenylate kinase
  misc_feature: Useful for making plants with altered cell wall content and/or composition
EVVMFDIEDEEKEHTLVHHSEKIAIAFSLLTTKPGETIRVTKNLRVCSDCHTAIKLISRITNREIIVRDNNRFHCFRDGHCSCNDYW

SEQ ID NO: 39267 - DNA, 1313 bp, Panicum virgatum
  misc_feature: Ceres CLONE 1997589
  misc_feature: Encodes the peptide sequence at SEQ ID NO. 39268
aagcgctgtggaggttcagcagccttcgccggccttggtgtctctcctctgcgcttctccactgtggctaagctagggtggcggcgccgccgcaatctattgcaagcaaccccaccaccgtacctgtcgccacggcggcttcagcggcagcgctcccagccccaccgctgacgcctccccatcgactttcagatgtcttttgacatcacagaaaaggattgcccctgctttctctggtgtggatgccacggacgcttctggcgccccactatatttcgacattggacttaatacttgtcgatctttgttatactgcacgttgcagatttcactaccttgctgcttcaaccaaggacgtttcttcttctctagctacaaccagaccatttccttctttatttccaattttgtatctcgttattatctatcttactactgcaaagagaaccgcaatattctccctatggccaagacatcgcttcctccaggattccggtttcacccaactgatgtagaactcaccgtctactatttaaagaggaagttgttgggaaaacatttacgctgcaatgctattacggagattgatctatacaagttcgccccttgggatcttccagagaaagcttccttggagagtaacgatctagtgtggtatttcttttgcccacgcgataggaaatattctagtgggttaaggactaacaggtcaaccggagttggatattggaaagctactgggaaggacaggccggtgttttataattctaggactgttgggatgaagagaactttggtgtttcatcttggcaagccaccacgaggtgatagaactgactgggtaatgtatgaatataggctggaggatgaggaactagctgcttctggtgttaaactggatgcctgtgttctatgcaaaatttttcagaaaagcggtctaggacccaagattggggcacaatatggtgctccattcaatgaagaggactggaatgatgccagcaatgcggagtgttcaccatttgcaccttctgtggccccctgtgcacctgaatcaagtcatgttgggttgaactctgctggtcaacacctggctgtgagttatgatggcaaggtttctttgggccccttgtcagaaagtaacaatgaacatgctgtcaatcgtgttcatcctagcagaccttcttccaatattcctatcgagagcatacacatacagctgctagctgagatgatcagatgttccctcacaaatcttctatgtactgctgctgaagatggttcactgcctgacttcactgctggcgatgata

SEQ ID NO: 39268 - protein, 283 aa, Panicum virgatum
  misc_feature: Ceres CLONE 1997589
  misc_feature (6)..(134): Pfam Name: NAM Pfam Description: No apical meristem (NAM) protein
  misc_feature: The sequence is a functional homolog of SEQ ID NO 108 in the 10/666,642 US patent application
  misc_feature: The sequence is a functional homolog of SEQ ID NO 332 in the 10/412,699 US patent application
  misc_feature: Useful for making plants with modulated oxidative stress sensitivity
MAKTSLPPGFRFHPTDVELTVYYLKRKLLGKHLRCNAITEIDLYKFAPWDLPEKASLESNDLVWYFFCPRDRKYSSGLRTNRSTGVGYWKATGKDRPVFYNSRTVGMKRTLVFHLGKPPRGDRTDWVMYEYRLEDEELAASGVKLDACVLCKIFQKSGLGPKIGAQYGAPFNEEDWNDASNAECSPFAPSVAPCAPESSHVGLNSAGQHLAVSYDGKVSLGPLSESNNEHAVNRVHPSRPSSNIPIESIHIQLLAEMIRCSLTNLLCTAAEDGSLPDFTAGDD

SEQ ID NO: 39269 - DNA, 553 bp, Panicum virgatum
  misc_feature: Ceres CLONE 1997589-R
gagcgagactctgtggactgcatctccaatactgttaatacttccacatcgacagctgatggttcatttccttcagtgtgcgcggttgatgtgcacagaacctgattcagagtgagttgtctagctcacattttagtggagtcttggaggactcggcacagggctccatttcccctcctttcaatggagtcagcattatgctgttgagatgaaggcgggtccccagctgaccccatgagtcaccttgcacacgatcatctttgttgtgcagctactggttgaatagcctcaatccaggagtattcctctgtcatccctagtcccgcaccgtggcagcatgaataatgtaattttcatgttttagctagagtggggtacctgcagctgttgtgatgtaacatgtgctggtttcgtttcaaggatttgctagcgtcttggcaacttttgtagtcatattctcagctcagccgctggatgaacttcatccaacgaatgtaaatttccacacgaatcttaaacaccgaaaggtgctgaagaaaaaaatattgcagcg

SEQ ID NO: 39270 - DNA, 626 bp, Panicum virgatum
  misc_feature: Ceres CLONE 1997598
  misc_feature: Encodes the peptide sequence at SEQ ID NO. 39271
caaaagaaaccctcccttccaaccgcctatctttagctcccccgtctcgcgcgccgccgcatgcggccgccgccaccgccagcgattcccacagggtcccttccctccgtccctcgtcgctgggcctccgcgcccgaccagcctggaagtccgataacctggttttccggggggccgagccgaaaaaggacagccaccgaccgctcgctttcccgcacctcccccacctctcgccccctccctccctccctccagttgcaggatcagcatcgatgcgattcaaccgcggccgcgcatccagtgcagaggtctgcaattggggggtggaggctccgctccaccgccggaaccgctgcgcgtttgatttcctgctggctcttaatcccgcggggagcgatttgtatctctcggcattcctgtttgatggcagacggtagtgctgcttctctgaggagtcattgtggcaataggcagctgcgttgaacagcaatcctttcgcgggaggaattagaacaaatcaacggggacacagatcatggagcatgtgattggagggaagtacaagcttgtgaggaagattgggagtggatccttcggggagctgtatctcggtgttaatatacaga

SEQ ID NO: 39271 - protein, 30 aa, Panicum virgatum
  misc_feature: Ceres CLONE 1997598
  misc_feature: SWISSPROT Homolog: EC 2.7.11.1 Non-specific serine/threonine protein kinase
  misc_feature: The sequence is a functional homolog of SEQ ID NO 32 in US patent 7179962
MEHVIGGKYKLVRKIGSGSFGELYLGVNIQ

SEQ ID NO: 39272 - DNA, 669 bp, Panicum virgatum
  misc_feature: Ceres CLONE 1997601
  misc_feature: Encodes the peptide sequence at SEQ ID NO. 39273
gataaacgcgagccgagccgccaccctccgtttcatcagctcggctgcgaatccccggcgacctccctcgaagcttcctccgccggttgccggctgggcctcgaacctgcgagaagcttccggcgccggcccaccgagaaccgcaatggcgtccgccggcggagcggccatctccgcggggcccacgccgccgtcggcgacggcgacggcggtggagtggcaccagcggccgccgaacccgaagaacccggtggtgttcttcgacgtcaccatcgggtccatccccgccggccgcatcaagatggagctcttcgccgacatcacccccaagaccgccgagaacttccggcagttctgcactggcgagcacaggtatgagacttccggcaatttgttatcttcctggatgtgggcttattctgtggcgaattctgctaatctgactctatcctcatgttaaaccatataggttacacgtataagtttctatttactgatatttgtaatggttagcatggtcatttgattgggagttggtatgaacgaattttctatacattctgtgtaaaggaaagagtatcactgatgtgaagttgagcttatatgggggatgttttctagaacctagggcacttgaattttcaggcatacttactagctgatttaaca

SEQ ID NO: 39273 - protein, 104 aa, Panicum virgatum
  misc_feature: Ceres CLONE 1997601
  misc_feature: SWISSPROT Homolog: EC 5.2.1.8 Peptidylprolyl isomerase
MASAGGAAISAGPTPPSATATAVEWHQRPPNPKNPVVFFDVTIGSIPAGRIKMELFADITPKTAENFRQFCTGEHRYETSGNLLSSWMWAYSVANSANLTLSSC

SEQ ID NO: 39274 - DNA, 644 bp, Panicum virgatum
  misc_feature: Ceres CLONE 1997604-R
  misc_feature: Encodes the peptide sequence at SEQ ID NO. 39275
agaccatacccattaagtccagtggtgaacagtaccatcaaaacactgctggatagttcccacagctattacaggcttgaggagaaggatggtgtcctttatcttggctggaagaacagaaagctggttgtatcttctgcctggtgctgacatttccaattttggaagaagctttgtttaggttctttcatggctttgtgttcagcacatgaatccaaggtggaacctagagttctcaatgcagacttcaaaatcaaaaacaacttggttgcttccttgcttactgttgttgcccagctttcaaacagtcccatgctcaccatcttttggactcaatggttgtggctggtatactcatcatgactctcgcttacatcctcatctaggagcaagcaaacagtggttgccccaccttctactggtattaatattgcatgttggtagaaatctagtatcagcttccgaatctggattgctggaaccgtgcatgttgcatttaggttgacttgtacaatgctatacgagtctaaacttatgccgggttttcggtagtaggcacaagaagtgccattagtctgtatgtataacctgctgcagctcgtgtattgtactacttccatacagtatgggtgatttacttggat

SEQ ID NO: 39275 - protein, 49 aa, Panicum virgatum
  misc_feature: Ceres CLONE 1997604-R
  misc_feature: The sequence is a functional homolog of SEQ ID NO 474 in the 10/666,642 US patent application
  misc_feature: Useful for making plants with modulated light quality sensitivity
  misc_feature: Useful for making plants with modulated low light sensitivity
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
RPYPLSPVVNSTIKTLLDSSHSYYRLEEKDGVLYLGWKNRKLVVSSAWC

SEQ ID NO: 39276 - DNA, 1029 bp, Panicum virgatum
  misc_feature: Ceres CLONE 1997604
ctcgagtcctctctcgtcctgggtcctcgtcattctgttcccggcgacggtgagtgaggcagcggacgccgccaccaggcaccagtcccggttctcgaaccccctggtccccctccttgccttctccgtttccgcaggccggttgcctcttagcctcaccgcaccgccgggcgcaaacgcagccgtgccggcttccctccgcctctctactttttcgagcaagctccgcctctccagtggcggccctggcgtggtgtggagatcctcccggacttggattgctttcttctttcgctgttgatatcatcatgatgagcattttgtggtagacggcaagatcatctttgggttcaagcttatacctccttcccacaaggttgctctagaaaatatgtcgacacaggcctctaaccggtcgtacagatatccggacaatacccaaataccatactacaatggcaatctagtgccagttgggggcaatggtacttactatatgccacaaaatcatgatgatggtcactacatttcctctgatgacggatcgcagaacactaattctagagctcaaggttttcaagcacagtactgcaccctagactcgtcctcagccaattgtgtttatcctgcacataactctacctcttctcagagccaaagcgggagtcccctgtctcagcaagagagccactcagatcatgcatatggttcctctccaagtgcatcatgtgttactcaggttcccagttggacacttaaggatctagaaaatgtaatgctcggacctgattctgacataggcagccctgacagctccttactatctggcactgctttgcatgaaaacaattggagagagcttttgggaattaaaaccggggatttgaggcagttaattatagcatgtggtaaggcagttgatgagaatgcttgctatatggacgcactgatgtctgagttgaggcagatggtttctgtggctggtgaaccgatgcaacgactgggagcttatatggtggaagggctcat

SEQ ID NO: 39277 - DNA, 678 bp, Panicum virgatum
  misc_feature: Ceres CLONE 1997613-R
  misc_feature: Encodes the peptide sequence at SEQ ID NO. 39278
gaagatggacatataatgctatcagactttgacctctcactgaggtgctcggtgaatcctgtgctgcttcggtcatcctctgtagcagcaaaccaccaaccaaggaaacttgctggaccttgtgctgagaagtactgcatcaattcatcatgcctccagcagccctcttgtgcccaaacatcttgcttcacaccacgtctaccatcaattccaaagcctcggaagcctaaatcttcccagaaaaggctccctcagcttgttgtagagcctattgatgcacgctcaaattcctttgttggcacgcatgagtaccttgcaccagaaatcatcaaaggggatggccatggaagcgccgttgactggtggacctttggtgtcttcctttatgaacttttatatggcaagacacccttcagaggacctgggaacgatgaaacattggcaaatgtggtctcacagaatctccggttcccggacagtccagttgtgagtagcaacgccaaagacctcatcagaggtttgctggtgaaggagcctgagaacagacttggatcgttgagaggagctgctgagatcaagcagcatcctttctttgaaggcttgaattgggccctgatacggtctgctgctccgccagagacacaaccttgcaatgttgtgactcttgcgaaagagcgg

SEQ ID NO: 39278 - protein, 225 aa, Panicum virgatum
  misc_feature: Ceres CLONE 1997613-R
  misc_feature (17)..(198): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated light quality sensitivity
EDGHIMLSDFDLSLRCSVNPVLLRSSSVAANHQPRKLAGPCAEKYCINSSCLQQPSCAQTSCFTPRLPSIPKPRKPKSSQKRLPQLVVEPIDARSNSFVGTHEYLAPEIIKGDGHGSAVDWWTFGVFLYELLYGKTPFRGPGNDETLANVVSQNLRFPDSPVVSSNAKDLIRGLLVKEPENRLGSLRGAAEIKQHPFFEGLNWALIRSAAPPETQPCNVVTLAKE

SEQ ID NO: 39279 - DNA, 1338 bp, Panicum virgatum
  misc_feature: Ceres CLONE 1997613
ctgttccctctcgctctcttccctctccacgccttctccaaagccgccattcccaagagcagcagcagcagccgagttcgtctccccagaagtacccgacgaccccggctccactgggccgccgccgcctctccttccagcttggagatccgggccggcatttcttgggtggccactggttgctgcactagttataaaaaaggcctgcttttccgggagttccctggggttctcatctcggatgacgtctctgtgaaaggtgcaggtattgtagtatgacttgcatgctccggatgtccctgccggcatcgggctgagttgacggactccttgtttgtccgtgttgaatcagtctgctggagccatggggtcgtccggctgtagctccgagatagtggaatccatagaggaagaatttgacagtgcgcccattggtggatccagcttgctgcatattaaactcagggatgaggagaaacgcagcaaatgccatgattatcctgtggaagatgacctcgaccagcttcttaaagcgattgatagcagaacattccgtcgggcgcttagtcctgccagcacaggtggagatgcgctgggaaagagtgttctcaagaaaccagctaggtcagggttgtctcaaaatgcaggcattgggatatcctccaagactgttaatatgaagcaggcgctgagaaggctatgcatttcccaggcatcagaaatggctgcaatgaagaggctgtcgatgtcacctggatcttcaagttcatctgaagctgggactatccacaggctctatgcctctttgatggtccaaagtagtactgagggtcttctgcatgatgatgaaaagatgaacctgattgaaatatcgatcactcctgagaagatggataagagttcatctagaggtacgagcgagttcagtgaagactgtgaatttgagacagctgatggaagtgcagtcacctctatccgttctgtgtcttcaacctcagctgagattcggaagatcagaatccaagatgtcattagtggtgaccctattgataatgagagttccttggtggaaagtgataaattaggaagtaaagtttctgcagctactgctgatggctctcccagagtcccaatcttgagcaagcccatcactacgtccaggcttgtcaagccagtcttccgatgcaagacagctgttaagaagaaactgaaagaagaaccatcttcattgggtgattcttccaatagcacaaaattctgttcatcaaaggagtcaatctccctcgcatcaaccagctgctcttcaacatctagcattacaaatcccaccaactatgc

SEQ ID NO: 39280 - DNA, 493 bp, Panicum virgatum
  misc_feature: Ceres CLONE 1997614
  misc_feature: Encodes the peptide sequence at SEQ ID NO. 39281
ccccgccgccgccgcagcgtcctcgtctcgacccccacctccggccctcgtgaagcgcctcctcgaccgccaggagtgagagaagagatggcgggcaagggcgatgggtcggcgatggggatccacgtcggcatttcctgctcgtgcgtcggcgtgtggcatcgctaccgcatcgagatgatctccaaggaccaggggaacctcaccaccccctcggacgtcgccttcaccgagtgcgagcgcctcatcggagatgccgccaacaacctggtcgccatgaaccccatcaacaccgtctttgatgcctagcgtctcatcggcagaaggttcgctgatgcttctgtgccgagtgatatcaagctctggcccttcaaggtcatttctggacctggtgagaagcccatgattgttgtcatgcacaagggtgaggataagcattttgcagcagaagagatctcctccatggttctgatcaacatgcgagaaatagctg

SEQ ID NO: 39281 - protein, 73 aa, Panicum virgatum
  misc_feature: Ceres CLONE 1997614
  misc_feature: Useful for making plants with modulated heat sensitivity
MAGKGDGSAMGIHVGISCSCVGVWHRYRIEMISKDQGNLTTPSDVAFTECERLIGDAANNLVAMNPINTVFDA

SEQ ID NO: 39282 - DNA, 1127 bp, Panicum virgatum
  misc_feature: Ceres CLONE 1997622
  misc_feature: Encodes the peptide sequence at SEQ ID NO. 39283
acagttcacagtgaagagctccgagcctccactcccgacctcgagccgagcagagctttccccctccccctccctctcccgccgaagcccaaaccctaaaccctcgggcccaaatgccgaggccggctcccgcggttgcggcggcggccgcgctgctggcgatcctcgcggcggcggccccccgcggcgcgacggcgaagacgacgatcgagccgtgctcgggcgcggacgcgtgcccggcgctgctgggctacacgctctacgcggacatgaaggtctccgaggtggcggcgctcttcggcgccgacccggcggcggtgctggccgccaacgcgctcgacttcgcctccccgggcgccgccaaccgcatcctccccgcggggacgcctctccacgtgcccacccgctgcgcctgcgccgacggcgtccgcaagtccgtcgccgtccgctacgccgcccgccccgcggacacgctcggctccgtcgccgacgtcgtcttcgccgggctcccctccgccgaccagatccgcaccgccaacgggctcgccgcggaggaccccgacgcgccgctcatccccsggcagcagctcgtcatcccgctcccctgcgtctgcttcaactccaccgacaacracctccccgccgtgtacctctcctatgtcgtgcgggttggggacaccgtgcaatccatcgccgccagccacgccaccaccgtcacggatgtcagtaatgtgaacgcaatggggagccccatcgtcgcgcccggtgacatcctcgccattccattgccagcttgcgcatcagcatttcctaactctgcttcggactctggattgcttgtggcaaatgggacctatgcactaactgctggtaactgtgtggagtgcagttgtgggccagcgagtctcaagtaatgttataatataggaaacctatttgttcaatgcaattttcttgcggcagtctgttttggactataactataaccccacctttttccttacagtttgtactgcaccccagcgcctgcttcattaacagcatcatgttcaagtatgcaatgccccaatagcaacctaatccttggtaatggtgactgcacaacccaccattgctggttgccgtgt

SEQ ID NO: 39283 - protein, 266 aa, Panicum virgatum
  misc_feature: Ceres CLONE 1997622
  misc_feature (182)..(224): Pfam Name: LysM Pfam Description: LysM domain
  misc_feature (156)..(156): Xaa is any aa, unknown, or other
  misc_feature (174)..(174): Xaa is any aa, unknown, or other
MPRPAPAVAAAAALLAILAAAAPRGATAKTTIEPCSGADACPALLGYTLYADMKVSEVAALFGADPAAVLAANALDFASPGAANRILPAGTPLHVPTRCACADGVRKSVAVRYAARPADTLGSVADVVFAGLPSADQIRTANGLAAEDPDAPLIPXQQLVIPLPCVCFNSTDNXLPAVYLSYVVRVGDTVQSIAASHATTVTDVSNVNAMGSPIVAPGDILAIPLPACASAFPNSASDSGLLVANGTYALTAGNCVECSCGPASLK

SEQ ID NO: 39284 - DNA, 651 bp, Panicum virgatum
  misc_feature: Ceres CLONE 1997623
  misc_feature: Encodes the peptide sequence at SEQ ID NO. 39285
agcaagcaagcgcccccttctccttgctctgccgatcctcctccctcttcgaggcacaccgggcggggagagagagagcgagcgagaaagatggcgctgctgctcctgctcacggtcctcgcggcggcggcggtggtggcgagcagcctgctgctgcggtggaacgaggtgcggtacagccgccgccggggcctgccgccgggcacaatggggtggccgctcttcggcgagaccaccgagttcctcaagcaggggcccagcttcatgaaggccaggaggctgaggtacgggagcctgttccggacgcacatcctggggtgccccacggtggtgtgcatggacccggagctgaaccggcggacgctggccagcgagggcgccggcttcgtcccgggctacccgcagtccatgctcgacatcctggggcccaacaacatcgccgccgtgcacgggccgctccaccgcgccatgcgcggcgccatgctcgcgctcacccgccccgccatgatccgcggcgcgctcctccccaagatcgacgccttcatgcgcgcgcacctccacggctgggccggccgccgcgtcgacatccaggagatgaccaaggagatggccttgctctcagctctcaggcagattgctggcatctcggct

SEQ ID NO: 39285 - protein, 186 aa, Panicum virgatum
  misc_feature: Ceres CLONE 1997623
  misc_feature: SWISSPROT Homolog: EC 1.14.13.93 (+)-abscisic acid 8'-hydroxylase
MALLLLLTVLAAAAVVASSLLLRWNEVRYSRRRGLPPGTMGWPLFGETTEFLKQGPSFMKARRLRYGSLFRTHILGCPTVVCMDPELNRRTLASEGAGFVPGYPQSMLDILGPNNIAAVHGPLHRAMRGAMLALTRPAMIRGALLPKIDAFMRAHLHGWAGRRVDIQEMTKEMALLSALRQIAGIS

SEQ ID NO: 39286 - DNA, 684 bp, Panicum virgatum
  misc_feature: Ceres CLONE 1997626
  misc_feature: Encodes the peptide sequence at SEQ ID NO. 39287
attccatcactcgatcgctctcccactcacgtcacggctcacgggtcgccgtcgtcaacatggctcggagcttcagcggcatgatgagtccgacatcatcgtcgtcggtgccggcgacgctgctggtggtggtggtgctactgctggcgggcggctgccacggctcgccgccgctgaaggcgcacttctaccggcgcagctgcccggcggcggaggcggtggtgcgcgacatcgtggtggcccgcgtcgccgccgaccccgccgcgctccccgccaagctgctccgcctcttcttccacgactgcttcgtcagagggtgcgacgcgtcggtgctgatcgactcgacgccgggcacgggcggcagcgcggcggagaaggacgcggcgccgaacgcgtcgctgggcgggttcgacgtgatcgacaccgccaaggccgtgctggaggccgtgtgccccggcaccgtctcctgcgccgacatcgtcgcgctcgcggcccgcgacgccgtctccttccagttcgggcgggagctgtgggacgtgcagctggggcggcgcgacggcgtggtgtcgcgggcgtcggaggcggcggcgggcatcccctcgccgtcggacaacttcaccgccctcgaggccaacttcgccgccaagggcctcgacgtcaaggacctcgtcatcctctcccggt

SEQ ID NO: 39287 - protein, 208 aa, Panicum virgatum
  misc_feature: Ceres CLONE 1997626
  misc_feature (55)..(207): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MARSFSGMMSPTSSSSVPATLLVVVVLLLAGGCHGSPPLKAHFYRRSCPAAEAVVRDIVVARVAADPAALPAKLLRLFFHDCFVRGCDASVLIDSTPGTGGSAAEKDAAPNASLGGFDVIDTAKAVLEAVCPGTVSCADIVALAARDAVSFQFGRELWDVQLGRRDGVVSRASEAAAGIPSPSDNFTALEANFAAKGLDVKDLVILSR

SEQ ID NO: 39288 - DNA, 1222 bp, Panicum virgatum
  misc_feature: Ceres CLONE 1997628
  misc_feature: Encodes the peptide sequence at SEQ ID NO. 39289
gaattaattccaacggacagtctcgcgcatccaccccacccgcatctttacccaagcaaagcaagcgcccctcccttctcgtcccctcccctcccctcccctcttccccactcgattccgtaggattccgcgagcggatcggcgtctcgccgtagcacgcagaagcagaagtaggaggccatggagatgctgcggcggaacctgaagcggcaggcgtcgcgctcgctctccgcattcgccggcggggccacctccccgcgcgccgcggaccaggagaacctccaccccaacctcgcctcctcgccgccggcgtcgcccgccgccaagggcgccgcctcgccgcgccccaagcacccagcgcacgcggctgccgctcccccgccgacggccaccgccgaggaggatcgcgccgcgggcgccgcaccagccgacaacgagccctccgtcaaggtggtggtgagggtgcggccgacggtgagccggccggtggacggcaaggatctgtggtttgtccgcaagaccgctccggacgccgtcgctgtcggcgaccggtccttcgcggttgatggcgtcctcgacgacagggccacgcaggccgatgcgttcgatctggttgggttgcccttgatcgagaacgccctggccggattcaacacatccctcgtctgctacggccagagcggcactggtaagacatacaccatgtgggggcctctcggcgccatggttgacagcggctctgaccacactgaccgtggtgtcgtgcctcgggttttccagaacctcttctctcgaatccaaagagcgcaagagagctctcctgagaagcagaccagctaccaatgccggtgctcgttccttgaggtacataacgagcagatcaatgatctgttggaaccatctcagcgtgacctgcagataagagagaatgctggcaatggtatccatgtcgaaaacttgaccgatgagtatgtgtcaacggtagaggatatcaatcagattttgatgaagggactttcaaataggaaagttggcaccaccagtatgaacttgaaaagttcacgttctcatgtgatattcacctgcgttattgaagcatggagcaagggttcatcgaatggatttagtagttcaagaactagcagaattacttttgttgaccttgctggccctgaaaatgatgaccttgaaggtgcagcaaagaatagtacaaaggaggaaa

SEQ ID NO: 39289 - protein, 347 aa, Panicum virgatum
  misc_feature: Ceres CLONE 1997628
  misc_feature (94)..(345): Pfam Name: Kinesin Pfam Description: Kinesin motor domain
MEMLRRNLKRQASRSLSAFAGGATSPRAADQENLHPNLASSPPASPAAKGAASPRPKHPAHAAAAPPPTATAEEDRAAGAAPADNEPSVKVVVRVRPTVSRPVDGKDLWFVRKTAPDAVAVGDRSFAVDGVLDDRATQADAFDLVGLPLIENALAGFNTSLVCYGQSGTGKTYTMWGPLGAMVDSGSDHTDRGVVPRVFQNLFSRIQRAQESSPEKQTSYQCRCSFLEVHNEQINDLLEPSQRDLQIRENAGNGIHVENLTDEYVSTVEDINQILMKGLSNRKVGTTSMNLKSSRSHVIFTCVIEAWSKGSSNGFSSSRTSRITFVDLAGPENDDLEGAAKNSTKEE

SEQ ID NO: 39290 - DNA, 1244 bp, Panicum virgatum
  misc_feature: Ceres CLONE 1997633
  misc_feature: Encodes the peptide sequence at SEQ ID NO. 39291
gtaacccccccggcgcccctccctctccctccgaccagtgaccaccgcggcgccggtggccggataagctcgccaggccgacagagcggcggatggacgcgcgacgggtcggaggccgcatcgcggcggcgcggagggcgctcgccgcggggggctcgctgcccgtccccgtgttgcggatcaccaacggcctggcgatgatctcgctcgtgctctcctcctgcgacctgctccgcctctgcagcgacaggagccgcccgctcggcttcccgctcggcggccgcgagttcgccaccgtgctgtgccagctcgcctccgtcgtctacctcctcagcctcttcggcgccccctccggctccgggcaccccaaggcccccgccagcgacgacgagggcgccggctccccgcgccgggctcgcgccgccgacgccgacgcgcctgcggcaatgcatgccggcgtggagggcggggacgacgaggagatcgtcgcgactgtggtgtccggggcgctgccgtcgcaccacctggagtcgagcctcggggactgccgccgcgcggccaggctgcggcgggaggcgctccggcgggtcacggggcggggcgtcgaggggctcccgttcgacgggatggactaccaggccatcctggggcaatgctgcgagatgcccgtcggctacgtgcaggtaccggtgggggtcgccggcccgctgctcctggatgggcgccagtaccacgtccccttggccaccaccgagggatgtctcgtcgccagcgtcaaccgcgggtgcagggccatcgccgcgtccgggggcgccgtgagcgtgctgctccgggatgccatgtcccgcgcgcccgtcgtcaagctgccgtccgccaagagggccgcggagctcaagtcgttcgtggaggcagctgccaattttgagactttggcttctttcttcaataggtctagcagatttggcaggcttcagggtattcggtgtgcactcgctggtaggaacctttacattaggttcacttgtagcaccggagatgcaatgggaatgaatatggtgtcaaaaggtgttgagaatgtcttgggctacctgcagaatgatttccccgacatggatctcatcagcctgtctggtaattactgttcagacaagaaacctacagcagtaaactggatagaaggtcgtgggaaatctgttgtttgtgaggctacaatcaaaggaggggttgtgcagagtgttcttaag

SEQ ID NO: 39291 - protein, 383 aa, Panicum virgatum
  misc_feature: Ceres CLONE 1997633
  misc_feature (139)..(383): Pfam Name: HMG-CoA_red Pfam Description: Hydroxymethylglutaryl-coenzyme A reductase
  misc_feature: SWISSPROT Homolog: EC 1.1.1.34 Hydroxymethylglutaryl-CoA reductase (NADPH)
MDARRVGGRIAAARRALAAGGSLPVPVLRITNGLAMISLVLSSCDLLRLCSDRSRPLGFPLGGREFATVLCQLASVVYLLSLFGAPSGSGHPKAPASDDEGAGSPRRARAADADAPAAMHAGVEGGDDEEIVATVVSGALPSHHLESSLGDCRRAARLRREALRRVTGRGVEGLPFDGMDYQAILGQCCEMPVGYVQVPVGVAGPLLLDGRQYHVPLATTEGCLVASVNRGCRAIAASGGAVSVLLRDAMSRAPVVKLPSAKRAAELKSFVEAAANFETLASFFNRSSRFGRLQGIRCALAGRNLYIRFTCSTGDAMGMNMVSKGVENVLGYLQNDFPDMDLISLSGNYCSDKKPTAVNWIEGRGKSVVCEATIKGGVVQSVL

SEQ ID NO: 39292 - DNA, 1908 bp, Panicum virgatum
  misc_feature: Ceres CLONE 1997659
  misc_feature: Encodes the peptide sequence at SEQ ID NO. 39293
agccggagagtcggagacgatgatgggttctcgcgatcgcctcgtctccctcctcttcgccttactcctcgcgcgcgtcgccgaggccgggccgaccgccgccgccaccgccgctggcagcaggtacctgaccacggacgagcggtggatgaagcagcgcctcgaccacttctcccccactgaccaccggcggttcaagcagcgctacttcgagttcctcgactaccaccgcgccccaggcgggccgatcttcctgcgcatctgcggcgagtccgcctgcggcggcatccccaacgactacctggccgtactcgccaagaagttcggcgcggcggtggtgacgccggagcaccggtactacggcaagagctccccgttcaggcggctgaccaccgggaacctgaggttcctgtcgtcgaagcaggccctgttcgacctcgccgtcttccgccagtactaccaggaatccttgaatgctaggtacaaccgcacgggatttgacaatccttggttcgtcatcggggtctcctactccggcgctctcagcgcctggttcaggctcaagttcccccacctgacatgtgggagcctggcgagctcaggggtggttcgtgcggtgtacaactacactgactttgacaagcaggttggagagtcggctggccctgagtgcaaagctgcccttcaagaaacgactagacttgttgagcaacagcttctgtcagacagccgttcggtgaagaccttatttggggcacagacgttgaaaaatgacgacttcctctacttactggcagatgccgcagcagaagcattccaatatgggcaccctgatgctgtgtgcactcctctagtaaatgcaaagaagaatgggaaaaacttggtggacacatttgctcaaattgtgagagtcttttatgtcaaagaaatggagacaccggtatcttcatatgatcaggagtacctgaagaaaacaactcccgacgattctagttctcgcctctggtggttccaagtttgcagtgaggttgcctactttcaagtggcacccaaaactgatagtgttcgttctgcaagtatcaacacaaagtaccatttggatctatgcagaaatgtttttggggaaggcgtttatcctgatgtgtccatgacgaacttgtattatgggggcacaagaattgctgcttctaaaattgtgtttacaaacggctctcaagatccatggcgacatgcctccaagcagaaatcatsgaaagacatgccttystacttgatgaaawgcagcaattgcggacagggcactgatttgaggggctgtcctcaaagtcctttcagaatccaaggggactcttcaaactgctcatctcccgcagcagtcaatacagtgagaaagcagatcgccaagtacattgatctctggttatcacagtgccaaaaaccatcagcgtcaggggagtggtaaccacgaattgctgacccgtttggaaagagtaaacggaggatttgcagatcctggagtaatctggtgcgtgtcggacgacatgtgcaaccagttttttttagataaaggaaatatcttcggcctgtgcagccgcacacagccaacatgcgcaaccagttcggctgcagaattgcacataggtgaggtgatggatagccctttccgtgactggaagtctggaagaaaactaagtcagacgaataggagggaccagagaatccaccacattaccacaaccacaagggtctcgtcggattgcattgcttgccaaggattcaccttctgaccctaggcgaataaactcagctttaataataaagacgataacatcgtggtatttgaatgtataggaccgagtgaacgtgtcgtccgtactctgttcaagaattttagtgccgtttgcgatc

SEQ ID NO: 39293 - protein, 480 aa, Panicum virgatum
  misc_feature: Ceres CLONE 1997659
  misc_feature (46)..(460): Pfam Name: Peptidase_S28 Pfam Description: Serine carboxypeptidase S28
  misc_feature: SWISSPROT Homolog: EC 3.4.14.2 Dipeptidyl-peptidase II
  misc_feature (411)..(411): Xaa is any aa, unknown, or other
  misc_feature (416)..(416): Xaa is any aa, unknown, or other
  misc_feature (421)..(421): Xaa is any aa, unknown, or other
MMGSRDRLVSLLFALLLARVAEAGPTAAATAAGSRYLTTDERWMKQRLDHFSPTDHRRFKQRYFEFLDYHRAPGGPIFLRICGESACGGIPNDYLAVLAKKFGAAVVTPEHRYYGKSSPFRRLTTGNLRFLSSKQALFDLAVFRQYYQESLNARYNRTGFDNPWFVIGVSYSGALSAWFRLKFPHLTCGSLASSGVVRAVYNYTDFDKQVGESAGPECKAALQETTRLVEQQLLSDSRSVKTLFGAQTLKNDDFLYLLADAAAEAFQYGHPDAVCTPLVNAKKNGKNLVDTFAQIVRVFYVKEMETPVSSYDQEYLKKTTPDDSSSRLWWFQVCSEVAYFQVAPKTDSVRSASINTKYHLDLCRNVFGEGVYPDVSMTNLYYGGTRIAASKIVFTNGSQDPWRHASKQKSXKDMPXYLMKXSNCGQGTDLRGCPQSPFRIQGDSSNCSSPAAVNTVRKQIAKYIDLWLSQCQKPSASGEW

SEQ ID NO: 39294 - DNA, 640 bp, Panicum virgatum
  misc_feature: Ceres CLONE 1997663
  misc_feature: Encodes the peptide sequence at SEQ ID NO. 39295
gatatttgtgccgcgccgcccaaagcgcatacggcatatcccttcctcgccccgccgcccccccgtgcgcgctccccgccccccgctgccccgccagccagctaggtctcgcgcgccgctcacgcccgcggccgcttctagggttagggttccacgccgaggcggcggagatgggcgtgccggcgttctaccggtggctggcggagaagtacccgatggtggtggtggacgtggtggaggaggagcccgtcgagatcgagggcgtccgggtccccgtcgacacctccaagcccaaccccaacggcctcgagttcgacaacctctacctcgatatgaacgggatcattcacccctgcttccaccccgaggacaggccctccccgacaaccttcgccgaggttttccagtgcatgtttgattacattgatagactcttcgtcatggttcgtcctaggaaacttatgtacatggccatcgatggagtggctccacgtgctaagatgaaccagcagcgttctaggcggttcagagctgcaaaagatgcatctgatgcggctgcagaggaagaacggttgcgtgaagagtttgagagggaagggagaaagcttcctgcaaaacagcaatcacaaacttgtgattc

SEQ ID NO: 39295 - protein, 156 aa, Panicum virgatum
  misc_feature: Ceres CLONE 1997663
  misc_feature (1)..(156): Pfam Name: XRN_N Pfam Description: XRN 5'-3' exonuclease N-terminus
MGVPAFYRWLAEKYPMVVVDVVEEEPVEIEGVRVPVDTSKPNPNGLEFDNLYLDMNGIIHPCFHPEDRPSPTTFAEVFQCMFDYIDRLFVMVRPRKLMYMAIDGVAPRAKMNQQRSRRFRAAKDASDAAAEEERLREEFEREGRKLPAKQQSQTCD

SEQ ID NO: 39296 - DNA, 1027 bp, Panicum virgatum
  misc_feature: Ceres CLONE 1997667
  misc_feature: Encodes the peptide sequence at SEQ ID NO. 39297
agcgacgaacaactcatcactggattcgcagagcggaagcggcggcgaagcaggggcacgatgcgcaagtgggcgctctcctccgcgctcctcctcctcttcctcctcaccactctccccgatccagctaagaagctgcaagtgaatgctgaggagagcggtgatgacctagccaatccaccaaaggtagaggagaagcttggtgctgttcctcatggcctgtccaccgactctgaggttgcccagagggaagccgagtcaatctcgaggaagaccctcaggagctcagcggagaagtttgaattccaagctgaggtgtccagacttatggacatcatcatcaactcgctctacagcaacaaggacatcttcttgagggagctcatctccaatgcctctgatgccttggataagattaggttcctgtcccttaccgataaggaggttctgggtgaaggtgacactgctaagcttgaaatccagattaagttggataaagagaagaagatcctctccattcgggataggggtattggtatgaccaaggaagacctgatcaagaacctcggaaccattgcaaaatctgggacctctgcttttgtggaaaagatgcagtctggaggtgacctcaatctgattggacagtttggtgttggtttctattctgtgtacttggttgctgactatgtcgaagtgatcagcaagcactatgatgaccaacagtacgtgtgggaatccaaagctgatggagcatttgctatctctgaggatacatggaatgagccccttggacgtggaactgagataagactgcatctgcgagatgaagcaaaggagtacctggaagaggataagctcaaggatttggtgaagaagtactctgagttcatcaatttccccatttatttgtggacaaccaaggaggttgatgttgaagtgccagctgatgaggaggaattccagtgaagaagaggaatccaccctggaagctaaggaggatgaagacacagaagaagatgaagagaaa

SEQ ID NO: 39297 - protein, 301 aa, Panicum virgatum
  misc_feature: Ceres CLONE 1997667
  misc_feature (100)..(256): Pfam Name: HATPase_c Pfam Description: Histidine kinase-, DNA gyrase B-, and HSP90-like ATPase
MRKWALSSALLLLFLLTTLPDPAKKLQVNAEESGDDLANPPKVEEKLGAVPHGLSTDSEVAQREAESISRKTLRSSAEKFEFQAEVSRLMDIIINSLYSNKDIFLRELISNASDALDKIRFLSLTDKEVLGEGDTAKLEIQIKLDKEKKILSIRDRGIGMTKEDLIKNLGTIAKSGTSAFVEKMQSGGDLNLIGQFGVGFYSVYLVADYVEVISKHYDDQQYVWESKADGAFAISEDTWNEPLGRGTEIRLHLRDEAKEYLEEDKLKDLVKKYSEFINFPIYLWTTKEVDVEVPADEEEFQ

SEQ ID NO: 39298 - DNA, 1154 bp, Panicum virgatum
  misc_feature: Ceres CLONE 1997669
  misc_feature: Encodes the peptide sequence at SEQ ID NO. 39299
caccttcgcatcctgcgcgtcgcgtcgcctcgccgtcgaaatccacgccggcgcaaccaggtcacgcctccgcgccccctgccccccctccggctccgacgatgtcggcgccctccgaccccgccgcggcccccgcccccgcggccgcctcctccagcagcggcctcaccttcaagctccaccccctcgtcatcgtgaacgtctcggaccaccacacccgcgtcaaggcccaggccgcctgctccggggacagctcctcctcgtccggggcggcggcggcggcggggcagcccccgagggtgttcgggtgcgtgatcggggtgcagcgcgggcggacggtggagatcttcaacagcttcgagctcgtgctcgaccccgtctcgggcaccctcgaccgcgccttcctcgagaagaagcaggagctctataagaaggtgttccctgatttctacgtgctgggctggtactccactggaagcgatgtgcaggacactgacatgcaaatccacaaagccttgatggacgttaacgaaagccctgtttatctactattaaatcctgcaatcaacctctcccagaaggatctccctgtgactatctatgagagtgagttgcatgtcatcgacgggagtcctcagctcatctttgtcagatcaaattataccattgagactgtggaggctgagaggatatctgtagaccatgtggcccatctcaaaccatctgatggcggctcagcggcaactcaattggctgctcatcttacaggaatacacagtgccatcaagatgctcaatagcagggtctgtgttatccatcagtatcttgttgccatgcaaaaaggtgatgttccagtggataattcgctgcttaggcaagtctcaagcctcgtaagaaggctaccagctatggaatcacagaaattacaagatgacttcttaatggaatacaacgacactctcctcatgacttaccttgctatgttcactaactgttcaagcacaatgaacgagttagttgagaagatcaacacaagctatgagagacctgcaaccaggagaggagggcgaggtgctttcatgtagcttaccttccaatcagtgactgctgctctcagctgtgaaaatttttggaaatagtttcttgtatcccga

SEQ ID NO: 39299 - protein, 327 aa, Panicum virgatum
  misc_feature: Ceres CLONE 1997669
  misc_feature (19)..(145): Pfam Name: Mov34 Pfam Description: Mov34/MPN/PAD-1 family
  misc_feature: Useful for making plants with modulated biomass
MSAPSDPAAAPAPAAASSSSGLTFKLHPLVIVNVSDHHTRVKAQAACSGDSSSSSGAAAAAGQPPRVFGCVIGVQRGRTVEIFNSFELVLDPVSGTLDRAFLEKKQELYKKVFPDFYVLGWYSTGSDVQDTDMQIHKALMDVNESPVYLLLNPAINLSQKDLPVTIYESELHVIDGSPQLIFVRSNYTIETVEAERISVDHVAHLKPSDGGSAATQLAAHLTGIHSAIKMLNSRVCVIHQYLVAMQKGDVPVDNSLLRQVSSLVRRLPAMESQKLQDDFLMEYNDTLLMTYLAMFTNCSSTMNELVEKINTSYERPATRRGGRGAFM

SEQ ID NO: 39300 - DNA, 713 bp, Panicum virgatum
  misc_feature: Ceres CLONE 1997671
  misc_feature: Encodes the peptide sequence at SEQ ID NO. 39301
acaaatcacccccacccacctccacctgggcacctggccaccttcccatcttgtgcgcgcgcgggtacctgcagcgactgacggggagcaatggagaaggccatcgacaggcagcgggtcctgctgcggcacctcgaccccgcggcggcggcgccgggccccgcccagcccgccatctccgcgagcgcgtgcgcggcgggggacagcgcggcgtaccaccggagggcggccttcgccgacgacgtcgtcatcgtcgctgcatacaggacggcgatttgcaaggccaagagagggggtttcaaggatacgttcgctgaggacctattggttcctgtcttcaaggctttagtagataaaacaaagctgaaccctagcgaagttggcgacatcgttgttggtactgtcttagctcctgggtcccagagggcaatcgaatgcagaatggcagcactgtatgctggtattcctgacactgttcctctgaagactgtaaacaggcaatgctcttctggccttcaggcagttgcagatgttgctgctgctattaaagcagggctgtatgatattggtattgctgctggcctcgagtccatgacagtgaacaaagttagtcttgacggtcaagtgaatcccaaagttgagctattttctcaagcacgtgattgccttctcccaatgggcctcacatctgagaatgttgcacaccggattcg

SEQ ID NO: 39301 - protein, 207 aa, Panicum virgatum
  misc_feature: Ceres CLONE 1997671
  misc_feature (49)..(207): Pfam Name: Thiolase_N Pfam Description: Thiolase, N-terminal domain
  misc_feature: SWISSPROT Homolog: EC 2.3.1.16 Acetyl-CoA C-acyltransferase
MEKAIDRQRVLLRHLDPAAAAPGPAQPAISASACAAGDSAAYHRRAAFADDVVIVAAYRTAICKAKRGGFKDTFAEDLLVPVFKALVDKTKLNPSEVGDIVVGTVLAPGSQRAIECRMAALYAGIPDTVPLKTVNRQCSSGLQAVADVAAAIKAGLYDIGIAAGLESMTVNKVSLDGQVNPKVELFSQARDCLLPMGLTSENVAHRI

SEQ ID NO: 39302 - DNA, 1714 bp, Panicum virgatum
  misc_feature: Ceres CLONE 1997675
  misc_feature: Encodes the peptide sequence at SEQ ID NO. 39303
atctctactacagtggccgcctctcctcccccatcttcttccccttctcttctggcaagaacacaagcaaaaagaagatcagagattcttttcttggcgtctggaataaaagtaagtagatgagaagctagtagggaagggaggaggagatgcaaacggagactagaaccacgaagcaatagagcaatatcagtagattactcactctgcaatcctgcggcattagcgtgtacgaccaagcagcgtggttcttgggcactatagaaagatgccaagattcgacctcgctgcatccatgcttctctgctcagaggacagcaccgccattttcgaccttgaggaggagagcgaggacatttcgtgggttcttcggccgccgtcgcgccacgccgacgcttcttctgggttcttgctgattgactttccgctgcagtcggagagcttcatcgatgagctcctggagagggaggaggggcacctgcccatggagggctacgcccagcggctcctgcagcaacctggcgggttggatttggtggccgtcaggagcgccgccatcgactggatttggaaggtccatgagcattacaagttcggacctttgacggttgtcttgtctgtgaactacctagatcggttcctctctttgttcgatcctgcgctaggggaagcttgggtgacacaactcttagcagtgactgtattgtccttggctgcaaaaatggaggaaactattgtcctagatcctttagacttgcaggtggtcgatgcggaatatgtatttgatcctacgactgtgcacaggatggagcatttggtgctcaataccctgagttggaggatgcaagctgtgactgcttgctcatttattgactattatcttcacaaattcagtgatggtgatgcagtatccgaaatcgtacttgctcgctcaattcaacttatcttgagcacatctaaagctgctgaattcatggcattcaaaccgtcagagattgccgcaagtgtggctcttgtggcattggggaaatatgacagttcaatacttgagagtgtggtgacttgttgcaaacaattaagaaaggagaggatattaggatgctatgaagtgattcaagaaaagattgttatgggaaacattattctcaagtcaactggctctcccgttttccccgagcagcatagccccataggtgtgctggatgtagctgcatgcgaaagccaacaaaatgatggtgtcagtgtaggaatggctctagtacgcgatgaagctccatcagcaagcaaaaggagaaggatttgcagatgattggtctcatggccaggtgcttcactctccaactattgcttcaagcatgtcaatctaattcasccmctcggaagaattggtatgtccaggctgttttgaggattcaaagaagcaagagaaaatatggmccgtgtttcccccccccccccctaatggcaaaagccaattgacttgcagcggagttttagctttttcgcagtttacatgagtcttgggcgtgcaaaactatttgatggtccggtgatggtattggttattggctgattggttgaggtagatagcggaattgaaccatgaactccgagtgctgtagagatgagagttcttttgttgcattttgtattcatgctcacttctttgcttttgtgataacctgggagagggatgctttgatgtgggtaatgg

SEQ ID NO: 39303 - protein, 346 aa, Panicum virgatum
  misc_feature: Ceres CLONE 1997675
  misc_feature (58)..(193): Pfam Name: Cyclin_N Pfam Description: Cyclin, N-terminal domain
MPRFDLAASMLLCSEDSTAIFDLEEESEDISWVLRPPSRHADASSGFLLIDFPLQSESFIDELLEREEGHLPMEGYAQRLLQQPGGLDLVAVRSAAIDWIWKVHEHYKFGPLTVVLSVNYLDRFLSLFDPALGEAWVTQLLAVTVLSLAAKMEETIVLDPLDLQVVDAEYVFDPTTVHRMEHLVLNTLSWRMQAVTACSFIDYYLHKFSDGDAVSEIVLARSIQLILSTSKAAEFMAFKPSEIAASVALVALGKYDSSILESVVTCCKQLRKERILGCYEVIQEKIVMGNIILKSTGSPVFPEQHSPIGVLDVAACESQQNDGVSVGMALVRDEAPSASKRRRICR

SEQ ID NO: 39304 - DNA, 1318 bp, Panicum virgatum
  misc_feature: Ceres CLONE 1997684
  misc_feature: Encodes the peptide sequence at SEQ ID NO. 39305
attcacaaaaggccagagccagagccagagggcggcggctggcggcgctctaaaaaagagagcgagagatcccctgccggcagccggccctgcgcggcttcgcctcttccccgacggtggcctctccagttccttactagtcttcccggcggccggcgttgtgcctactccacgctccttggtcccccgacgggtggcgcatcttctcttgtctggctgtctccctggttctgtgccgccgtggcacagcaggctgcagatccggccggcaggcagaggctcccaacgtcagctcaagcagaggccggcaagcagcagcaagcaccaagcgcaagctcaagcagactactgtctgcatctgcactctacagaagcttccggacggcaagacatggcaaacggtgagtgcctaaattagaaaatccatgcgtattgctgtactgaatgtgaagtggagatctagtcctattaggaatttaggatcccgtcaaggtagatagatttttttattaattagtcactgcattgccgttttctagttctgaaggtcggagttagtttgcaaattgcaagtgcatattttagtttatattcttacattgcgtaactatgcagtactcagctcaaatattaatatagttcctagctcagttcttccatgtattattgactatcttcgtcactattatttctttgcatatgcagtaggttcttcagacaccccaactccaactgacagcagctcaaacccaacgcctagtgttcaggtagcagtagaagcaaagacaagaagaaaaactgatccagcatggggttattgtacacaatttactgaagaaggaaaaaagaagatcaagtgcatgtactgtaacatggtttttggtggaggcggcatccatcgcttcaaggaacatctagcccattacccaggaaacagcaaggcatgttcaaaggttgatcctgaggttcaacatactatgttacagcatatcgaagaatggaacgataagaagaggaaggcacatgaggattttgaggaagaccacccatatgggcgagaacctggagaagaagaagaagcagcagcttgtgatgcctcaaagagtggtacagcagccccccaacctcaccgtgctacagcaatcagaggaagaaaaagaggcactagtactcctagtattggcaagtacttcaagcccagaaccaatccaggagatcagcctacaataaatagagtgcttcaaggagaagctgtgaagctaaagactgatttgtgtgtgacaaaatggtttattgatgcatctatttcatttaatgc

SEQ ID NO: 39305 - protein, 152 aa, Panicum virgatum
  misc_feature: Ceres CLONE 1997684
  misc_feature (1)..(37): Pfam Name: zf-C2HC_plant Pfam Description: Protein of unknown function, DUF1544
MYCNMVFGGGGIHRFKEHLAHYPGNSKACSKVDPEVQHTMLQHIEEWNDKKRKAHEDFEEDHPYGREPGEEEEAAACDASKSGTAAPQPHRATAIRGRKRGTSTPSIGKYFKPRTNPGDQPTINRVLQGEAVKLKTDLCVTKWFIDASISFN

SEQ ID NO: 39306 - DNA, 1506 bp, Panicum virgatum
  misc_feature: Ceres CLONE 1997716
  misc_feature: Encodes the peptide sequence at SEQ ID NO. 39307
ataccgagagcgaggaaccagagagaggtggccccaccttccccacgcctcagtgagcctgcgcgcgatctctttctccgccgccgcatccgatctcgatccccccccgacgcggcgagtcctccggtcagcgccgccgcctcctcccctctcctgccgccgccgtcgccgccatgaactatatcattggagcattcaagccaccatgtgacatctcgattacattctctgatgcgaggaccaggaagcaggtttctgttaagaaggacaacgggaagacaacaatggtccctgttttccagagcctggaaacaatctctggagaagtatcgatagcaccagtcccaggtaaaaggattgaacacatgggtgttaagatcgagttgctgggccaaatagagctgtattttgaccgagggaacttctatgacttcacttcattagtgcgcgagttggaagttcctggtgaaatctatgaaagaaagacatacccatttgagttttcaactgttgaaatgccatacgagtcttacaatgggacaaatgtcagactgaggtacattttgaaggtgactattggcagaaactatgttgggaatattgtggaataccgggatttctgtgtaagaaactactctcctgtccctacaatcaataatagtattaagatggaagttggaattgaggattgcttacatattgagtttgagtacagcaaaagcaaatatcatctcaatgatgtgattattgggaagatatacttccttcttgttagaataaagataaaaaatatggagctggagattcggcgtagggagtcaacagggtcaggctctaacacatatgttgaaactgagactcttgctaagtttgagctgatggatggtgctcctgtcagaggtgagtctattccagtgaggctgttcctgacgccttatgagctgacaccaacttaccgcaacataaacaacaaattcagcgtcaaatactacctgaatctggtccttgtggatgaggaagataggaggtacttcaagcagcaagagatcacaatgtaccgtctcctagaatctgccccgtcttcctagatcctggcctggagcagcatgatgtttacctctcaggttttgtataattgagtgctgaggttagagcgacgttgtgttacctgtatataactccagaagagcgccgctgttgactgctgctatggccatgcatgctgtcgtgttgtttgtgttctttttttttcctgctccttaccttgctttaccttgcttatggtctatggcaccgtggttagctgggggtgctagtgaatcacctgcctctatttacttaccattctcgtgaggcttctacaagaatcatgtttgatctgtcgatatttttctgcgggatgttagtttagtctgacagtaatgtaatatgttttggtaagttgaacaatgtagaatttacttggattgccctgttaggtagcagattgtttgtgtttccctcatc

SEQ ID NO: 39307 - protein, 304 aa, Panicum virgatum; identical to SEQ ID NO: 30164
  misc_feature: Ceres CLONE 1997716
  misc_feature (8)..(283): Pfam Name: Vps26 Pfam Description: Vacuolar protein sorting-associated protein 26

SEQ ID NO: 39308 - DNA, 647 bp, Panicum virgatum
  misc_feature: Ceres CLONE 1997733
  misc_feature: Encodes the peptide sequence at SEQ ID NO. 39309
aagaaagatagactgctagagtgacaaggcacaggctaagcgcgcgcgcacgcacacacgccgaagataccttccccttgtcactctcgcacggacattgccaacacgaaccagctagcagcatatggctcgcgtactcttgctggtgttgttattggccacgctctcgagcatcctgccgccgtccgcgagccaggcggcgaccaggtgcgagtacccgaggcacgccgggcacgggtacaaacacccggtgggcgtgctgaaggtggtcgtggacgccggcggcgccggcgacttcacctccatccagcaggccgtcgattcagtgccggtgaacaacaccgtgcgtgtcatcatgaagatcaacgccggaacctacagagagaaggtgctggtgccggcgtcgaagccgtacatcacgttccacggcgccgggcgcgacgtgacggtggtggagtggcacgaccgtgccagcgaccgcggccccgacgggcagccgctccgcacctacaacaccgcctccgtaaccgtcctctctaactatttcaccgctaagaacatcagcttcaagaacacagctccggcaccgatgcccggcacgcagggggggcaggcggtggcgttccgcatctccggcgacaaggcct

SEQ ID NO: 39309 - protein, 174 aa, Panicum virgatum
  misc_feature: Ceres CLONE 1997733
  misc_feature (47)..(174): Pfam Name: Pectinesterase Pfam Description: Pectinesterase
  misc_feature: SWISSPROT Homolog: EC 3.1.1.11 Pectinesterase
  misc_feature: Useful for making plants with altered cell wall content and/or composition
  misc_feature: Useful for making plants with altered carbohydrate content
MARVLLLVLLLATLSSILPPSASQAATRCEYPRHAGHGYKHPVGVLKVVVDAGGAGDFTSIQQAVDSVPVNNTVRVIMKINAGTYREKVLVPASKPYITFHGAGRDVTVVEWHDRASDRGPDGQPLRTYNTASVTVLSNYFTAKNISFKNTAPAPMPGTQGGQAVAFRISGDKA

SEQ ID NO: 39310 - DNA, 644 bp, Panicum virgatum
  misc_feature: Ceres CLONE 1997736
  misc_feature: Encodes the peptide sequence at SEQ ID NO. 39311
ttgttggccttcgggatcggagtaatgattaatagggatagtcgggggcattcgtatttcatagtcagaggtgaaattcttggatttatgaaagacgaacaactgcgaaagcatttgccaaggatgttttcattaatcaagaacaaaactccgtctccctgaggcccgaaccccgccgccggcccccgtcctcgtcctccccgactccccgtccccatctaagcacgcgtccgtgtcctcccgcccgcctcgccagcgccgtctccgtccgcgggcagcctccactccattgcgtcggcgtcctctccgtcctccccatccgcacccaggccaggagttctctgttcaacacccaacgcaaatcctatttaacccagatccgaccacgctacccccacaccgcgccagcgccgcctccgtccccccgccgcagcagctatggtgtacgtggattcgtgggacgagttcgtggagcgttccgtgcagctcttccgcgccgaccccagcgccacccgctatgtgatgaagtacaggcactgcgaggggaagctcgtgctcaaggtcaccgacgaccgtgagtgcttgaagttcaagacagatcaagctcaggatgcaaagaagatggagaaagctccacaacatct

SEQ ID NO: 39311 - protein, 68 aa, Panicum virgatum
  misc_feature: Ceres CLONE 1997736
  misc_feature (2)..(67): Pfam Name: SRP9 Pfam Description: Signal recognition particle 9 kDa protein (SRP9)
MVYVDSWDEFVERSVQLFRADPSATRYVMKYRHCEGKLVLKVTDDRECLKFKTDQAQDAKKMEKAPQH

SEQ ID NO: 39312 - DNA, 1826 bp, Panicum virgatum
  misc_feature: Ceres CLONE 1997745
  misc_feature: Encodes the peptide sequence at SEQ ID NO. 39313
gtcttcctgcagtaacttctcctcttcctctcgccaaaagggaaaaaaaaaaatctcatcttcctcgctggcaaagagagggagagggcgaagggttcagtagcttcttccgcgcgcttgtctccttcccggcggcgtcttctccggtcgtccggaagaggccgtggcactcaaggaagtgctccaggcaggacactccatggagatcgacgcaaaaggaaagcggccccgtgcaagcagcagcagcttgaccggcggcgactggctgagctccctgccggattgcctcatccaccacatcatgtccttcatgaaggcccgccaggtggtgcagacctgcgtgctgtccaccaggtggaagcacctctggcgctccgtcccctgccttgacatcgaccaagacgagttcaagactgatgaaggctcggaccacgattgggataaatttgaggacttcaccgaccacctgcttatccctaataatatttccattgggctcttggatacattccgtctgcatgttagtgccatgtataagggtccgcaggcaactagatggatccgtcatggcataaagtacagtacccaggaagctggcattcagcgcaggggattgggctctagctcctggcggctcaaaagattggatctttccaacgtacatttgaatgacagtttcacagagcatgtcagttcagggtgccaaaatttggagtatttggaactgaaaagttgcacgtgtacgtttcatgagatcacctcccactcactgaagaacttaattctgaaacattgccgctgctatgaactttctgctattacatcgcccaaactgaagagcttgattattaatatctggggaaatacaaggctggtggtcactgcccctgctgttgcttatctgctcctggaagtggaagctcgtgtcttaaacgacagtggtctctcattagaggagatgccatctcttggcaaggtctcgattcatctaaggaggaataattatgacgtagaaaatgtcagccaggaacaactcaagcttctttgcagcgtgtctaatgtgatgagtttggtgttgtcgggttttgcgacaatggtgcttggtgaggatccggcaactttcccgaatttcaggaatcttaggtccttattactgcacagctgtgatcttagtgataacttcaagacattggaacattttctgaagaattcaccagatctggagaagctaacccttcggtgttgcaagttttcaaaagatcttaagaagaaaaaggccaagtcaaagagggcatcttcttcccagtgtctcaacttggtggatgtcaagtgcaagaatctcaagcacactgaaatcatatataaagatgatgatatccgccagctggttgagcttttgttgagcatttcatcgaatctgccgaagaataatataaaacttaccaaagttgactagtattatcttcagttcagatcttcatgttctggttcactgaattttgtatgcttgccctgctgtaatagactagtgagaccatgtacctttggcctgttccaagatgatttatgggttagcttttgctctatggactatggtattgatttttagccgtttctctacccatgtatcctttgcttaaggtgatgcttggctctaggctttttgagcctaatgaagctatgttaccaacttcaaaccagaactgaaagttacatatttgcttcttcctgagttatcatgatcagcttttctatctccagcctgtgtcccttcccatgtgtatgtactgcttctctgaaaagtaaataccagtctgtcgccctgc

SEQ ID NO: 39313 - protein, 418 aa, Panicum virgatum
  misc_feature: Ceres CLONE 1997745
  misc_feature (21)..(68): Pfam Name: F-box Pfam Description: F-box domain
MEIDAKGKRPRASSSSLTGGDWLSSLPDCLIHHIMSFMKARQVVQTCVLSTRWKHLWRSVPCLDIDQDEFKTDEGSDHDWDKFEDFTDHLLIPNNISIGLLDTFRLHVSAMYKGPQATRWIRHGIKYSTQEAGIQRRGLGSSSWRLKRLDLSNVHLNDSFTEHVSSGCQNLEYLELKSCTCTFHEITSHSLKNLILKHCRCYELSAITSPKLKSLIINIWGNTRLVVTAPAVAYLLLEVEARVLNDSGLSLEEMPSLGKVSIHLRRNNYDVENVSQEQLKLLCSVSNVMSLVLSGFATMVLGEDPATFPNFRNLRSLLLHSCDLSDNFKTLEHFLKNSPDLEKLTLRCCKFSKDLKKKKAKSKRASSSQCLNLVDVKCKNLKHTEIIYKDDDIRQLVELLLSISSNLPKNNIKLTKVD

SEQ ID NO: 39314 - DNA, 1224 bp, Panicum virgatum
  misc_feature: Ceres CLONE 1997750
  misc_feature: Encodes the peptide sequence at SEQ ID NO. 39315
gatgggtgcccctgcccctcgatagccgcgccgctctcttgcccccgttccccatttgcctcctcgcccgcctccctgacctagcgccgccgccccctccctattcgccccagcgccgccgccgccgcatcgaaggcctcgccgccgcctcggctccgccctgcggcctccggaggtggtgccggcgcgcgatccgccgcggcgtccgttggtccggcttcgattcgtcggcgcggggagtatgcctctgatacaagtgcgctgaagatgaaggagaggagctctttatgtgatagcgcagcagatggaaactggggtttgaaatacaaaaggaaaagaagcaagctaacagttagtccatctaacgaaaatgaggctacctcaccaacatcagactctccaaggggctatggttccaccaaaaagaagctgaaacatgaccctaacatttctccatctgccaagaagataagagggaacgatgggtatttctatgagtgtgtagtatgtgatcttggtgggaatctgctctgttgtgatagctgtccgcgtgtttaccacttggaatgcctcaatcctcctcttaagcgtccaccccctgggaagtggcaatgtccaagatgccgtccaaaaaaaggtagcttgaagctgttaggtaatgcagaagctgacacttctaaacatgaaagaactacaaggacgctcacaagcacgacatcagatagtccaccttcccacacaaaagtctcttttaagacccgtagctccacacaagacaaaattggatcaaatgaacaaggaaaactgtcatctggtggcacattgaaggggggtgaccctagtataaagaagaacgaaggtgagaaaaagaagacactgatattacatttgaagaagcgctcaaccaaggaattatcagagaatgttaaaccctcaaagtcagaatttgttggagaaccttcagaagagaaaattgtgaaacatggaagtgttttgaaactgaagaaacatccaccacgtacagactcatctccaaataaatctaaaagcaggaggcaaaatagccagagagatggtaaaagatccggtacaaaaaagcttaaatattcaacatctgatgatgatgacagcgtttcctcgacagaaccatcgacatctcttgataacagtgaatcgccacaaaaaagaaaaccctcagatggaaaggcatcttcatctagtacc

SEQ ID NO: 39315 - protein, 318 aa, Panicum virgatum
  misc_feature: Ceres CLONE 1997750
  misc_feature (77)..(122): Pfam Name: PHD Pfam Description: PHD-finger
  misc_feature: SWISSPROT Homolog: EC 2.3.1.48 Histone acetyltransferase
MKERSSLCDSAADGNWGLKYKRKRSKLTVSPSNENEATSPTSDSPRGYGSTKKKLKHDPNISPSAKKIRGNDGYFYECVVCDLGGNLLCCDSCPRVYHLECLNPPLKRPPPGKWQCPRCRPKKGSLKLLGNAEADTSKHERTTRTLTSTTSDSPPSHTKVSFKTRSSTQDKIGSNEQGKLSSGGTLKGGDPSIKKNEGEKKKTLILHLKKRSTKELSENVKPSKSEFVGEPSEEKIVKHGSVLKLKKHPPRTDSSPNKSKSRRQNSQRDGKRSGTKKLKYSTSDDDDSVSSTEPSTSLDNSESPQKRKPSDGKASSSS

SEQ ID NO: 39316 - DNA, 673 bp, Panicum virgatum
  misc_feature: Ceres CLONE 1997764
  misc_feature: Encodes the peptide sequence at SEQ ID NO. 39317
gatttgatctggtgtacatcatgattgatgaacctgatgaaaccacagactaccacattgctcatcacattgtaagagtccatcagaaacgtgaagaagcactggcccctgcatttagcactgcggaactgaagcgatatattgcatttgcgaagtctttgaaacctcagctgagttcagaagcaaagaaggttttggtggactcatatgttacccttcgtagaggtgacagtactcctggaaccagggttgcttacaggatgacagtaaggcaattagaagcattgattaggctatcagaagctattgctcgaagccacttagaaagaactgttctcccagctcatgtccgactggcagttaaattgcttaagacatccatcatcagcgttgagtcaagtgaagttgatctctctgagtttgaagatgctgaagatggaacaaatgtaccttctgataatgatgctggacagccagctgaagcagatgctgctcctcaacaagagggtgcagaaaatgaccaagcagcagataacggtaagaagaaattggtaataactgaagaatacttccagagaattactcaagcgttggttatgagactacggcagcatgaagagtccatcatgaaagatggagatggtcttgctggcatgaagcaaggggatcttat

SEQ ID NO: 39317 - protein, 223 aa, Panicum virgatum
  misc_feature: Ceres CLONE 1997764
  misc_feature (1)..(128): Pfam Name: MCM Pfam Description: MCM2/3/5 family
FDLVYIMIDEPDETTDYHIAHHIVRVHQKREEALAPAFSTAELKRYIAFAKSLKPQLSSEAKKVLVDSYVTLRRGDSTPGTRVAYRMTVRQLEALIRLSEAIARSHLERTVLPAHVRLAVKLLKTSIISVESSEVDLSEFEDAEDGTNVPSDNDAGQPAEADAAPQQEGAENDQAADNGKKKLVITEEYFQRITQALVMRLRQHEESIMKDGDGLAGMKQGDL

SEQ ID NO: 39318 - DNA, 630 bp, Panicum virgatum
  misc_feature: Ceres CLONE 1997776
  misc_feature: Encodes the peptide sequence at SEQ ID NO. 39319
aaaaccccctgccattgctagccctcctcctcctcccaacctcggggccaacctcggaatctccccctcccccggggcaggggcgccctatatagaccccgccgcccggcccccgatccgcacctacctccttcacccgtgccccccccaccctggccggccctgcttcgacgggcggcttcgcagatcgaaggaaccaggagggaatgatggatctcgcggacagccggcagcggctcctcgccggcgcggcgctgctgctggccaccgtcgccttcgtgaggctcctgctgggctcccgcggccgcgggaagcgcctcccgcccaccatcccgggggctccggtcgtcggcgggctcgtcaagttcatgcgcgggcccatccccatgatccgggagcagtacgcccgcctcggcagcgtcttcaccgtccccatcctcagccgccggatcaccttcctcatcgggcccgaggtgtcggcgcacttcttcaagggcaacgaggccgagatgagccagcaggaggtgtacaagttcaacgtgcccacgtttgggccaggggtcgtcttcgacgtcgactactcagtcaggcaggagcagttccggttcttcaccgaggccctgcgggcca

SEQ ID NO: 39319 - protein, 140 aa, Panicum virgatum
  misc_feature: Ceres CLONE 1997776
  misc_feature: SWISSPROT Homolog: EC 1.14.13.70 Sterol 14-demethylase
MDLADSRQRLLAGAALLLATVAFVRLLLGSRGRGKRLPPTIPGAPVVGGLVKFMRGPIPMIREQYARLGSVFTVPILSRRITFLIGPEVSAHFFKGNEAEMSQQEVYKFNVPTFGPGVVFDVDYSVRQEQFRFFTEALRA

SEQ ID NO: 39320 - DNA, 726 bp, Panicum virgatum
  misc_feature: Ceres CLONE 1997783
  misc_feature: Encodes the peptide sequence at SEQ ID NO. 39321
caatgacttactcctctgctatcttcaaggcggaggacgagagcttagaggcagcccagctacgtaaacttgacagtcttattaataaggctaaggtggagccggagcatcatgttcttgatattggtagtggttggggcactttagcaatacggttggtgaagaaaactggttgcaagtacacgggaatcacgttgtctgaggagcaactaaaatgctccaagagaaaggttaaagaagcaggattagaggaccgcataactttcctcctttgtgattaccgtcgaataccaacttcccataagtttgacaggattataagctgtgagatgattgaacacgtcgggcatgagtacatggatgagtttttcggctgctgtgagtaccatttggcagaccaaggcctatttgtcctccagttcatcgcgatacctgaggaattgtatgacagaatgaggttgcggcccgagtttttgaaggaatatatcttcccaggtggctgcctaccttccctaaacagggttgtatctgccatgactaattcatcaaggctctgcgtacaacaccttgagcaacttggggaccattactacccgactctgatgcactggagggacaattttgtggccaacagaaaaaaagtttctgccctgggattcgatgaaaaattcatccgtacttgggagtactatttttcatattgtgcgggctttgttcaaatcgcgc

SEQ ID NO: 39321 - protein, 241 aa, Panicum virgatum
  misc_feature: Ceres CLONE 1997783
  misc_feature (1)..(241): Pfam Name: CMAS Pfam Description: Cyclopropane-fatty-acyl-phospholipid synthase
  misc_feature (39)..(138): Pfam Name: Methyltransf_11 Pfam Description: Methyltransferase domain
  misc_feature: SWISSPROT Homolog: EC 2.1.1.79 Cyclopropane-fatty-acyl-phospholipid synthase
MTYSSAIFKAEDESLEAAQLRKLDSLINKAKVEPEHHVLDIGSGWGTLAIRLVKKTGCKYTGITLSEEQLKCSKRKVKEAGLEDRITFLLCDYRRIPTSHKFDRIISCEMIEHVGHEYMDEFFGCCEYHLADQGLFVLQFIAIPEELYDRMRLRPEFLKEYIFPGGCLPSLNRVVSAMTNSSRLCVQHLEQLGDHYYPTLMHWRDNFVANRKKVSALGFDEKFIRTWEYYFSYCAGFVQIA

SEQ ID NO: 39322 - DNA, 672 bp, Panicum virgatum
  misc_feature: Ceres CLONE 1997787
  misc_feature: Encodes the peptide sequence at SEQ ID NO. 39323
acacgcacacacaagctcatcgcacagctcagcttcgactcgtctcgagcgagaaatagctttcgtcaccaactcgtcttcttggaggagggccggccggcgagagatttaattacggttgaggaggaggagatggaggtcgccgccgccgtcgccgcagcgagctacgtggccgacgacgttgacagctgcctgaaggcgaccgagctgaggctcggcctgccgggcaccgaggagacggcgccggcggcgctgccgacgccgccgtccacgcccaggggcaagaagcgcgaggggaacagcgccgccgccgaggaggcagccaagaccgcgccgccggccgccaaggctcaggtggtggggtggccgccggtgaggtcctacaggaagagctgcttccagcagtccagcaccgccgccgccaagagcaagccggcggcgccgccggaggagaaggccccggccgcgcctgccgccgccgccgccggtgggaacgcggcgctgttcgtcaaggtgagcatggacggagcgccctacctgaggaaggtggacctcaagatgtacaagggctaccgcgagctcagggaggccctggaggccatgttcctcggcttctccggcggcggcgccgacgcgccggccgtcaacccctccgacttcgccgtcacctac

SEQ ID NO: 39323 - protein, 179 aa, Panicum virgatum
  misc_feature: Ceres CLONE 1997787
  misc_feature (21)..(179): Pfam Name: AUX_IAA Pfam Description: AUX/IAA family
MEVAAAVAAASYVADDVDSCLKATELRLGLPGTEETAPAALPTPPSTPRGKKREGNSAAAEEAAKTAPPAAKAQVVGWPPVRSYRKSCFQQSSTAAAKSKPAAPPEEKAPAAPAAAAAGGNAALFVKVSMDGAPYLRKVDLKMYKGYRELREALEAMFLGFSGGGADAPAVNPSDFAVT

SEQ ID NO: 39324 - DNA, 662 bp, Panicum virgatum
  misc_feature: Ceres CLONE 1997790
  misc_feature: Encodes the peptide sequence at SEQ ID NO. 39325
aaaaagacgagccgaatcattgtgactacaagggaggagaatattgcaaaacattgcactgggaaacatggaaagatacacaatcttgaagttctagactatgaacatgcacttgacctcttcagcaaaaaggtatttgggaagactacagatttggttgagcagaatcctgagttgattgaagaagcaaaattgattctaaagaaatgcagtggacttccccttgaaatagtaacaataggtggcttcttggcaaatcgaccaaagacactagtggagtggcggaaattgaatgagaatatcagtgctgagttggagatgaatccagagcttgggatgataagagcggtccttgaaaaaagctatgatggtttaccttacaatctcaagtcctgttttttgtatctgtctatctttcctgaagaccaactaatttctcggaagcgtttggtgcgccggtggacagcagagggttactctactgatatgtgtgggaagtctgccaatgaaatagctgacgactacttcacagaactccaaaacaggagcatgattttaccatctcagcgatcagtttgcagtagaaaattgatcgactcctgcaaagtccatgacctcatccgtgaaatcgccatctcaaaatcgatggaggaaaaccttgt

SEQ ID NO: 39325 - protein, 220 aa, Panicum virgatum
  misc_feature: Ceres CLONE 1997790
  misc_feature (1)..(165): Pfam Name: NB-ARC Pfam Description: NB-ARC domain
KKTSRIIVTTREENIAKHCTGKHGKIHNLEVLDYEHALDLFSKKVFGKTTDLVEQNPELIEEAKLILKKCSGLPLEIVTIGGFLANRPKTLVEWRKLNENISAELEMNPELGMIRAVLEKSYDGLPYNLKSCFLYLSIFPEDQLISRKRLVRRWTAEGYSTDMCGKSANEIADDYFTELQNRSMILPSQRSVCSRKLIDSCKVHDLIREIAISKSMEENL

SEQ ID NO: 39326 - DNA, 663 bp, Panicum virgatum
  misc_feature: Ceres CLONE 1997816
  misc_feature: Encodes the peptide sequence at SEQ ID NO. 39327
gttagcctaaaatgcacttgggagacttccgtgctctgttgaacctctggggggagatgggtccactttcttccatgtaccttactatctttttgttttttcagctggaggccttacagttccgtggtctctgttcgtacaaatctgcaggctttggttaattttggcgtcagcagggtgatagcatctgggcacccggatttcaaggttggggatcttgtgtggggaatgaccggatgggaggagtacactctcgtccctaaaccggagtcatttttcaagatcaatcaccccgagttgcctctgtcctactacacaggtgttcttggcatgcccggccttactgcttgggctggatttttcgatgtgggcaagcctaagaaaggcgattacgtttttgtctcggctgcatcaggtgccgttggtcagcttgttgggcagcttgctaagctcacgggctgttatgtagttggcagtgctggttctgatgagaaggttaaccttctgaaaaccaagtttggcttcgacgaagcattcaactacaagaaagagcaggaccttgatgctgccctgaggaggtgcttccctgagggcatcgacatctacttcgagaacgtgggtggcccaacactggaggccgtgctgtccaacatgcgcaaccac

SEQ ID NO: 39327 - protein, 144 aa, Panicum virgatum
  misc_feature: Ceres CLONE 1997816
  misc_feature (52)..(144): Pfam Name: ADH_zinc_N Pfam Description: Zinc-binding dehydrogenase
  misc_feature: SWISSPROT Homolog: EC 1.6.5.5 NADPH:quinone reductase
MTGWEEYTLVPKPESFFKINHPELPLSYYTGVLGMPGLTAWAGFFDVGKPKKGDYVFVSAASGAVGQLVGQLAKLTGCYVVGSAGSDEKVNLLKTKFGFDEAFNYKKEQDLDAALRRCFPEGIDIYFENVGGPTLEAVLSNMRN

SEQ ID NO: 39328 - DNA, 550 bp, Panicum virgatum
  misc_feature: Ceres CLONE 1997818
  misc_feature: Encodes the peptide sequence at SEQ ID NO. 39329
atctcttccttccctggcggcgacgactgggcgagcggcggcgccatttgtcacgtcttcgcccagccctttgccggcgacgagcgcatcctccagatctgaatccagccacttcttcgagatgccgagggccacgagcgacgcaaagcttctgatccagtccctcaacaaggcgtatgctgccacaccgacaaatcttaagattatcgacctgtacgtgatttgtgctctcgctaccgccgtgattcaggtaagttttaacatttctgtctttgctgttaagacagatctcaagtctcaaaatgaaggctcaaaaatttacctcaacaattactagtgcttaccctagtatctagagatgttcctgttgcagattttcacacctagatagcacaataaatctagcgtctggtgatatttaaaaattctacctgatcagcttatcgtgtatactataatgtatctagagatatttcctgttccagattttcactatctaagtgtagtgtccggaggtgtttcaaaagaacaacttgtggtgtatactatc

SEQ ID NO: 39329 - protein, 71 aa, Panicum virgatum
  misc_feature: Ceres CLONE 1997818
  misc_feature: SWISSPROT Homolog: EC 2.4.1.119 Dolichyl-diphosphooligosaccharide--protein glycotransferase
MPRATSDAKLLIQSLNKAYAATPTNLKIIDLYVICALATAVIQVSFNISVFAVKTDLKSQNEGSKIYLNNY

SEQ ID NO: 39330 - DNA, 687 bp, Panicum virgatum
  misc_feature: Ceres CLONE 1997819
  misc_feature: Encodes the peptide sequence at SEQ ID NO. 39331
caccgctgcttcaagaaaccaccgaggccaagctcgcaagggaatagagaggggagagaggcaaggagaagaaatggaggggaaggaggaggatgtgcgcctgggcgccaacaagttcgcggagaggcagcccatcggcacggcggcgcagggcaccgatgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccccatccaagtgcgccaccgtcggcatccagggaatcgcctggtccttcggaggaatgatcttcgcgctcgtctactgcaccgccggcatctccggaggccacatcaacccggctgtgacattcgggctgttcttggccaggaagctgtccctgaccagggccatcttctacatagtcatgcaatgcctgggtgccatctgcggagctggagtggtgaagggcttccagcagggactttacatgggcaacggcggtggtgccaacgttgtcgcccccggctacaccaagggtgatggccttggtgctgagattgttggcaccttcatcctggtctacaccgtcttctcagccactgacgcccagaagaaatgcta

SEQ ID NO: 39331 - protein, 204 aa, Panicum virgatum
  misc_feature: Ceres CLONE 1997819
  misc_feature (46)..(203): Pfam Name: MIP Pfam Description: Major intrinsic protein
  misc_feature: Useful for making plants with modulated water use efficiency
  misc_feature: Useful for making plants with modulated drought sensitivity
  misc_feature: Useful for making plants with modulated cold sensitivity
MEGKEEDVRLGANKFAERQPIGTAAQGTDDKDYKEPPPAPLFEPGELKSWSFYRAGIAEFVATFLFLYITILTVMGVSKSPSKCATVGIQGIAWSFGGMIFALVYCTAGISGGHINPAVTFGLFLARKLSLTRAIFYIVMQCLGAICGAGVVKGFQQGLYMGNGGGANVVAPGYTKGDGLGAEIVGTFILVYTVFSATDAQKKC

SEQ ID NO: 39332 - DNA, 638 bp, Panicum virgatum
  misc_feature: Ceres CLONE 1997823
  misc_feature: Encodes the peptide sequence at SEQ ID NO. 39333
gaaagctgcggcacgtacatacaccaatcgatcgattgcaattgcaattgcaattgcaagcagcagcggcatcgacgatcgataataatagtaatggagggcagggaggaggatgttcggctgggcgccaaccggtactctgagcggcagcccatcggcacggaggcgcagggcaccgaggagaaggactacaaggagcctcccccggcgccgctgttcgaggcggaggagctggcgtcgtggtccttctaccgcgccggcatcgccgagttcgtggccaccttcctgttcctctacatcagcatcctgacggtgatgggcgtgagcaagtcgtccagcaagtgcgccaccgtgggcatccagggcatcgcctggtccttcggcggcatgatcttcgcgctcgtctactgcacggcgggcatctccggcggccacatcaacccggcggtcaccttcggcctcttcctggcgcgcaagctctcgctcacgcgcgcgctcttctacatggtgatgcagtgcctgggcgccatctgcggcgccggcgtcgtcaaggggttccagcaggggctctacatgggcgccggcggcggcgccaacgccgtcaacccgggctacaccaagggcgacggcctcggcgc

SEQ ID NO: 39333 - protein, 181 aa, Panicum virgatum
  misc_feature: Ceres CLONE 1997823
  misc_feature (46)..(181): Pfam Name: MIP Pfam Description: Major intrinsic protein
  misc_feature: Useful for making plants with modulated water use efficiency
  misc_feature: Useful for making plants with modulated drought sensitivity
  misc_feature: Useful for making plants with modulated cold sensitivity
MEGREEDVRLGANRYSERQPIGTEAQGTEEKDYKEPPPAPLFEAEELASWSFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGFQQGLYMGAGGGANAVNPGYTKGDGLG

SEQ ID NO: 39334 - DNA, 600 bp, Panicum virgatum
  misc_feature: Ceres CLONE 1997859
  misc_feature: Encodes the peptide sequence at SEQ ID NO. 39335
acccaccatcaccgagctctgcctctctctcggcacgcgcgcgagctctccttactcgtcgaggtgccttgatggcgaccgaagtggctgacgctccggtgccgctgccggaggcgagccccgacgccgccgcggaggcccctgccgcggacgccgtcgcggccgccggcgacgcgaagccggccaaggccaagaaggccgccgcgccgcggaagcgcgcgaacccgacccacccgccgtacgccgagatgatctcggaggcgatcacgtcgctgaaggagaggacggggtcgagccagtacgcgatcgccaagttcctggaggacaagcacaaggacaagctgccgtccaacttccgcaagatgctgctcgtgcagctgaagaagctcgccgccgccggcaagctcaccaaggtcaagaactcctacaaggtgccgtcggggcgcgccccggccgccgacaagcccaaggccaaggccaagaagcttgctgccgccaagccgaagccgaagcccgctgcgaagaagcccaaggccgccgccaagcccaaggccaaggcacccgccaagaccaagcccgctgcgaagccgaaggccgccg

SEQ ID NO: 39335 - protein, 176 aa, Panicum virgatum
  misc_feature: Ceres CLONE 1997859
  misc_feature (53)..(123): Pfam Name: Linker_histone Pfam Description: linker histone H1 and H5 family
  misc_feature: Useful for making plants with modulated nitrogen use efficiency
  misc_feature: Useful for making plants with modulated oxidative stress sensitivity
MATEVADAPVPLPEASPDAAAEAPAADAVAAAGDAKPAKAKKAAAPRKRANPTHPPYAEMISEAITSLKERTGSSQYAIAKFLEDKHKDKLPSNFRKMLLVQLKKLAAAGKLTKVKNSYKVPSGRAPAADKPKAKAKKLAAAKPKPKPAAKKPKAAAKPKAKAPAKTKPAAKPKAA

SEQ ID NO: 39336 - DNA, 1812 bp, Panicum virgatum
  misc_feature: Ceres CLONE 1997864
  misc_feature: Encodes the peptide sequence at SEQ ID NO. 39337
gcttaagagcatacctccggtgtccttccatcctcccctcgctcccccacccaccgttccgcgctcggggaaacttccaagccagagagagagagagagagagagagggacttagagagagagagacagagacttccaagccagagagagagagagaaggcggcgtctttaaccgatcgacgccctcccggctccctccccgccggggtttgcttgctgcggcgggcgggctattcggtttccggcggctcccggtccgcgcggcggcggggttgggactctccgcgggccgcgcggcggcggctgcgtccaccgcctccttcgccgttgcggttcgggatatgatggctgctgctgaatgttgatgaaattcacttatagatactgaactgccatctaatctaagttaaatgaaacacggcacaactgtgtgcactgagagtttgaaacacgtcagcaatgagttgtttttctcactttttcaagaggaaaacagggccccaacgtcaagacgatccggctagtgatgacttcactggttctgagaatataacaagatacagctatagggaactggttagagcaacatcaaattttgaccaagccaataagattggtgagggaggttatggtcctgtctacaagggaaccctcaaggatggaacagctattgctgtaaaggttttgtctttacattctagacaaggtgcaaaggagtttctcagtgagcttcttgcaatctctgatgttgcacatgagaatcttgtcaaactctatggctgctgtgtagaagggaaccacaggatccttatctacaattatcttgagaacaatagtctttcacatacccttctaggttcagggcatagcaacatccaattcaactggagaactcgagtgaatatctgcatcggtgttgcccagggattggctttcctccatgattgtgcccgccctcatattgttcaccgcgacatcaaggcgagcaacatccttcttgataaggaccttacaccaaaaatatctgattttggtctggcaaagcttctaccttcggatgtatcacatgttagcacaagagtcgcaggaactctaggttacttggctcctgaatatgcaattcgaggacaagtgtcacggagggcagatgtctacagctatggtgttctgctcatcgaaatagttagcggaagatgcaatactgatacggaattgccctatgatgatcagattcttcttgagaagacatggagatactacgaccaggggaatctggagaagatcatagacagttctctaggcgacgacctagatgtcgaccaagcctgcaggttcctgaagattgggctcctctgcacccaggacgtcacgaagcggcgtccaggcatttcaacagtggtggccatgctgaaaggcgaggtggaagtgaacactgagatgatcaacaagcccgacgtgatcagggacttcagggacctgaagctccggagcagggccacatcatcgaccatgctgacctccatcatggcgcgctcatccccgctatcgtctgaagagacgacgcgcacctccatcaccttcacagcaatatcggagcgcgactgatgatcggggatgcgattgactgtgtctgcaaccgtttagctagagcaaattgtatgtagcataggccagaatcctttttggtggttgtatgtttcgtgtgcatatagatgtgcgttttcccctgttatagagcatatgaacaaattgattatactttcagagccagaatcaacctgtgaagtaaataaatggaagtctgctcatttc

SEQ ID NO: 39337 - protein, 381 aa, Panicum virgatum
  misc_feature: Ceres CLONE 1997864
  misc_feature (46)..(317): Pfam Name: Pkinase Pfam Description: Protein kinase domain
  misc_feature: SWISSPROT Homolog: EC 2.7.11.1 Non-specific serine/threonine protein kinase
MSCFSHFFKRKTGPQRQDDPASDDFTGSENITRYSYRELVRATSNFDQANKIGEGGYGPVYKGTLKDGTAIAVKVLSLHSRQGAKEFLSELLAISDVAHENLVKLYGCCVEGNHRILIYNYLENNSLSHTLLGSGHSNIQFNWRTRVNICIGVAQGLAFLHDCARPHIVHRDIKASNILLDKDLTPKISDFGLAKLLPSDVSHVSTRVAGTLGYLAPEYAIRGQVSRRADVYSYGVLLIEIVSGRCNTDTELPYDDQILLEKTWRYYDQGNLEKIIDSSLGDDLDVDQACRFLKIGLLCTQDVTKRRPGISTVVAMLKGEVEVNTEMINKPDVIRDFRDLKLRSRATSSTMLTSIMARSSPLSSEETTRTSITFTAISERD

SEQ ID NO: 39338 - DNA, 687 bp, Panicum virgatum
  misc_feature: Ceres CLONE 1997865
  misc_feature: Encodes the peptide sequence at SEQ ID NO. 39339
aattcttctctctttcgccggctccgatcccaagtcccatggcgctctccatctccacgcctacctcctcctccctccttccggcctcccgtcaggtgggcaggtggagtccattggcgcggtcggctaagcctgtgtctttcagcctctggaggtcgcctctggcggcgcggtccgccgccggcaacgcacgagcttcccccgtcgacgaggtcgtcactgagctcgacgcggtggccggattcagcgagatcgtgccggacactgtcgtgttcgatgatttcgagaggttcgcacccacagcggccacggtgagctcctcgctgctgcttggaatctctgggctcccggataccaagttcaagagtgcgatagatactgcactggcagatggtgagtgcaacgcattggagaagcccgaggacaggatgtcctgttacctcaccaaggccctggcaaacgttggtgctgaactggctcagcaagtccctggacgcgtttcgactgaaatagatgctcggttggcttatgacacccagggcattatccagagggtgcatgaactgttgaatctatacaaccaacatgatgtctcaactgaccgcctgctatttaaaattcctgctacatggcaaggtatagaggcctcaaggttgcttgaatctgatggaattcagacacatttta

SEQ ID NO: 39339 - protein, 216 aa, Panicum virgatum
  misc_feature: Ceres CLONE 1997865
  misc_feature: SWISSPROT Homolog: EC 2.2.1.2 Transaldolase
MALSISTPTSSSLLPASRQVGRWSPLARSAKPVSFSLWRSPLAARSAAGNARASPVDEVVTELDAVAGFSEIVPDTVVFDDFERFAPTAATVSSSLLLGISGLPDTKFKSAIDTALADGECNALEKPEDRMSCYLTKALANVGAELAQQVPGRVSTEIDARLAYDTQGIIQRVHELLNLYNQHDVSTDRLLFKIPATWQGIEASRLLESDGIQTHF

SEQ ID NO: 39340 - DNA, 642 bp, Panicum virgatum
  misc_feature: Ceres CLONE 1997883
  misc_feature: Encodes the peptide sequence at SEQ ID NO. 39341
ccgcgtcttcgtcacaagtcacatcccccttctctctctaaaccctaacgcctcgacctgagcaatccctaggtctccgcgcgaggtggtggcgggcggcgggcggcgaggggatttcgatttgatttgacccgggatggcggaggaaaataaggtcggacggatcttcgtgggcgggctgtcgtgggacaccacggagagcacgctcacgcgcaccttcagccagtacggcaaggtcatcgactcgcaggttgtagtggaaagggacacaggccgctccaggggatttggatttgtcacattttcagaacctcgggctgtggatgctgccattcggggaatgcataatggagaactggatggtcgaaatatctctgtgaacaaagctcaacctaggaactctgatgatggctatggctatggtggtggtggtggtggtggtggttactcatctggtgctagaggtggatatcgcagtggaggtgatgtagttccagctgccagtgatgattgcttcaaatgtggccgccctggacattgggctcgtgaatgcccttattcagatggaggtggtagaactggaaggtactctccagcttcaaggtatggtggtggcactgggggacgtggtgaccgttttgg

SEQ ID NO: 39341 - protein, 168 aa, Panicum virgatum
  misc_feature: Ceres CLONE 1997883
  misc_feature (10)..(81): Pfam Name: RRM_1 Pfam Description: RNA recognition motif. (a.k.a. RRM, RBD, or RNP domain)
  misc_feature (124)..(141): Pfam Name: zf-CCHC Pfam Description: Zinc knuckle
  misc_feature: SWISSPROT Homolog: EC 5.2.1.8 Peptidylprolyl isomerase
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with modulated biomass
  misc_feature: Useful for making plants with modulated flowering time
MAEENKVGRIFVGGLSWDTTESTLTRTFSQYGKVIDSQVVVERDTGRSRGFGFVTFSEPRAVDAAIRGMHNGELDGRNISVNKAQPRNSDDGYGYGGGGGGGGYSSGARGGYRSGGDVVPAASDDCFKCGRPGHWARECPYSDGGGRTGRYSPASRYGGGTGGRGDRF

SEQ ID NO: 39342 - DNA, 1575 bp, Panicum virgatum
  misc_feature: Ceres CLONE 1997886
  misc_feature: Encodes the peptide sequence at SEQ ID NO. 39343
atcctcggcaccatcgtctccctcctggacaccgaggagggcgcccgcacagccatcctctcccgccgctggcgccacatctggcgctcggcggcgccgctcaacctcgacgactgcctccaggacttctacatggactcccaacgcgcccaggtcatctcccacatcctcgctactcaccgtggtcccgctcggcgcctcgccttgagattccacggaactccccgcgctctcagtcactacaacgattggttcccccttccgatattcgacgggctgcaggaactggtcctccgcttccctctcgccgtcgaccaccccaaaatgtccgcctctgcgctgcgcttcgcctcgctccgcgtgctggatatctataactgtaccttcccgctgagcggcaccgcgccctccttcccctgcctggcctacctctctctccgtcaggtaggcatcaccgaggagttcctccaaggcatgatctctaatagccctgggattgatgctatggtgctggacactaattttggccaccgccggctgtgcctctccatgccgaggctgaggtacctgaccgtgtcggtcaggtgctttgataggagggaggaggttgagctggatgatctcgtcatccaggatgcttcaagcctggaacggctattgctgcatgaggcgaattatggcccatctgtgaggatcactggggcgacaaaactcaagatgctaggataccttggaactggctttcccattattcagcttggcgattcaatcttcaagggcatggttcctgtcagcttggtggagcagttctccactgtgacaatattagcattagagatgcctgaaccgaagttgacggttgttctcgactacttaagatgttttccttgcctggagaagctcaacatcaagtttaatgtgaacatatggacgagtttggagcctggtctgcccaatgatccatttgctcctatcaagtgccttgaccacagcctggagaccattttgctgcaatcatatgatggactgaagacacatgttgaattcaccaagtttttcgtcaagagagcaaaggtccttagggtcatgaagttctgttgcagaagattgtgtacaacaagatggattcaaaaccagcataggcggctcaatttggagagaagagcttcaaggcgtgctcggtttgcttttgtgagtcagtgcgacttgcccctaactttttggttggatgagggcttctctagagatgatcccttcatagaaaccattggatgagggcttccaatggaaagcaatgattggtgagttctccattccattacatgaagcagtgagggttctggaatgcagagcatgaaatcaccatgaagatgatgtttaaaatctttatttatgtagtcatgcagttctaagatgggttgatttaagttgtgttaggcctttaaatctatttatgcagtgtgggtgtgtatggacgtgagtgtggtgtgcgtgtggtaactgtgttcgtttctgggatgttttgtactcggtacatgtgcttttattatcatttgttagaccctggctccatac

SEQ ID NO: 39343 - protein, 424 aa, Panicum virgatum
  misc_feature: Ceres CLONE 1997886
  misc_feature (316)..(367): Pfam Name: FBD Pfam Description: FBD
ILGTIVSLLDTEEGARTAILSRRWRHIWRSAAPLNLDDCLQDFYMDSQRAQVISHILATHRGPARRLALRFHGTPRALSHYNDWFPLPIFDGLQELVLRFPLAVDHPKMSASALRFASLRVLDIYNCTFPLSGTAPSFPCLAYLSLRQVGITEEFLQGMISNSPGIDAMVLDTNFGHRRLCLSMPRLRYLTVSVRCFDRREEVELDDLVIQDASSLERLLLHEANYGPSVRITGATKLKMLGYLGTGFPIIQLGDSIFKGMVPVSLVEQFSTVTILALEMPEPKLTVVLDYLRCFPCLEKLNIKFNVNIWTSLEPGLPNDPFAPIKCLDHSLETILLQSYDGLKTHVEFTKFFVKRAKVLRVMKFCCRRLCTTRWIQNQHRRLNLERRASRRARFAFVSQCDLPLTFWLDEGFSRDDPFIETIG

SEQ ID NO: 39344 - DNA, 1491 bp, Panicum virgatum
  misc_feature: Ceres CLONE 1997907
  misc_feature: Encodes the peptide sequence at SEQ ID NO. 39345
gatgtccaacgcggcaacgcccctctccttcccctcatcgcgcgcggcgcgaccgtacccggcccggccataagacgccacctccccgcatctaccgccaccttatcgcctcgccctccaacaccgatcgacgcgagccaggcaccaacccgctgcggcggcggcccagcgagagatggacggcggccggccggagatgcggcggaccatgacgctgtccgagcagctgtccacgcccgacccggccatccgcgacttcctcaagatccccaaggacgccgacgtcggcgggagccccggcgaggacggcaaccctgcggccagcggcggcggcggctggaagccgctccgggaccggctccggctccgccgcgcggccgcggcccacgcccggacgagcagcggtgacctcagcaacagcaccagtgccaacagccgcagcaacaagtacaaccacgccggcgaggcggcggcggcgttctcccgcaccttctcccgcgcgccttcgctccgcgcgacgcccacattctcccgcgtcgcgtccacccgggtcgggcccagctcctcctcccgctccacctccagctccaggcgccccgggtcgtccaacttccgcgaccatgaagaggaacgccgtgacgacggcgacggcgagcacagtgaagatgatgatgatgacgaggaggaggacgacgaggaggagggcaaggaggaggcgcccgcggcgcagatgtcgctgatggcgctgctggagcagtcggacagccagtgggacgacgacgaggacgaggatgccggcggcggcgcgcggaagaacggcgagggcgacgacgacgatgacgacggcgagggccgggaggaggagatggtgcacgtgtgctgcgtgtgcatggtgcggcacaagggcgccgccttcatcccctgcggccacaccttctgccgcctctgctcgcgcgagctctgggtcagccgcggcaactgcccgctctgcaacgggttcatccaggagattctcgacatcttctgaccggccgagcttgcctccgccattgttcatcagctaggccttgtcacgtccattgcataatcacaatcaccaccgtctccctctgcctcttcttcttcttggacgaggaagtgacacggaatctatgaaaccgaaatccctagaaggattcaattgatcgagctggcggtaactaacgctggtgtttgcaaatgcattcaattttttttggatgtggttgattatatgttaaggatcaataaaaaatgatatatgcaatgtttgtatgtgtatatgtacatttcagagtgtggttgttaggttgactaaacatcaccaacaagagcctatgattatacctgttcccagagtagctacccaggctgttcttatttttcttggttggaggttggaactgaactatcaaattcgttccgatcaccatctaatgataacaaaactttgtctgtggtccgttcaattgt

SEQ ID NO: 39345 - protein, 283 aa, Panicum virgatum
  misc_feature: Ceres CLONE 1997907
  misc_feature (235)..(272): Pfam Name: zf-C3HC4 Pfam Description: Zinc finger, C3HC4 type (RING finger)
MDGGRPEMRRTMTLSEQLSTPDPAIRDFLKIPKDADVGGSPGEDGNPAASGGGGWKPLRDRLRLRRAAAAHARTSSGDLSNSTSANSRSNKYNHAGEAAAAFSRTFSRAPSLRATPTFSRVASTRVGPSSSSRSTSSSRRPGSSNFRDHEEERRDDGDGEHSEDDDDDEEEDDEEEGKEEAPAAQMSLMALLEQSDSQWDDDEDEDAGGGARKNGEGDDDDDDGEGREEEMVHVCCVCMVRHKGAAFIPCGHTFCRLCSRELWVSRGNCPLCNGFIQEILDIF

SEQ ID NO: 39346 - DNA, 657 bp, Panicum virgatum
  misc_feature: Ceres CLONE 1997911
  misc_feature: Encodes the peptide sequence at SEQ ID NO. 39347
gttcccctcctccaagaagcagcccagcactggtgctgcgagctcgaatgatcggcctatgtgcgtgcaaggcgactccggcggcctcgtcctcaccaccgaccccaagccccgcctccggtggaccgccgagctccatgaccgtttcgtcgacgccgtcgcccagctcggaggcccggacaaggcaactccaaagactatcatgagggttatgggagtcaagggcctcaccctctaccatctcaagagtcacctgcaaaaattcaggctaggcaagcagcacaaggagtttggggatcatacagcaatggagatgcaacgtaacgtggcttcttcttcaggcgtgatgggaagaaccatgaacgaccgaagcgtgaacgtgagcgggaatgaggccctaaggatccagatggaagtccaaagaaggctccatggggaactagaggtgcagaagcacctccagatgagggttgaagcccaggggaagtacatgcaatccatcgtggagaaagcataccaagccctggggtccagcgactgcgccacgtggcccgcggggtacagatctctaggcagcaaccagcaggccgtccttgacattggcggctccacgagcttctcgtccctccaggacctgcacttctatggaggaagcag

SEQ ID NO: 39347 - protein, 218 aa, Panicum virgatum
  misc_feature: Ceres CLONE 1997911
  misc_feature (38)..(89): Pfam Name: Myb_DNA-binding Pfam Description: Myb-like DNA-binding domain
  misc_feature: Useful for making plants with altered alkaloid content
  misc_feature: Useful for making plants with altered lignin content
  misc_feature: The sequence is a functional homolog of SEQ ID NO 1097 in the 11/479,226 US patent application
  misc_feature: The sequence is a functional homolog of SEQ ID NO 2402 in the 10/374,780 US patent application
  misc_feature: The sequence is a functional homolog of SEQ ID NO 548 in the 10/225,066 US patent application
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: Useful for making plants with altered terpenoid content
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
FPSSKKQPSTGAASSNDRPMCVQGDSGGLVLTTDPKPRLRWTAELHDRFVDAVAQLGGPDKATPKTIMRVMGVKGLTLYHLKSHLQKFRLGKQHKEFGDHTAMEMQRNVASSSGVMGRTMNDRSVNVSGNEALRIQMEVQRRLHGELEVQKHLQMRVEAQGKYMQSIVEKAYQALGSSDCATWPAGYRSLGSNQQAVLDIGGSTSFSSLQDLHFYGGS

SEQ ID NO: 39348 - DNA, 1638 bp, Panicum virgatum
  misc_feature: Ceres CLONE 1997912
  misc_feature: Encodes the peptide sequence at SEQ ID NO. 39349
accaatcctccccatcccgaccgaccgcggtagcggtagcaaagcagcagttgacgccgccccacctcctccccgcccgcctcgccccgccgccgccgcgtccgatcgcaagcctccacctcgccctccgcttgctgtcggtcttccatccaccttctgcgcgacgaatcggcggcggcggcggctatatcggcggcgcgtcgctgcccgccatggaggcgtacaagctctgggtgcgcaggaaccgggacctcgtccgctccctcgagtccctcgccaacgggctcatttggatactacctgagcgctttgccaactcagagatcgcgccagaagcagtatattcgctattgggtattgtgagttctgtcaaccagcacataattgatgcgcccaccgaaaaccacgcatttgcctcaaaggagcaatctatcccatggggtcttgttgtctctgtactaaaggatgtggaggcggttgttgaggttgctgcccagcactttgttggtgatgatcgcaagtggagcttccttgctgttacagaagcagtgaaagcaggtgtcaggttagccgcttttckggagagtggatacaagatgctcttacaaggaggggagsygkcaaatgaagaagaggtgaccgttcttgaagattattatggagtaaatggtaatggagttccagtcatctatccgatgaatgggcattcccaaaatggtcacaaagctgtgaccaacggtctggatggaaaaaatgaatttgtatctaagagtctcgagagaagagcagtagctgctttgaacaagtttggtgagaatgcaaagatgatgtctgatcctatgtggatgaggaggctccaacctgcgcccgagccaactgtctcagttgtcgagaagccaactttggcaagtatttggtctgctaaagggggtactgggcgcttatttgttttaggggaggttgttcacatattcaggccacttgtttatgtacttctaatcagaaagtttgaaatcagatcatggaccccctggttagtgtcgctagctgtggaactgacaagtcttggcttccattcacatgcgactgatctaaatcataggggagggaaagtgcatcagctctcctcagctgagagggatgagttgaggaggagaaagatgatgtgggccctttatgtgatgagagatcctttctttgccagttataccaagcgtcatctccagaaggctgaacaggtgctgaatccggtgccattgattggtttccttacaggtaaacttgtagagctactggaaggggttcagacaagatatacatacacgtcaggttcatagagatggcaggatagatgtctgagcttggttcctgatttggaggaccttcttgcttcgtgtgagttggtggatgggttatgttttactggcctaaaacttgtgcccagacctgcattcccatttcctcggcaggtgtggcattgttgtcttatgagttatgacatatatgaggctgctaagctgcggccactttcatccatattggcagatgagaactaagaatccaagtatataattctaatgcggatgtaatgctaagaaccggcactatatctggaacgcatcatgcatgagctaatgg

SEQ ID NO: 39349 - protein, 374 aa, Panicum virgatum
  misc_feature: Ceres CLONE 1997912
  misc_feature (1)..(367): Pfam Name: Pex16 Pfam Description: Peroxisomal membrane protein (Pex16)
  misc_feature (123)..(123): Xaa is any aa, unknown, or other
  misc_feature (136)..(136): Xaa is any aa, unknown, or other
  misc_feature (137)..(137): Xaa is any aa, unknown, or other
MEAYKLWVRRNRDLVRSLESLANGLIWILPERFANSEIAPEAVYSLLGIVSSVNQHIIDAPTENHAFASKEQSIPWGLVVSVLKDVEAVVEVAAQHFVGDDRKWSFLAVTEAVKAGVRLAAFXESGYKMLLQGGEXXNEEEVTVLEDYYGVNGNGVPVIYPMNGHSQNGHKAVTNGLDGKNEFVSKSLERRAVAALNKFGENAKMMSDPMWMRRLQPAPEPTVSVVEKPTLASIWSAKGGTGRLFVLGEVVHIFRPLVYVLLIRKFEIRSWTPWLVSLAVELTSLGFHSHATDLNHRGGKVHQLSSAERDELRRRKMMWALYVMRDPFFASYTKRHLQKAEQVLNPVPLIGFLTGKLVELLEGVQTRYTYTSGS

SEQ ID NO: 39350 - DNA, 639 bp, Panicum virgatum
  misc_feature: Ceres CLONE 1997933
  misc_feature: Encodes the peptide sequence at SEQ ID NO. 39351
gttagtggacaaagcaggcaatctagcaatgaagagaataattgatgaaagaagagctcagtaccgtcgtaatcatgatgggaatagcaagcatgactggtggagacaaccttgggatgccagtgaggtggagggcctacatattacaatggacgactttgaggaagcaacaaaaatggttcaaccatccttgagaagagaagggttttcatctgtgcctgatgtcacatggggtgatgttggaggtcttgattcattaaggaaagagtttgaccgctgcattattcgacgtatcaagcatcctgaagattatgaggtgtttggagtgaatatgcaagctggcttcctgttgtttggacctccaggatgtgggaaaacactaattgcaaaagcagtggcccatgaggcaggggctaattttattcatatcaaggggcctgaactattgaacaagtatgttggggaaagtgaatcagaagtgaggaaaatattcactcgtgcacgcacaaattccccatgcatcctatttttcgatgaggtagatgctttgacaacaaagagagggaaagagggaggatgggttgttgaacgtctcctaaatcagttacttattgaacttgatggtgctgatcaacggca

SEQ ID NO: 39351 - protein, 212 aa, Panicum virgatum
  misc_feature: Ceres CLONE 1997933
  misc_feature (114)..(212): Pfam Name: AAA Pfam Description: ATPase family associated with various cellular activities (AAA)
  misc_feature: SWISSPROT Homolog: EC 3.6.4.3 Microtubule-severing ATPase
LVDKAGNLAMKRIIDERRAQYRRNHDGNSKHDWWRQPWDASEVEGLHITMDDFEEATKMVQPSLRREGFSSVPDVTWGDVGGLDSLRKEFDRCIIRRIKHPEDYEVFGVNMQAGFLLFGPPGCGKTLIAKAVAHEAGANFIHIKGPELLNKYVGESESEVRKIFTRARTNSPCILFFDEVDALTTKRGKEGGWVVERLLNQLLIELDGADQR

SEQ ID NO: 39352 - DNA, 697 bp, Panicum virgatum
  misc_feature: Ceres CLONE 1997948
  misc_feature: Encodes the peptide sequence at SEQ ID NO. 39353
atgtcgtccttacgcatagctagggtttgcgactgcagcgctcgtggcctctcccaagcgcagcaatcatgccgaagcaaatccatgagatcaaggacttccttctcacagcgagaaggaaggatgcccgctccgtgaggatcaagaggagcaaggatgccgtcaagttcaaggttcgctgctccaagtacctctacacactgtgtgtctatgacactgagaaggccatcaagctgaagcagtctctgcctcctggcttgaacgtgcaggaggtttaagctttggaaatagtgactacagcaccggtgctggttgcttcaaagatttgccaatctaccttaaatttagtttctgtatgtgacctccgactgttttaaatgaattgctgtgattgagacgaaatgttatgtggaagtaatgtgatggctggcgagcctcgatttgataaaaaaagactcctccaaacccttgcgccggcgcctccacttcgcttcctcacctcatctcctcgcgctcagggtccggcgccgaagggaggcaagatgtacaccgcgaggaagaagatccagaaggagaggggcctcgagccctccgagttcgaggactccgtcgctcaggccttctttgacctggagaatagcaaccaggagctcaagagcgacctcaaggacctctacatcaacaatgctatccagat

SEQ ID NO: 39353 - protein, 69 aa, Panicum virgatum
  misc_feature: Ceres CLONE 1997948
  misc_feature (2)..(69): Pfam Name: Ribosomal_L38e Pfam Description: Ribosomal L38e protein family
MPKQIHEIKDFLLTARRKDARSVRIKRSKDAVKFKVRCSKYLYTLCVYDTEKAIKLKQSLPPGLNVQEV

SEQ ID NO: 39354 - DNA, 650 bp, Panicum virgatum
  misc_feature: Ceres CLONE 1997951
  misc_feature: Encodes the peptide sequence at SEQ ID NO. 39355
aaaaaaaaaaaaaaaaattctactcggcccaactcaaaggagggtggtgtgagtgtgaccgagactccgagagagatcagacgaggagagaacggagcagtagaagcagctccgcggcgtgccggaagccccaccggcgtaagggatcggagctacccgcctgccgttggcaacaccagtgagccgccggcgcgaggccccgtccaagtccacggcgcgcccaagggcggctcgccggcgaggagcacggccgccatggctgccggcggcggcgaggtgaagtacatccacagcaacgagagcaccaagacgctcctcaagagcgaggccctctacgagtacatgctcaacacgatggtgtacccgcgggagaacgagcacctgcgcgagctccgcctcatcaccgagcagcacacctacgggttcatgctgtcgccgccggacgaggagcagctgctgtcgctgctgctcaaggtgatgggcgcccggaacaccatcgaggtcggcgtcttcaccggcggctccgtgctcgccaccgcgctcgccatccccgacgacggcaggatcgtggccatcgacgtcagccgcgagtacttcgacctcggccggccccgtctcgagaaggccggcgtcgcgcacaaggtcgactt

SEQ ID NO: 39355 - protein, 131 aa, Panicum virgatum
  misc_feature: Ceres CLONE 1997951
  misc_feature (31)..(131): Pfam Name: Methyltransf_3 Pfam Description: O-methyltransferase
  misc_feature: SWISSPROT Homolog: EC 2.1.1.104 Caffeoyl-CoA O-methyltransferase
  misc_feature: Useful for making plants with altered carbohydrate content
  misc_feature: Useful for making plants with altered cell wall content and/or composition
  misc_feature: Useful for making plants with altered lignin content
MAAGGGEVKYIHSNESTKTLLKSEALYEYMLNTMVYPRENEHLRELRLITEQHTYGFMLSPPDEEQLLSLLLKVMGARNTIEVGVFTGGSVLATALAIPDDGRIVAIDVSREYFDLGRPRLEKAGVAHKVD

SEQ ID NO: 39356 - DNA, 552 bp, Panicum virgatum
  misc_feature: Ceres CLONE 1997957
  misc_feature: Encodes the peptide sequence at SEQ ID NO. 39357
actcagaggtatcgctccgctcccctccccgctcctccctaccctggctcttatcgtctcgtggttggatcactgctgcttctataccctttgttcccagatgatttgcgggattttttttctcacgtaaacctctcgtttccgcacagatttgccggcgcgtttactgctggtttggctcccttcagatcgaataggcgagttcagtgatccatggacgcttgatctgacgcgattaccgtgcgaagctgtcaaagcatgtatccgctgattctgaattggcacactgcaagaattataaactgaactgtaagatggcatcagcggagctttcccgtgaggagaatgtgtacatggccaagctcgctgagcaggctgagaggtacgaggagatggttgagttcatggagaaggtagccaagactgttgactcagaggagctcactgtcgaggagcgcaacctcctttctgttgcgtacaacaatgtcattgaagcccgccgtgcttcgtggcgcatcatctcctcgattgaccacaaagaggagggccgag

SEQ ID NO: 39357 - protein, 79 aa, Panicum virgatum
  misc_feature: Ceres CLONE 1997957
  misc_feature: The sequence is a functional homolog of SEQ ID NO 786 in the 11/479,226 US patent application
  misc_feature: The sequence is a functional homolog of SEQ ID NO 789 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 801 in the 11/479,226 US patent application
  misc_feature: Useful for making plants with modulated water use efficiency
  misc_feature: The sequence is a functional homolog of SEQ ID NO 809 in the 11/479,226 US patent application
  misc_feature: Useful for making plants with modulated drought sensitivity
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
MASAELSREENVYMAKLAEQAERYEEMVEFMEKVAKTVDSEELTVEERNLLSVAYNNVIEARRASWRIISSIDHKEEGR

SEQ ID NO: 39358 - DNA, 1300 bp, Panicum virgatum
  misc_feature: Ceres CLONE 1997958
  misc_feature: Encodes the peptide sequence at SEQ ID NO. 39359
aaccggagagcaacagccgagctcatagaaatcctctgaaaaatctgaattgcagactccgccgagcttacgagcagcagcaatggcgaagctctgcacattgctgctggccgcggtgctcgtcctctcgctcctggcgagccccattgcctgcacccgcaagctcagcaagcccaagcacaaggccaaggccaagccagtcggccacaggacggcgccggccgcggccaagccgaagccaaacccagtcagccacaggacggcgccggctgcggccaaggcgaagccgaacccggtcagctacaagccggcgccagctgcggcgaggcctccccgcagcaaccacaccgctaggcactcgccgccgatcgtctacggcggcgcctggctctccggcgccggcgccacgtactacggcgcgcccaacggcgacggcagcgacggcggcgcgtgcgggtaccagaccgccgtcgggaagcagccattcgactcgatgatcgccgccgggagcacgccgctgtacatggacggcgaggggtgcggcgcctgctacgaggtcaagtgcacgaccaacgcggcgtgctccggccagccggcgacgatcgtgatcaccgaccggtcccccggcgacctgttccccggcgaggtcgtccacttcgacatgagcggcaccgcgatgggcgccatggcgaggcccggcatggccgacaagctccgcgccggcggcgtcctgaggatcctgtaccggcgggtgccgtgcaagtaccccggcgtgaacgtggccttcaaggtggaccagggcgccaaccccttctacttcgacgtgctcatcgagttcgaggacgacgacggcgacctcaaggccgtcgacctgatggaggccggcagcaacgtgtgggcgcccatggcgcacaactggggcgccacgtggcggctcaacaacggcaggaagctcaacgcaccgttcgggctccggctcacctccgactccggcagggtgctcgtcgccaacaacgccatccccgccgcgtggaagcccgggaagacgtaccgctccctcgtcaactacccctgaaaggagggattcttcggaggagtccatgcccatggcgggtaatgtgaagaggaggagaaggttgaagaagagaatggcgttcttccctccctcctcacggtctctgtttgcagtccccaagtgatgtgtgactgtgtgagacatgtctgtaatttcaattttttttttcattccggtttgttattagttggtgctggtacttgaggaaagagagaagcttgtccg

SEQ ID NO: 39359 - protein, 330 aa, Panicum virgatum
  misc_feature: Ceres CLONE 1997958
  misc_feature (233)..(314): Pfam Name: Pollen_allerg_1 Pfam Description: Pollen allergen
  misc_feature (139)..(221): Pfam Name: DPBB_1 Pfam Description: Rare lipoprotein A (RlpA)-like double-psi beta-barrel
  misc_feature: Useful for making plants with altered carbohydrate content
  misc_feature: Useful for making plants with altered cell wall content and/or composition
MAKLCTLLLAAVLVLSLLASPIACTRKLSKPKHKAKAKPVGHRTAPAAAKPKPNPVSHRTAPAAAKAKPNPVSYKPAPAAARPPRSNHTARHSPPIVYGGAWLSGAGATYYGAPNGDGSDGGACGYQTAVGKQPFDSMIAAGSTPLYMDGEGCGACYEVKCTTNAACSGQPATIVITDRSPGDLFPGEVVHFDMSGTAMGAMARPGMADKLRAGGVLRILYRRVPCKYPGVNVAFKVDQGANPFYFDVLIEFEDDDGDLKAVDLMEAGSNVWAPMAHNWGATWRLNNGRKLNAPFGLRLTSDSGRVLVANNAIPAAWKPGKTYRSLVNYP

SEQ ID NO: 39360 - DNA, 667 bp, Panicum virgatum
  misc_feature: Ceres CLONE 1997963
  misc_feature: Encodes the peptide sequence at SEQ ID NO. 39361
cttcttcggttcatcctccccgacccggagcacgagcagccagtcccgtcccgtcgtctctaaccctacagcgccgacgacgacgaggccatgagggggaagaagcagctcatggatctgaagctctccgtgccggcgcaggagagccccgtcgacaagttcctgacggcgagtggcacattcaaggatggcgaactgcggcttaatcaaagcggcttgcggcttatctccgaggaaaatggggatgaagatgaatcaacaaagctgaaagttgaagatgtgcagttatcgatggatgatcttgagatgattcaagtcattggtaaaggaagtggtggtgttgtccagctagtgaggcacaaatgggtggggacattgtacgccttaaagggtattcaaatgaacattcaggagtcagttcgcaaacaaatagtacaagagctcaaaataaaccaggcaacacaaagccctcatatagttctgtgccatcaatctttttaccacaatggtgtaatatatcttgttcttgagtacatggatcgtggatctcttgcagacatcattaagcaagtgaagacagttatggaaccataccttgcggtactctgtaagcaggtcttggagggtctattatatcttcatcatgaaaagcacgtgattcacaggg

SEQ ID NO: 39361 - protein, 192 aa, Panicum virgatum
  misc_feature: Ceres CLONE 1997963
  misc_feature: SWISSPROT Homolog: EC 2.7.12.2 Mitogen-activated protein kinase kinase
MRGKKQLMDLKLSVPAQESPVDKFLTASGTFKDGELRLNQSGLRLISEENGDEDESTKLKVEDVQLSMDDLEMIQVIGKGSGGVVQLVRHKWVGTLYALKGIQMNIQESVRKQIVQELKINQATQSPHIVLCHQSFYHNGVIYLVLEYMDRGSLADIIKQVKTVMEPYLAVLCKQVLEGLLYLHHEKHVIHR

SEQ ID NO: 39362 - DNA, 1333 bp, Panicum virgatum
  misc_feature: Ceres CLONE 1997984
  misc_feature: Encodes the peptide sequence at SEQ ID NO. 39363
gaggccgcccgcccgccaccgcccagcccaccgccacccggccggcagcagaggggagcggggcgcagcgggcaggggcagctgcagagccacacgcgcgcgcggacgcacagcagggcgcggccatcatggcgccaccctcctcctcgtcctcgtcctcgtcctcgtcctcctccttcagggccctggccaccgccctgtgcctcctcctccacctgtccctgcgggccgccgcggccatggaccccgccgagcgggaggcgctgctccgcgtcatggaggccgtctcgtcggaccgcgactggcgcgaggccgccggcgccgacccctgcagctcgccgtggccggggctcgagtgcaagccggcgcccggcggcggggggcccgcggcgcggatgcacgtcgcgcggctcgacttcggggtgccgcccaacccgacgtgcaaggacacggccacgttcccgctcggcgcgttcgcgctgccggagctccgggcgctgttcctcgtcggctgcttcaagaacccggacgccatcaccgccttcaccctgccgccgccggccaacctctcggcgtcccgcctgcagcagctcagcgtccgctccaacccgtcgctgtccggcacgttgccgccgcagctcgccagcatcaagtcgctccaggtgctcaccgtgtcgcagaacgcgctcatccgcggtgaggtcccgcagggcctcggcgagctcaggaacctggtgcacctcgacctcagctacaactcgctcaccggcccgatcccgagccggctcggcgagctgcgcggcctggtcggcctcgacctcagctacaactccttctccgggcccatccccagccggcttggcgagctcaccctgctgcagaagctggacctgagctcgaacaacctcaccggcggcgtcccggccaccgtcacccgcctgaaattgctcaccttcctggccttaagcaacaacgggctgcgcggccgcctccccgccggcctctccgacctccgcgacctgcagtacctgatcatggagaacaacccgatgggcgtcccgctgccgcccgagctgggcaacatcgcgcggctccaggagctccggctggccaactcgggcctctcgggctcgataccggagacgttcgggctcctgtccagcctgacgacgctgtcgctggagaacaacaacctaaccgggcagatcccggcggggctgagccggctgaagcggatgtaccacctgaacctgagcaagaacgggctggacggcgtggtgccgttcggcggcgcgatcctgcggcagctgggggcggaacctggacctgagcg

SEQ ID NO: 39363 - protein, 401 aa, Panicum virgatum
  misc_feature: Ceres CLONE 1997984
  misc_feature: SWISSPROT Homolog: EC 2.7.11.1 Non-specific serine/threonine protein kinase
MAPPSSSSSSSSSSSSFRALATALCLLLHLSLRAAAAMDPAEREALLRVMEAVSSDRDWREAAGADPCSSPWPGLECKPAPGGGGPAARMHVARLDFGVPPNPTCKDTATFPLGAFALPELRALFLVGCFKNPDAITAFTLPPPANLSASRLQQLSVRSNPSLSGTLPPQLASIKSLQVLTVSQNALIRGEVPQGLGELRNLVHLDLSYNSLTGPIPSRLGELRGLVGLDLSYNSFSGPIPSRLGELTLLQKLDLSSNNLTGGVPATVTRLKLLTFLALSNNGLRGRLPAGLSDLRDLQYLIMENNPMGVPLPPELGNIARLQELRLANSGLSGSIPETFGLLSSLTTLSLENNNLTGQIPAGLSRLKRMYHLNLSKNGLDGVVPFGGAILRQLGAEPGPE

SEQ ID NO: 39364 - DNA, 1230 bp, Panicum virgatum
  misc_feature: Ceres CLONE 1997985
  misc_feature: Encodes the peptide sequence at SEQ ID NO. 39365
atatcacacccatctttgacatcccccaccaaaaacatttacaccaaaagagttgcagttgctacacgctccacgccacccttcctctcgtcctcctcactttccatggagaagagccgggtgctcgtcgtgggcggcacgggctacatcggccgtcggatcgtgcgggcgagcctggcgcaggggcaccccacgctcgtcctgatgcggccggagatcggtctcgacatcgacaagctccagatgctgctgtccttcaaggcccagggcgcgcgcctggtggaggcgtcgctggacgaccacgcggggctcgtcgccgccgtttcgcaggccgacgtggtggtctcggccatgtccggggcgcacatccggagccacaacttacacttgcagcacaagctcgtcgaggctatcaaggaggccgggaacgtcaagcgtttcataccatcggaatttggcatggacccatcgaggatgaggcatgctcttgaaccaggaagggttacatttgatgaaaagatggagataagaagggcaatagaagaggcgaacattccccacacgtatgtttctgctaatttctttgctgcttactcttgtcctaacctctgtcaaatgcgcacccttttgccacccaaagagaaagttcatgtatacggcgacggcaacgtcaaagcgatatttgttgatgaagatgatgttgcaacatatacaattaagtccattgatgatcctcgcaccttgaacaagacaatatacataagaccacaagaaaacattctcactcagaatgaagtgattgcaaaatgggaaaagctctctggaaaagttctggagaaaatccacgttcatgcagatgaattcttggcttcaatgaaaggtactgaccttgccaatcaagtcggagtgacccactactaccactttttctacgaaggttgcttgacaaactttgaaataggggaggatggagcagaggctactcgcctgtacccagacgttcagtacaaccgtatggacgagtacatgaagatatatttgtaatagcaaaatttgaaaatttgttgtgggtctatcttaacatatcaatatccatggacactgtgtttgaattattttgtattgcattatgtattgacaacaaatactacttcctgtattaagccctactgtccagaatgataatatatggatcaataaagatgagaggcccaagttccttttgttctt

SEQ ID NO: 39365 - protein, 312 aa, Panicum virgatum
  misc_feature: Ceres CLONE 1997985
  misc_feature (6)..(303): Pfam Name: NmrA Pfam Description: NmrA-like family
  misc_feature: SWISSPROT Homolog: EC 1.3.1.45 2'-hydroxyisoflavone reductase
MEKSRVLVVGGTGYIGRRIVRASLAQGHPTLVLMRPEIGLDIDKLQMLLSFKAQGARLVEASLDDHAGLVAAVSQADVVVSAMSGAHIRSHNLHLQHKLVEAIKEAGNVKRFIPSEFGMDPSRMRHALEPGRVTFDEKMEIRRAIEEANIPHTYVSANFFAAYSCPNLCQMRTLLPPKEKVHVYGDGNVKAIFVDEDDVATYTIKSIDDPRTLNKTIYIRPQENILTQNEVIAKWEKLSGKVLEKIHVHADEFLASMKGTDLANQVGVTHYYHFFYEGCLTNFEIGEDGAEATRLYPDVQYNRMDEYMKIYL

SEQ ID NO: 39366 - DNA, 708 bp, Panicum virgatum
  misc_feature: Ceres CLONE 1997989
  misc_feature: Encodes the peptide sequence at SEQ ID NO. 39367
aaacacacacacaacatacgatcgagcactactaatcccgaagatcagcaccctgctgtgctgtagctagctggtacgacgacgatcgagctgggatagatgatggccgccaccgtgacgatcgtctcctcctccaaggcggctgcggtggcactcgccgtcgcgctgttcgccgtgcttgccgcgtacggcgccgaggccgccaagcccggcggcggctggctcccggccaaggccacctggtacggcgcgcccaacggcgccggccccgacgacaacggtggcgcgtgcgggttcaagcacaccaaccagtacccctacatgtccatgacgtcgtgcgggaacgagcccctcttcaaggacggcaagggctgcggcgcctgctaccagatacggtgcctgaacagcacccacgacgcgtgctccggccgggcgaagcgcgtgatcatcaccgacatgaactactacccggtggccaagtaccacttcgacctcagcggcacggcgttcggcgccatggccagggcggggctcaacgacaagctccggcacgccggcatcatcgacatccagttccggcgggtgccctgcaactacaagggcctgaccgtcaacttccacgtccaggtcgggtccaaccccaactacttcgccgtgctggtgcagtacgccggcagggacggcgccgtggtgcaggtcgacctcatg

SEQ ID NO: 39367 - protein, 202 aa, Panicum virgatum
  misc_feature: Ceres CLONE 1997989
  misc_feature (78)..(159): Pfam Name: DPBB_1 Pfam Description: Rare lipoprotein A (RlpA)-like double-psi beta-barrel
  misc_feature: Useful for making plants with altered carbohydrate content
MMAATVTIVSSSKAAAVALAVALFAVLAAYGAEAAKPGGGWLPAKATWYGAPNGAGPDDNGGACGFKHTNQYPYMSMTSCGNEPLFKDGKGCGACYQIRCLNSTHDACSGRAKRVIITDMNYYPVAKYHFDLSGTAFGAMARAGLNDKLRHAGIIDIQFRRVPCNYKGLTVNFHVQVGSNPNYFAVLVQYAGRDGAVVQVDL

SEQ ID NO: 39368 - DNA, 673 bp, Panicum virgatum
  misc_feature: Ceres CLONE 1998006
  misc_feature: Encodes the peptide sequence at SEQ ID NO. 39369
acagcgcccgccacacgcacgcatcgcctctcctccactacccaaattcttgacattctgttcgcaatggcgctcgccacgaacgccgccgccgccgccgccgcctccgcggcagccgccatgtccggcgcggccgcgccgcagccccgtccacgcgcgccggcgttcctcccgctgaggcgccgctgcgccgtccgcgccgtgcacgccgcggagccgtccaaaggccacggcgtcccggcggccgcgaagacctcgtcgccgacggtcgcgcccgagaaggaggcggccccagtcgcggccccggccccgaaggcgctcccgaagtgggcggtggacagctggatggcaaagaaggcgctgcagcagccggagtacccgaacccggtggagctcgaggccgtgctcaagacgatcgaggccttcccgccgatcgtgttcgctggggaggcgcgccacctggaggagcgcctcgccgacgccgccatgggccgcgccttcctcctccagggcggcgactgcgccgagagcttcaaagagttcaacagcaacaacatccgggacaccttccgcgtcctcctccagatgtccgtcgtcctcatgttcggcgcccaaatgcccgtcatcaaggttggtaggatggccggacagttcgccaagcccgaggtcggag

SEQ ID NO: 39369 - protein, 202 aa, Panicum virgatum
  misc_feature: Ceres CLONE 1998006
  misc_feature (87)..(202): Pfam Name: DAHP_synth_2 Pfam Description: Class-II DAHP synthetase family
  misc_feature: SWISSPROT Homolog: EC 2.5.1.54 3-deoxy-7-phosphoheptulonate synthase
MALATNAAAAAAASAAAAMSGAAAPQPRPRAPAFLPLRRRCAVRAVHAAEPSKGHGVPAAAKTSSPTVAPEKEAAPVAAPAPKALPKWAVDSWMAKKALQQPEYPNPVELEAVLKTIEAFPPIVFAGEARHLEERLADAAMGRAFLLQGGDCAESFKEFNSNNIRDTFRVLLQMSVVLMFGAQMPVIKVGRMAGQFAKPEVG

SEQ ID NO: 39370 - DNA, 1408 bp, Panicum virgatum
  misc_feature: Ceres CLONE 1998021
  misc_feature: Encodes the peptide sequence at SEQ ID NO. 39371
gccatttattaactaactgtattaatcccggctcctccgcctcctccgccgagaggcgaccaaccagcccccaatcgcagcccacgcgcgcaaaccctagcccggccagccagccagccaacgaccggccaatggcggaggacggcggcgaccggggccagcagcagcagcagcagccgcccgcggcggaggggcgcggcagggagagcgtgaagctgttcgtggggcaggtgcccaaggagatgtccgagcccgagctcgccgccatgttcggccgcgtggcgctcgtcgacgaggtcaccgtcatccgcgacagggccaccagggtctcgcgaggctgctgcttcgtgatctgcccatcaagggaggaggcggacaaggctgtgactgcatatcacaacaagtgcacactacctggggcctcaagtccattgcaagtaaaatatgctgatggagagttggaaagattggagcacaaactttttgttggaatgctcccaaaaaatgtaacagatgctgaaatgactgacttattttcacaatatgggaatatcaaggatttgcagattttgagaggttcgcaacaggcaagcaaagctggttgtgcctttctcaaatatgaaacaaaakagcaagctgtggctgcgatagaagctctaaatggaaagcacaagatagagggttcaagtgttcccttggttgtcaaatgggctgacactgaaaaggaaagacaggctcgaaaagcacagaaagctcaattccagtcttctaacatgttgaatgcaaatgcaatgcagcagacctcattgtttggagctttacagatgggatatgtacctcagtacaatggatttggctaccagccacaaggaacctacggacttatgcagtaccctcctctatctcctatgcaaaatcaagctgccttccagaatatggttcagcctgttaatcaagcaagctcaatccgtggagctaattctgaagtttcccctaactcagttcctagatcatttagttcaacacagttaggaagcccctattcacctctgcctggcatacagtatcctgggacgtatcctggtggtgcaattaacaatcatccttttgcaaattctcacaattcaatcagagttctaaatgcaaatgctaattcacccacgtcttcgggtgccagcagcaatcctggtccccagatagaaggtcctcctggagctaacttgttcatataccacataccacaagaattcggtgaccatgatcttgcaagtgcatttcagagttttggtagagttttgagtgctaaagtttttgtagacaaggcaactggtgttagtaaatgctttggttttgtaagctatgattctccagcctctgcacaaacagccattagtatgatggaatggat

SEQ ID NO: 39371 - protein, 425 aa, Panicum virgatum
  misc_feature: Ceres CLONE 1998021
  misc_feature (117)..(189): Pfam Name: RRM_1 Pfam Description: RNA recognition motif. (a.k.a. RRM, RBD, or RNP domain)
  misc_feature (29)..(101): Pfam Name: RRM_1 Pfam Description: RNA recognition motif. (a.k.a. RRM, RBD, or RNP domain)
  misc_feature (364)..(421): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (167)..(167): Xaa is any aa, unknown, or other
MAEDGGDRGQQQQQQPPAAEGRGRESVKLFVGQVPKEMSEPELAAMFGRVALVDEVTVIRDRATRVSRGCCFVICPSREEADKAVTAYHNKCTLPGASSPLQVKYADGELERLEHKLFVGMLPKNVTDAEMTDLFSQYGNIKDLQILRGSQQASKAGCAFLKYETKXQAVAAIEALNGKHKIEGSSVPLVVKWADTEKERQARKAQKAQFQSSNMLNANAMQQTSLFGALQMGYVPQYNGFGYQPQGTYGLMQYPPLSPMQNQAAFQNMVQPVNQASSIRGANSEVSPNSVPRSFSSTQLGSPYSPLPGIQYPGTYPGGAINNHPFANSHNSIRVLNANANSPTSSGASSNPGPQIEGPPGANLFIYHIPQEFGDHDLASAFQSFGRVLSAKVFVDKATGVSKCFGFVSYDSPASAQTAISMMEW

SEQ ID NO: 39372 - DNA, 637 bp, Panicum virgatum
  misc_feature: Ceres CLONE 1998022
  misc_feature: Encodes the peptide sequence at SEQ ID NO. 39373
acacacacgcacaagctcatcgcacagctcagcttcgactcgtctcgagcaagaaatagctttcgtcaccaactcgtcttcttggaggagggccggccggcgagagatttatttacggttgaggaggagatggaggtcgccgccgccgcagcgagctacgtggccgacgacgttgacagctgcctgaaggcgaccgagctgaggctcggcctgccgggcaccgaggagacggcgccgccgacgccgccgtccacgcccagaggcaagaagcgcgaggggaacagcgccggcgccgaggaggcagccaagaccgcgccgccggccgccaaggctcaggtggtggggtggccgccggtgaggtcctaccggaagagctgcttccagcagtccagcagcgccgccaagagcaagccggcactggcgccggcgccggaggagaaggccccggccgcgcctgccgccgccgccggtggaaacgcggcgctgttcgtcaaggtgagcatggacggagccccctacctgaggaaggtcgacctcaagatgtacaagggctaccgcgagctcagggaggccctggaggccatgttcctcggcttctccggcggcggcgccgacgcgccggccgtcaacccctcgg

SEQ ID NO: 39373 - protein, 169 aa, Panicum virgatum
  misc_feature: Ceres CLONE 1998022
  misc_feature (19)..(166): Pfam Name: AUX_IAA Pfam Description: AUX/IAA family
MEVAAAAASYVADDVDSCLKATELRLGLPGTEETAPPTPPSTPRGKKREGNSAGAEEAAKTAPPAAKAQVVGWPPVRSYRKSCFQQSSSAAKSKPALAPAPEEKAPAAPAAAAGGNAALFVKVSMDGAPYLRKVDLKMYKGYRELREALEAMFLGFSGGGADAPAVNPS

SEQ ID NO: 39374 - DNA, 1413 bp, Panicum virgatum
  misc_feature: Ceres CLONE 1998031
  misc_feature: Encodes the peptide sequence at SEQ ID NO. 39375
tctcaatcaattattgctccaattcattgcaacatgctgatcactgaaatttgtggatgtgcctgatctgaaactatagtacagatgatacaaagtcaagtttgcctctataaccccaaaaaggatgcttaattagtgtaaagaggatgcatctttacctaccataacacttaaaaaaacttaacaaggttttagagatagctggtcattcatctatgcattctaagagctattgtgttctatgaatcatttgtttggttgcaaggtgcatgtattgcaaataagaagcatcatgaagttaacggcataaatatgagaaatatagaagagcatgtcagtgttttttgtacatgcatatctactcacatcaggtatatttgtaaagtttggtacttttgttataccttcataaagtgctttaatttttttagaaaaacattcataacaatatcacaagacgttttctcagatggtgtcgtatggttttattgtttgcatgttggattcttgggagacctgtctttcgacacacacctatgcacttccatattgctagggtaataagcttccacactctaataaacatgttggagggctacttcttggttttgttttgtttttcctcgtcacataatgcmawgataataagcgtatttccagtttgttaagggtgtggatctgcactcaaatgatttagagttctccacattacaagaatctttccagccagtgtgcctgtggatctgcagctcaagcggtggttccctgcgagcgtcgattggctcgtctcggcgcgaggatttgatgttggagttctatccaccatgtagctcgtccgcagccttgcgcctgtgcaaacgccggcatcctcatcgtggctgcaggacgtccagttatgtaacctgctggctgtgctcttgttgctcatccattgaaggcttgttgctgacccatgtgtgtggttcctcatgtaaaatggcatcgctaccctataaggactcttctcaaggcgacaatcagaaactgtgataaattcgagatcattgccactggtaaggatgtcaagaagattactgattgggagaacagtgcaccaaaggtccaaagcaagttgaaattccattcaagtcagcctatgattctctcttgtactgattgcaacagttttttgtttgcgtatatccaactttgagttggaaatattcatgttaatagcttttggttccagtaatcttacaattggattggattcaacttttttattatatctgaaatacttgtatagagagtttacatagtacttcacttgggacaaggataaaatgttaaggaagcctagagaacatcggactcagattgggaagctggtgtatatatgtgcattgtattttcaactatgttacagattatctc

SEQ ID NO: 39375 - protein, 79 aa, Panicum virgatum
  misc_feature: Ceres CLONE 1998031
  misc_feature: SWISSPROT Homolog: EC 4.2.1.3 Aconitate hydratase
MCVVPHVKWHRYPIRTLLKATIRNCDKFEIIATGKDVKKITDWENSAPKVQSKLKFHSSQPMILSCTDCNSFLFAYIQL

SEQ ID NO: 39376 - DNA, 1381 bp, Panicum virgatum
  misc_feature: Ceres CLONE 1998033
  misc_feature: Encodes the peptide sequence at SEQ ID NO. 39377
gaagccttttcaaaatccaaatcaactccccgcagacgcccccaaagaccaccgccgctgcctgcgcaccacccaggcctcagctcgagcccaacgaccggcggcccggcgcctagacgcggctgggcggtcggcctcacctcacctccccccgcgcctcccttcttcctcctccgcgtctcgatctcgcctccccgccacccggccagatctcgccctcccggcgctgcggccatggagaacctgatctccctcgtcaacaagctgcagcgggcctgcacggccctcggcgaccacggcgaggagagcgccctcccaacgctctgggactcgctgccggccatcgccgtcgttggaggccagagttctggcaaatcttcggtgttggagagcgtggttgggaaggatttcctaccgaggggttcaggcattgtcactcggcgtccactggtgctgcagctccacagaatcgacggagacagggaatatgccgagtttatgcaccaacccaggaagagatatacagattttgctgctgtgaggaaggagatagctgatgaaactgacagagaaactggtcgttcaaagcaaatatcacctgtccctatccatttaagcatctattctccatatgttgtgaatctgactcttattgatcttcctgggcttactaaagtagctgttgagggtcaaccagacagtattgttcaggacattgaaaacatggttcgatcatacattgaaaagccaaattgtatcattctggccgtttccccagctaatcaggatcttgcaacttctgatgcaatcaagatttcgcgagaagttgatcccaaaggagaaagaaccttcggtgtgctcacgaaaattgatctgatggacaagggtactgatgctgttgatatactggaaggaagatcttaccggctccaacatccatgggttggtgttgttaatcgatcccagcaagatatcaacaaaaatgtggacatgattgctgctaggcgtagagagcgtgattatttttccagtacaccagaatataagcaccttgcccctaggatgggttctgaatatttggccaagatgctctcaaagcatttggagcaagtgattaaatcaaggattccgggcatccaatctcttataacaaagacaattgcagagctggagactgaactcaatcgacttggaaagcccattgctaatgatgctgggggcaagttgtacacaattatggaaatatgccgtatgtttgacggcatttacaaagagcatctggatggagtgcgccctgggggtgagaaagtttaccatgtcttcgacaatcaatttcctgtagcaattaaacggttgcagttcgataaacaactctcaatgg

SEQ ID NO: 39377 - protein, 382 aa, Panicum virgatum
  misc_feature: Ceres CLONE 1998033
  misc_feature (37)..(212): Pfam Name: Dynamin_N Pfam Description: Dynamin family
  misc_feature (221)..(382): Pfam Name: Dynamin_M Pfam Description: Dynamin central region
  misc_feature: SWISSPROT Homolog: EC 3.6.5.5 Dynamin GTPase
MENLISLVNKLQRACTALGDHGEESALPTLWDSLPAIAVVGGQSSGKSSVLESVVGKDFLPRGSGIVTRRPLVLQLHRIDGDREYAEFMHQPRKRYTDFAAVRKEIADETDRETGRSKQISPVPIHLSIYSPYVVNLTLIDLPGLTKVAVEGQPDSIVQDIENMVRSYIEKPNCIILAVSPANQDLATSDAIKISREVDPKGERTFGVLTKIDLMDKGTDAVDILEGRSYRLQHPWVGVVNRSQQDINKNVDMIAARRRERDYFSSTPEYKHLAPRMGSEYLAKMLSKHLEQVIKSRIPGIQSLITKTIAELETELNRLGKPIANDAGGKLYTIMEICRMFDGIYKEHLDGVRPGGEKVYHVFDNQFPVAIKRLQFDKQLSM

SEQ ID NO: 39378 - DNA, 485 bp, Panicum virgatum
  misc_feature: Ceres CLONE 1998033-R
  misc_feature: Encodes the peptide sequence at SEQ ID NO. 39379
accgaaatctattgtgtattgtcaagtccgtgaggcaaagcgctcacttctcgaccactttttcactgaactaggagcaagagagatgaagcaactttccaagcttcttgatgaagaccctgcagtcatggaacgaagaactaacctcgccaaaaggctggaactgtaccggagcgcccaagcagaaatcgatgcagttgcgtggtccaaataatcttgctggcctacctaccctgttcttgcatgctctctactccttgtttggtgattctcccctattctgggggcatatatagctgatttttttcctgttgtaggtaaggtcatttatagatcaccgcagctgtacggtgtcatttggtttgtgcttttgttccttgtgcttgaggatctaggggacaccaggctgctgtacttctgtatcacgacaagttcatatattgtgcttctattaccgtgtattattttattccatccgtgtgcgg

SEQ ID NO: 39379 - protein, 70 aa, Panicum virgatum
  misc_feature: Ceres CLONE 1998033-R
  misc_feature (1)..(66): Pfam Name: GED Pfam Description: Dynamin GTPase effector domain
  misc_feature: SWISSPROT Homolog: EC 3.6.5.5 Dynamin GTPase
PKSIVYCQVREAKRSLLDHFFTELGAREMKQLSKLLDEDPAVMERRTNLAKRLELYRSAQAEIDAVAWSK

SEQ ID NO: 39380 - DNA, 654 bp, Panicum virgatum
  misc_feature: Ceres CLONE 1998053
  misc_feature: Encodes the peptide sequence at SEQ ID NO. 39381
gcccggccgtctcgccacccgcagcgatggcggtcgtcgaagaagatgcggcgcctgcagccgccgcctccgcttctgatcccaccgctggctccagtgataatgagattacagtggatgaggcgtcttttgtgcatactgaacctccacaggatggcagtgccccacccctggtttcctctgctatggaagtccttcatgataaagtcaagaaacaggtcatcaaagaaggacacggcaagagaccgttgaagttcgcgacgtgctttgtgcactatagagcatgggttcaaggatcatctcataaatttgaggatacgtggcaggagcagcatccaatcgaattagtacttggaaaagagaaaaaggaaatgtctggtttaggcattggtgttggcaacatgaaaagcggggagcgtgcattgttgcatgttggttgggagctaggctatggcaaagaaggaagcttttcattcccaaatgtccctccaatggctgaccttgtttatgaagttgagcttattggatttgatgatgtcaaagaggggaaagccagaagtgacatgacagttgaggagaggattgcagctgcagacaggagaaagattgagggcaatgaatatttcaaagaaaagaagcttgaggaggccatgc

SEQ ID NO: 39381 - protein, 209 aa, Panicum virgatum
  misc_feature: Ceres CLONE 1998053
  misc_feature (69)..(166): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MAVVEEDAAPAAAASASDPTAGSSDNEITVDEASFVHTEPPQDGSAPPLVSSAMEVLHDKVKKQVIKEGHGKRPLKFATCFVHYRAWVQGSSHKFEDTWQEQHPIELVLGKEKKEMSGLGIGVGNMKSGERALLHVGWELGYGKEGSFSFPNVPPMADLVYEVELIGFDDVKEGKARSDMTVEERIAAADRRKIEGNEYFKEKKLEEAM

SEQ ID NO: 39382 - DNA, 666 bp, Panicum virgatum
  misc_feature: Ceres CLONE 1998067
  misc_feature: Encodes the peptide sequence at SEQ ID NO. 39383
atcgacagcagagctcgcaaaacctccacaccttcctgaaatagccactagcttcaggttctctgagctccctgatcactctcgctctcagccttcctcgctgatccatataggttgccagctaccagccccattaactgatggagtttgacctgctcaattacagcccggaagcgcagctggagctgatgaacacgatgctccagctggagcagctcaccaagctcgacggcggccatgagtcgttgatggcgcccgtctcgccgccggtatccccggtgcaaacccatgcagcccactgcttctcgcctccgccacacgtgtcggcgaccgcggccgccaccggctactaccccgatcagggcacaccgccggccgcgtacgccggcagtatcggcctcgagcacctccaggtcgactacgtgctgtccccgtgcgccgacgccgccgccgcggcgcggccggcggggtcgccgtcgccgacgtcgtccgcggacgcgatgcgggaggtgatcttccacatcgcggcgctgcagccggtggagatcgaccaggaggcggtgcggcccccgaagcggcgcaacgtgcgcatctccaaggacccgcagagcgtggcggcgcggctgcggcgggagcgcatcagcgagcgcatccgcaccctgcagc

SEQ ID NO: 39383 - protein, 175 aa, Panicum virgatum
  misc_feature: Ceres CLONE 1998067
  misc_feature: Useful for biocontainment applications
MEFDLLNYSPEAQLELMNTMLQLEQLTKLDGGHESLMAPVSPPVSPVQTHAAHCFSPPPHVSATAAATGYYPDQGTPPAAYAGSIGLEHLQVDYVLSPCADAAAAARPAGSPSPTSSADAMREVIFHIAALQPVEIDQEAVRPPKRRNVRISKDPQSVAARLRRERISERIRTLQ

SEQ ID NO: 39384 - DNA, 1492 bp, Panicum virgatum
  misc_feature: Ceres CLONE 1998080
  misc_feature: Encodes the peptide sequence at SEQ ID NO. 39385
atttttatcccttcctcagccatcccctcccctctctcccctcaacccagcgcaacctcccgccgccgctagggtttctcctcccctcgccgcctcccccaaaatctccccaccggagcttctagagcctcgcgcggcccctccagcagccatgagcgacggcaaggactccctcgacctctccggcctcggcgccgccatccccaactcgaacgagctcagcgcggaggataaggctaacctcgtggcctcgatcaagaacacgctcgagggattggcgtcgcggcatatggacgtgctcgaaggcctcgaccccaaggtcaggaagcgtgtcgagaagctcagggagatccagggacaacacgatgaacttgaggcaaagttttttgaggagagagctgcacttgaagctaagtatcagaagttgtatgaaccactttactcaaagcgttacgaaattgtcaatggtgtgatcgaggttgaggcagaaagtgcagatgaaacccctgcagagcaaaagagtggaggtgaaactccttctgagcaaaaagaagaaaaaggtgtgccagctttctggcttaatgcaatgaagaaccacgaaatcctggctgaggagatccaggagagggatgaggaagctctcaagtacctcaaggacatcaagtggtacaggatcagcgaacctaagggttttaagcttgagtttcactttgataccaatccattcttcaagaattcagtgctcacaaaaacatatcacatgattgatgaggatgaaccaattctagagaaagccattggtactgatattgaatggtatgctgggaagtgcttgacacaaaaggtgctaaaaaagaagccaaggaaggggtcaaagaacactaaacctatcacaaaaactgaagactgtgatagcttcttcaacttcttcagtccacctcaagtccctgatgatgaggaggaaattgatgaggatacagctgaacagttgcagaaccaaatggagcaagattatgatatcggatctaccatcagagacaagattataccacatgctgtctcatggttcactggagaggctgctcaagatgatgactttgagggccttatagatggtgatgaggacgattatgaagaagatgaagatgaagatgatgaggatgaggaaagtgaagatgatcatgatacaaagaccaagggagctgctggaggggatgggcagcagggtgaacgacctgcagagtgcaagcagcagtgaggcgctgcacattgaatttatgcatacagcgggttctggaatgatgaaagtttggttctgcttgatgcaatgtcattgagttggttgtggagcccttggaggggcgtgtgttggttttgtggagtcggtggggggattcttctgggacttggtatcgttttcatatgttggtggttttgtcacttatgtattgggtttcagatattatgtgctcagcttatgctttgagtgatc

SEQ ID NO: 39385 - protein, 368 aa, Panicum virgatum
  misc_feature: Ceres CLONE 1998080
  misc_feature (58)..(312): Pfam Name: NAP Pfam Description: Nucleosome assembly protein (NAP)
MSDGKDSLDLSGLGAAIPNSNELSAEDKANLVASIKNTLEGLASRHMDVLEGLDPKVRKRVEKLREIQGQHDELEAKFFEERAALEAKYQKLYEPLYSKRYEIVNGVIEVEAESADETPAEQKSGGETPSEQKEEKGVPAFWLNAMKNHEILAEEIQERDEEALKYLKDIKWYRISEPKGFKLEFHFDTNPFFKNSVLTKTYHMIDEDEPILEKAIGTDIEWYAGKCLTQKVLKKKPRKGSKNTKPITKTEDCDSFFNFFSPPQVPDDEEEIDEDTAEQLQNQMEQDYDIGSTIRDKIIPHAVSWFTGEAAQDDDFEGLIDGDEDDYEEDEDEDDEDEESEDDHDTKTKGAAGGDGQQGERPAECKQQ

SEQ ID NO: 39386 - DNA, 735 bp, Panicum virgatum
  misc_feature: Ceres CLONE 1998086
  misc_feature: Encodes the peptide sequence at SEQ ID NO. 39387
acttcactggggatctcctcctccactccacttctcttcctttgcggcgacgactgggctcgccggttcttccccggcgacgagcacccccccccctccccacaaggcagttcggaccggcggcgcggccatggcttccaacggcatcacccccagagatgtatgtgttgttggggttgcacgcacccctatgggtggtttccttggtgccttgtcttccttgcctgcaaccaaacttgggtctatagcaattcaagctgctctgaaaagagcaaacgtggatccagcccttgtgcaggaggtctactttggaaacgtcttgagtgctaatttgggacaagctcctgcaaggcaagctgctctgggtgcagggataccaaacactgttgtctgtaccactgttaacaaagtctgtgcatctggcatgaaagctactatgtttgcagcacagtcaattcaactgggtatcaatgatattgttgtggcaggtggcatggaaagcatgtccaatgccccaaagtacattgctgaagctaggaaagggtctcgtttcggacatgacacacttgtcgatggcatgcttaaggatggcctttgggacgtatacggtgattgtgccatgggaatgtgtgccgagctttgtgctgacaatcatgccctcacaagagaagatcaggatgcttttgctatccaaagcaacggggcgtggaattgctgctcgtgacaggggtgctt

SEQ ID NO: 39387 - protein, 197 aa, Panicum virgatum
  misc_feature: Ceres CLONE 1998086
  misc_feature (8)..(197): Pfam Name: Thiolase_N Pfam Description: Thiolase, N-terminal domain
  misc_feature: SWISSPROT Homolog: EC 2.3.1.9 Acetyl-CoA C-acetyltransferase
MASNGITPRDVCVVGVARTPMGGFLGALSSLPATKLGSIAIQAALKRANVDPALVQEVYFGNVLSANLGQAPARQAALGAGIPNTVVCTTVNKVCASGMKATMFAAQSIQLGINDIVVAGGMESMSNAPKYIAEARKGSRFGHDTLVDGMLKDGLWDVYGDCAMGMCAELCADNHALTREDQDAFAIQSNGAWNCCS

SEQ ID NO: 39388 - DNA, 680 bp, Panicum virgatum
  misc_feature: Ceres CLONE 1998097
  misc_feature: Encodes the peptide sequence at SEQ ID NO. 39389
cagctagctacgtcacctgtcgccaccaccaccgggggacgctctctcgggcgctcctgtgacgcatcgccgccgatcactctctccccccgccgctcctctggtggaggtggagatccgcgcaggcgagggcctgctccgctcgcgttggtacttgtggacgaatcaggtcagaaggagcacactcgtgtacttgactgaggagattaggtctacgcatgggggctccaaagcagaggtggacttctgaggaagaggctgctcttagaactggagtcgcaaagcatgaagttggaaattggcgcacaatattgaatgatccagagcttagttccgtattgcgctaccgctcgaatgttgacctaaaggacaagtggcgtaacatgaatgtaactgtcaccgcatcgggttctcgtgacaaggcgaggactgccgtgaagagaacccgagctgctcctaagaacaatgatcactcggcagcaatcatcacagttacttctgatgctgatgacgagattgttgacgcaaagcctatagcatcagtgtctgctgaagcatggaatgcttctacttcaaagaaatctcactcaaggctagacaatattataatggaggctataaagaacttgaatgagcctacagggtcacacagaactactattgctaattacattgaggag

SEQ ID NO: 39389 - protein, 153 aa, Panicum virgatum
  misc_feature: Ceres CLONE 1998097
  misc_feature (5)..(57): Pfam Name: Myb_DNA-binding Pfam Description: Myb-like DNA-binding domain
  misc_feature: The sequence is a functional homolog of SEQ ID NO 1220 in the 10/666,642 US patent application
  misc_feature: The sequence is a functional homolog of SEQ ID NO 1221 in the 10/666,642 US patent application
  misc_feature: Useful for making plants with altered alkaloid content
  misc_feature: The sequence is a functional homolog of SEQ ID NO 1374 in the 10/666,642 US patent application
MGAPKQRWTSEEEAALRTGVAKHEVGNWRTILNDPELSSVLRYRSNVDLKDKWRNMNVTVTASGSRDKARTAVKRTRAAPKNNDHSAAIITVTSDADDEIVDAKPIASVSAEAWNASTSKKSHSRLDNIIMEAIKNLNEPTGSHRTTIANYIE

SEQ ID NO: 39390 - DNA, 709 bp, Panicum virgatum
  misc_feature: Ceres CLONE 1998106
  misc_feature: Encodes the peptide sequence at SEQ ID NO. 39391
aaatcacgcgcaaagccacctccgcgtcatcgtcgtcgtctcctctcctctcctctccaagcaagcgaagcggcctcgaaatcttctccgcgccgccatggacgccgtggactcggtggtcgacccgctccgggagttcgccaaggacagcatccgcctcgtcaagcgctgccacaagcccgaccgcaaggaattcaccaaggtggcggcgcggacggcgatcggcttcgtcgtcatgggcttcgtcggcttcttcgtcaagctcatcttcatccccatcaacaacatcatcgtcgggacaggctgatccggtcccagcaggtatatattttgcgcctcacgcctctcctcgatctggtttccagccgccttcagtcaatttttttgtgccccatatgtgcaattcaatggatctcttagatcgttcgaaatctgcttagaacgatttcaatttcatatcgagtcatgtgatttgagcccgcagtggtcgagtaaggcttgtgcttatgcgttcacctgattggctcttgtgctatgcagtatgattagtttttatactactatagtagcttggtatggaagccatttttagtctcgaatcagtatctgtgtggccttaaaattctctcgtgatgttcacttggtatctgctaaattggacgagttaacctgattttttactatggttgtgttctggctccagaaaaag

SEQ ID NO: 39391 - protein, 69 aa, Panicum virgatum
  misc_feature: Ceres CLONE 1998106
  misc_feature (10)..(66): Pfam Name: SecE Pfam Description: SecE/Sec61-gamma subunits of protein translocation complex
MDAVDSVVDPLREFAKDSIRLVKRCHKPDRKEFTKVAARTAIGFVVMGFVGFFVKLIFIPINNIIVGTG

SEQ ID NO: 39392 - DNA, 673 bp, Panicum virgatum
  misc_feature: Ceres CLONE 1998117
  misc_feature: Encodes the peptide sequence at SEQ ID NO. 39393
actcatccatctctttcgtctcctcgcaggatcggagctagcagctcgatcgatccccacaacactgccacacctggctggctagcagcaagcaagagccaagaaattaagctccagcgttccgcaccatctcgccattgccaccaccgccgttctggtattcttgcaatgccggacggggagctgccgagcccggcgtcgtccgggggcacgtcgtcctcgccgccgctgtcgccagtcgagctggccgggccgaggcgcggcggcggcggtggcggggagaagcgggcgcgggaccgggacggcggcgagaggcacccgtcgtaccgcggcgtgcggatgcgggcgtgggggaagtgggtgtcggagatccgggagccgcgcaagaagtcgcgcatctggctcggcacgttcccgacccccgagatggcggcgcgcgcgcacgacgccgcagcgctcgtcgtcaagggccccgccgccgtgctcaacttcccggagatggccgccgcgctcccgcgcccggcctccgccgcgccgcgcgacgtccaggccgccgccgcgcgcgcggccgccatggagcccgccctgctgccgcctgatggcggtgaaggaccagcagccgccgccgtatcgttgcagcccgccccgccagtgccggcggcggggcagcagc

SEQ ID NO: 39393 - protein, 168 aa, Panicum virgatum
  misc_feature: Ceres CLONE 1998117
  misc_feature (51)..(102): Pfam Name: AP2 Pfam Description: AP2 domain
  misc_feature: The sequence is a functional homolog of SEQ ID NO 1234 in the 10/374,780 US patent application
  misc_feature: The sequence is a functional homolog of SEQ ID NO 147 in the 11/479,226 US patent application
  misc_feature: The sequence is a functional homolog of SEQ ID NO 2214 in the 10/374,780 US patent application
  misc_feature: The sequence is a functional homolog of SEQ ID NO 692 in the 10/225,066 US patent application
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: The sequence is a functional homolog of SEQ ID NO 2596 in the 10/374,780 US patent application
  misc_feature: The sequence is a functional homolog of SEQ ID NO 644 in the 10/225,066 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 1318 in the 11/479,226 US patent application
  misc_feature: The sequence is a functional homolog of SEQ ID NO 164 in the 10/225,068 US patent application
  misc_feature: The sequence is a functional homolog of SEQ ID NO 1816 in the 10/412,699 US patent application
  misc_feature: The sequence is a functional homolog of SEQ ID NO 188 in the 10/374,780 US patent application
  misc_feature: The sequence is a functional homolog of SEQ ID NO 28 in the 10/225,068 US patent application
  misc_feature: The sequence is a functional homolog of SEQ ID NO 740 in the 10/225,066 US patent application
  misc_feature: The sequence is a functional homolog of SEQ ID NO 1243 in the 10/374,780 US patent application
  misc_feature: The sequence is a functional homolog of SEQ ID NO 768 in the 11/435,388 US patent application
  misc_feature: Useful for making plants with altered terpenoid content
  misc_feature: Useful for making plants with modulated flowering time
  misc_feature: The sequence is a functional homolog of SEQ ID NO 1722 in the 10/412,699 US patent application
  misc_feature: The sequence is a functional homolog of SEQ ID NO 192 in the 11/375,241 US patent application
  misc_feature: The sequence is a functional homolog of SEQ ID NO 1958 in the 10/374,780 US patent application
  misc_feature: The sequence is a functional homolog of SEQ ID NO 2241 in the 10/666,642 US patent application
  misc_feature: The sequence is a functional homolog of SEQ ID NO 424 in the 10/714,887 US patent application
  misc_feature: The sequence is a functional homolog of SEQ ID NO 46 in the 10/412,699 US patent application
  misc_feature: The sequence is a functional homolog of SEQ ID NO 57 in the 10/838,616 US patent application
  misc_feature: The sequence is a functional homolog of SEQ ID NO 576 in the 11/435,388 US patent application
  misc_feature: The sequence is a functional homolog of SEQ ID NO 72 in the 10/669,824 US patent application
  misc_feature: The sequence is a functional homolog of SEQ ID NO 72 in the 10/870,198 US patent application
  misc_feature: The sequence is a functional homolog of SEQ ID NO 98 in the 10/675,852 US patent application
  misc_feature: The sequence is a functional homolog of SEQ ID NO 700 in the 11/435,388 US patent application
  misc_feature: Useful for making plants with modulated low light sensitivity
  misc_feature: Useful for making plants with modulated salt sensitivity
  misc_feature: Useful for making plants with modulated nitrogen use efficiency
MPDGELPSPASSGGTSSSPPLSPVELAGPRRGGGGGGEKRARDRDGGERHPSYRGVRMRAWGKWVSEIREPRKKSRIWLGTFPTPEMAARAHDAAALVVKGPAAVLNFPEMAAALPRPASAAPRDVQAAAARAAAMEPALLPPDGGEGPAAAAVSLQPAPPVPAAGQQ

SEQ ID NO: 39394 - DNA, 734 bp, Panicum virgatum
  misc_feature: Ceres CLONE 1998118
  misc_feature: Encodes the peptide sequence at SEQ ID NO. 39395
agcccctcccgctcatccgggcctccggggtcagggcctcaggttcacctcctttcctttccctcggactccctagcggcggcgactgggcgagcggcggcgccatttgtcgcgtcttcgtgcagcccttttccggcgaagagcgtcctccaggttagcaaattaccttttgaagatggatcatagttctgatgaagatacagaaatcagtgattctgagattgatgattatgaaggcaaaatatatgcaagactgatctccggggatttaaaggtcaagaaggatggagagagttacacctgtcccttctgtagcagcaagaagaagaacaattacagcaaaagtagtctggttcagcatgcttctggagtaggtgcagcacctaatcgacaggcaaaagataaggcagctcatcgttcccttgtcaaacatttgaagaatgaacttgctaaatcatctgagctacggccacaggtgattcctgttgagcctcagcctcttcagaacagagatgagaagtttgtgtggccctggatgggcgtcctagttaatgtgcctactgaatggaaggatgggcgccaagttggagaaagtggaaatcgtttgaaggagcaactatcacacttctgcccactgaaggtcatccctttgtggacttttagaggtcatacaggaaatgctattgttgagtttggaaaggactggaatgggttcagaaatgcacgggaccttc

SEQ ID NO: 39395 - protein, 186 aa, Panicum virgatum
  misc_feature: Ceres CLONE 1998118
  misc_feature (112)..(186): Pfam Name: XS Pfam Description: XS domain
  misc_feature (43)..(84): Pfam Name: zf-XS Pfam Description: XS zinc finger domain
MDHSSDEDTEISDSEIDDYEGKIYARLISGDLKVKKDGESYTCPFCSSKKKNNYSKSSLVQHASGVGAAPNRQAKDKAAHRSLVKHLKNELAKSSELRPQVIPVEPQPLQNRDEKFVWPWMGVLVNVPTEWKDGRQVGESGNRLKEQLSHFCPLKVIPLWTFRGHTGNAIVEFGKDWNGFRNARDL

SEQ ID NO: 39396 - DNA, 686 bp, Panicum virgatum
  misc_feature: Ceres CLONE 1998122
  misc_feature: Encodes the peptide sequence at SEQ ID NO. 39397
acgcccagctcaaatcctcaatccgagggttccgactgcgcgacaaattgagcaataaacctcaacgcaaaacccacatccgccgccgccgccgcgctcgtgacctctcaccgccggccggcgcccctccacgcacagcaatgatggtccccctcgaccccgcggacaagcccacctcgcagagtcgcatcgcggagggcgacaccgtcgtggtgtacgagcgccacgacgcgatgcgtgccgtcgcggtccgcgccggcggcgtgctccagaaccggttcggcgtcttccgccacgacgactggatcggcatccccttcggatccaaggtcttcagcacctccggcggcggaggcaggggtggagggggcaaggggggcggcggcggaggcaaggccggcggtgggttcgtgcacctcctggcgccgaccccggagctctggacgctcgtgctcagccaccggacccagatcctctacatcgccgacatcagtctcgtcgtcgccgacatcagtctcgtcgtcgcctacctcgagctcgtcccggggtgcgtcgtgcttgagtccggcacgggcagcggctcgctcaccacctcgcttgcgcgcgccgtcgcgccgcacggccgcgtccacaccttcgatttccacgagcagagggctgcctccgcgagggaagacttcgagagg

SEQ ID NO: 39397 - protein, 181 aa, Panicum virgatum
  misc_feature: Ceres CLONE 1998122
  misc_feature (2)..(181): Pfam Name: GCD14 Pfam Description: tRNA methyltransferase complex GCD14 subunit
  misc_feature: SWISSPROT Homolog: EC 2.1.1.36 tRNA (adenine-N(1)-)-methyltransferase
MMVPLDPADKPTSQSRIAEGDTVVVYERHDAMRAVAVRAGGVLQNRFGVFRHDDWIGIPFGSKVFSTSGGGGRGGGGKGGGGGGKAGGGFVHLLAPTPELWTLVLSHRTQILYIADISLVVADISLVVAYLELVPGCVVLESGTGSGSLTTSLARAVAPHGRVHTFDFHEQRAASAREDFE

SEQ ID NO: 39398 - DNA, 684 bp, Panicum virgatum
  misc_feature: Ceres CLONE 1998127
  misc_feature: Encodes the peptide sequence at SEQ ID NO. 39399
atcctcacccgcttcccgccgtccgcggcctgcctgcaacccaagaacggcgatggcggcgagggtcccggcggcggagctcaaccagcacccctcatcgccgttcgccgcatcccgctgctaccgtccaggcggcgccgcccttcacgcccctctccgcgtgccatccagaacgccgcggaggacggaggaatccaaaaggatcatccgaagggccgcagaggagcagggcgccggaggagccaggaggtggagaagggagccgctgcggcggggggccgtcagcgcgcgcctccgggtgccggaccacataccccggcctccgtacgtcggcgcggacgccatcccggccgtgtgcccggaccggcaggtgcacgacggcgagagcgtcatgcgtatgctggacgcctgcgagctcgccgcccgcgttctgcagtatgcaggaacactggtcaaaccggctgtgacgacggatgatatcgacagggctgtgcaccagatgattgtcgacgccggcgcctacccgtcaccacttggatatggtgggtttccgaaaagcgtctgcacgtcggtgaacgagtgcacctgccacggaatccctgattctcgtgagctacaggatggagacattatcaacattgatgttactgtctacttaaacgggtatcacggggacacctcaag

SEQ ID NO: 39399 - protein, 210 aa, Panicum virgatum
  misc_feature: Ceres CLONE 1998127
  misc_feature (112)..(210): Pfam Name: Peptidase_M24 Pfam Description: metallopeptidase family M24
  misc_feature: SWISSPROT Homolog: EC 3.4.11.18 Methionyl aminopeptidase
MAARVPAAELNQHPSSPFAASRCYRPGGAALHAPLRVPSRTPRRTEESKRIIRRAAEEQGAGGARRWRREPLRRGAVSARLRVPDHIPRPPYVGADAIPAVCPDRQVHDGESVMRMLDACELAARVLQYAGTLVKPAVTTDDIDRAVHQMIVDAGAYPSPLGYGGFPKSVCTSVNECTCHGIPDSRELQDGDIINIDVTVYLNGYHGDTS

SEQ ID NO: 39400 - DNA, 1570 bp, Panicum virgatum
  misc_feature: Ceres CLONE 1998154
  misc_feature: Encodes the peptide sequence at SEQ ID NO. 39401
aaacacacgctaaacacaccaaaagtctcaaacagacgagagtccccacccagatccccgcgcaaccacagagggagctagagttggagatccatcaaatccctttgcccggtctcggttccccttcttcctcggcaccggccagcgccggccccctcgtccacgaccatctccggcggccggtcgctttcggcggcatggattgccccaagcggtgcgcgccggctggcctcccctacgacgacatcgtggagatcctcgcgcgtctccccgccaggtccgtctaccgattcaagtgcgtcgccaaggcctggcgcgacctcatcgacgacccccttaaccgcaagaagctcccccaaaccctggaagggttcttcttcattgacaaaccgaacgacgtcgctagcttcgtggaacatttcgatttcatcaaccttttgccaagatccgtgcctctcgacatcgaccctcgcttccctttcctgacgaagcggcctgagattgaggatctcctcttcgctgattcctgcaatgggctcgccctcttcgatcatgtccggaagtcaaacttatttgacatattgagctacatagtgtgcaacccggccacaaagcagtgggagactgtgcccacctgcagctgctgtccaccactaagagattgtttagattggtatacctttttggctttcgatccggctgtctcctctcattttcacttgatttgcttccaggaaaagggtttggacgaggaggatgaggtgttagtcttgtcagtgtgtgcatactcatctgagactgggacgtggagtcagagccagatcaactggaatgaacaaggacaattggaaggatggcgccatcagtgccatctatcttatcagcatgcctttttcaatggcatcctacatttgttactttttggttttgatcatgatcagatagttgctctggatgtacaaggaaagactgaaggataatcacaataccagctgctgcagaggggaggcgttggaaatctaaaggttatattggtcattcccaagggcgtctgcattacatcaaatatgaagttgatgctcatgactgtgaaaattgttatgaactgtctatctgggtccttcaggattatgatagacaagaatggctgttgaaggacactatgagctttccgaagctgtctggaaaaaatagttgcataggaaccacgttggaattcttcgttgtagccattcatcaagattgcaatgtggttttcattcttcaacccctgaaccgactaatagcatatgacatggaccgcaaggaagtgagtgttattgccacttttgaacatgaaaattttggtgtgagaattgctccttatgtcccctatttctcggagtcaccggcgcttggaaataagctctgaaaatgtctgctctaaccatggagcaactagcgacttgattaggttgtagtgagcttaggtgaaacgttctgtctctgcttggatgtattcctcttatgctttttggtctaattaatactgcaagcctgcttatccattaatgtaatgtgttgaagaatt

SEQ ID NO: 39401 - protein, 260 aa, Panicum virgatum
  misc_feature: Ceres CLONE 1998154
  misc_feature (7)..(54): Pfam Name: F-box Pfam Description: F-box domain
MDCPKRCAPAGLPYDDIVEILARLPARSVYRFKCVAKAWRDLIDDPLNRKKLPQTLEGFFFIDKPNDVASFVEHFDFINLLPRSVPLDIDPRFPFLTKRPEIEDLLFADSCNGLALFDHVRKSNLFDILSYIVCNPATKQWETVPTCSCCPPLRDCLDWYTFLAFDPAVSSHFHLICFQEKGLDEEDEVLVLSVCAYSSETGTWSQSQINWNEQGQLEGWRHQCHLSYQHAFFNGILHLLLFGFDHDQIVALDVQGKTEG

SEQ ID NO: 39402 - DNA, 1227 bp, Panicum virgatum
  misc_feature: Ceres CLONE 1998155
  misc_feature: Encodes the peptide sequence at SEQ ID NO. 39403
acttccactttcctcagcctcctttcctggcggcgacggcggcggcgccctacggcacgtcttcgactttcctcggcttcctttcctggcggcgacggctgggcgagcggcgaagcccctcggctcgtcttcgccggcagcgagcgcccaccaggagatcgaggacaatggccatcttctcatccgcccacctcgccctccgccggtcgctagcggtggcaccacgagctgcatctcttggggagagtcttcggcaagcctcagatggacatttcacaggaaggctgctccatagccaactcctcccgcgctgcttcacctcggatgcatttggacccaacaagagttccccgccttctgggcctgaaattgctgcagaattgaagccacatcagaatttcaacagattcaattttatgcgtcaagatttacattctactaagacacaggccaacttcaataatgcagataatggtgggacaacgttaaagacagctgctggagagaggcctttcaaccttggggggcgctttccatttcctacttcgcgaatgtttaatgaacgtgaacaatattcacagaagaagagagattttatccatgtcttattgaagaaaaataagacctttgtgacggtgacagatgctagtggtaataaaaagactggagcttctgctggttgtttggaagacagaaaaggtcgatctcgtctctctcgatatgctgctgaagcaactgccgaacatgttgggcggtctgccaggaagatgggtttaaggtctgttgtcatgaaagtgaaaggggtttcttttttcaagaagaagaagaaagtgatcctgggctttagggaaggttttcgaggggaaagagttagagatcaatctcctatcatgtacatccacgatgtcacccaacttccgcataatggatgcagactcccaaaacaacgcagggtttagttctctgtgagctgaaattaaatttgagtaggaataaatcgaatttttgaaggtgatctggaaggcttttgtaagctggcaggtgttctgtctcatggctctctgcaacttgttgggctatacagcctggtttctgtccgacttatgctattcagtgagttatgacaattttttttaatgggtgaaatgctggtacataccagaaatctggactgttgtatgataagagccctgatttgacagtgtgagaaactcacccttttttttc

SEQ ID NO: 39403 - protein, 263 aa, Panicum virgatum
  misc_feature: Ceres CLONE 1998155
  misc_feature (144)..(262): Pfam Name: Ribosomal_S11 Pfam Description: Ribosomal protein S11
MAIFSSAHLALRRSLAVAPRAASLGESLRQASDGHFTGRLLHSQLLPRCFTSDAFGPNKSSPPSGPEIAAELKPHQNFNRFNFMRQDLHSTKTQANFNNADNGGTTLKTAAGERPFNLGGRFPFPTSRMFNEREQYSQKKRDFIHVLLKKNKTFVTVTDASGNKKTGASAGCLEDRKGRSRLSRYAAEATAEHVGRSARKMGLRSVVMKVKGVSFFKKKKKVILGFREGFRGERVRDQSPIMYIHDVTQLPHNGCRLPKQRRV

SEQ ID NO: 39404 - DNA, 678 bp, Panicum virgatum
  misc_feature: Ceres CLONE 1998159
  misc_feature: Encodes the peptide sequence at SEQ ID NO. 39405
gctccccatgcacaccggcagctcgccgaccctccgagttcgggccgctactgctataaatacgaagctcccgcggcggcggtccggccggtcatggcggcagtcggcgcgcgcccagtgctgtaccaccacccggcgccggcgggcgacgccgcctccatgtcctcgtacttctcccacggaggcagctccacctccagctccgcgtccagcttctccgccgcgctcgccgccgcggccgcgccgcccccgccgccgcttgccgaccagttcgacatctccgagttcctcttcgacgacggcgcgggggcggcggccgcgccaggcttgttcgctgcggcggccgaccgcggcgcgccgccccccgtcgcgcccgctgctggcagcgcgatcagtgcgcccgcacatgccgccaggagcgcggcggaggcggtgccggagcggccgcggacagagcggatcgcgttccggacgaggtcggaggtcgagatcctggacgacgggtacaagtggaggaagtacggcaagaagtccgtcaagaacagccccaacccaaggaactactacaggtgctcgacggaagggtgcaacgtgaagaagcgggtggagcgggacaaggacgaccccagctacgtggtgaccacgtacgagggcacgcacaaccacgtgagccccagc

SEQ ID NO: 39405 - protein, 194 aa, Panicum virgatum
  misc_feature: Ceres CLONE 1998159
  misc_feature (134)..(193): Pfam Name: WRKY Pfam Description: WRKY DNA -binding domain
  misc_feature: The sequence is a functional homolog of SEQ ID NO 132 in the 10/714,887 US patent application
  misc_feature: The sequence is a functional homolog of SEQ ID NO 132 in the 11/435,388 US patent application
  misc_feature: The sequence is a functional homolog of SEQ ID NO 144 in the 10/714,887 US patent application
  misc_feature: The sequence is a functional homolog of SEQ ID NO 144 in the 11/435,388 US patent application
  misc_feature: The sequence is a functional homolog of SEQ ID NO 1611 in the 10/412,699 US patent application
  misc_feature: The sequence is a functional homolog of SEQ ID NO 971 in the 10/666,642 US patent application
  misc_feature: The sequence is a functional homolog of SEQ ID NO 158 in the 10/714,887 US patent application
  misc_feature: The sequence is a functional homolog of SEQ ID NO 158 in the 11/435,388 US patent application
  misc_feature: The sequence is a functional homolog of SEQ ID NO 142 in the 10/714,887 US patent application
  misc_feature: The sequence is a functional homolog of SEQ ID NO 142 in the 11/435,388 US patent application
  misc_feature: The sequence is a functional homolog of SEQ ID NO 1610 in the 10/412,699 US patent application
  misc_feature: The sequence is a functional homolog of SEQ ID NO 970 in the 10/666,642 US patent application
  misc_feature: The sequence is a functional homolog of SEQ ID NO 136 in the 10/714,887 US patent application
  misc_feature: The sequence is a functional homolog of SEQ ID NO 136 in the 11/435,388 US patent application
  misc_feature: The sequence is a functional homolog of SEQ ID NO 146 in the 10/714,887 US patent application
  misc_feature: The sequence is a functional homolog of SEQ ID NO 146 in the 11/435,388 US patent application
MAAVGARPVLYHHPAPAGDAASMSSYFSHGGSSTSSSASSFSAALAAAAAPPPPPLADQFDISEFLFDDGAGAAAAPGLFAAAADRGAPPPVAPAAGSAISAPAHAARSAAEAVPERPRTERIAFRTRSEVEILDDGYKWRKYGKKSVKNSPNPRNYYRCSTEGCNVKKRVERDKDDPSYVVTTYEGTHNHVSP

SEQ ID NO: 39406 - DNA, 1711 bp, Panicum virgatum
  misc_feature: Ceres CLONE 1998165
  misc_feature: Encodes the peptide sequence at SEQ ID NO. 39407
accgcgccactctcccagtctcgctccagctctcggcaggtggcgcccggcgaatcaccgatcggaagcgcagccagcggaggcgccagtgaccggtctccgctccccgactcaggcgaccgcgagcccagccagcccgacagccgtcatgcggccaccaccgtcgtccctgctccaccacctcctcctcctgctcttcctcgccgacgtgccgagtgctctgtccaagtccacgctggagtcctgcgcctcgtccaccgcctgcccggcgctcctctcctacacgctgtacgcggacctgaagctggccgaggtcgcggcgctcttcgccgccgacccgctcgccatcctggccgccaccgccatcgacttcgcggcgcccgaccccgccaaccgcatcctccccgccggcctgcccctccgcgtgccggtcccctgcgcctgctccgacggcatccgcaaggccacctccgtccgctacgtggcccgggccggggacacgctggcgtccgtggcggggtccgtctacggcgggctcaccaccgccgactggatccgcgactccaacggcatgcccgagggcgccgcactcgacgccgggaccacgctcttcgtgccgctccactgcgcctgcttcggcggcgtcgacgacggcgtgcccgcggtgtacctgacctatgtggtggccgagggcgacacggtgccagccatcgcgcggaggttccggaccaccgggaacgacctcatgaacgtcaatgacatggccaccgccgacgtcgccgccggggccatcatcgtcgtgccgctgcccgcgtgtgcgtcgtcattcccggcctacacgtcggacgccggcctgtccgtggcgaacgggacctacgcgatcaccgccaaccgctgcgtccagtgcagctgcggcccgggcaacctggacctgttctgcgtgccggcgccgctggcggactcgacgtgctccagcatgcagtgcagcaacagcagcatgatgctcggcaacttcacgctccagatgaccagcgccggctgcagcgtcacctcctgcagctacgggggatacgtgaacgggaccatcctcaccacgctaaccacgtcactgaagcctcagtgcccaggcccgcaccagttccctccgctgatgccgccgccgacgtcgtccttcttcgagacgtacctcggcccgtcgccgacgccgacgccgacgccatctgaaggaggcgtcggcccgcagatggctggcatggcgccgacgagcagcccgccggtgagttccgggagtcctgccccagtagcaggccggcgcgttggggatgttcttgcactgctcgctctctgcctcgccgccgccaacttgctatggtagctgggccgtgacgagcgtgtgagaatcatatcgagcagcagtgtgtccggaattgaagggcattctttttttaggacaattagcaggtgctctgccttttcattatagtaggaagcagcctaagttacagaagtttagaacaacaagggcattcttgtacaggagcagtcggctagctttttacgggctctgcgattgtgccgaattttgctgtttctcattcgattggtcgttcttgtaaaatgcatggtgaacccacgctagcatacctatatagcacgtttgtatttgttacagaacaagttatttgatctcatcaaatgcagccatggtttc

SEQ ID NO: 39407 - protein, 408 aa, Panicum virgatum
  misc_feature: Ceres CLONE 1998165
  misc_feature (177)..(219): Pfam Name: LysM Pfam Description: LysM domain
MRPPPSSLLHHLLLLLFLADVPSALSKSTLESCASSTACPALLSYTLYADLKLAEVAALFAADPLAILAATAIDFAAPDPANRILPAGLPLRVPVPCACSDGIRKATSVRYVARAGDTLASVAGSVYGGLTTADWIRDSNGMPEGAALDAGTTLFVPLHCACFGGVDDGVPAVYLTYVVAEGDTVPAIARRFRTTGNDLMNVNDMATADVAAGAIIVVPLPACASSFPAYTSDAGLSVANGTYAITANRCVQCSCGPGNLDLFCVPAPLADSTCSSMQCSNSSMMLGNFTLQMTSAGCSVTSCSYGGYVNGTILTTLTTSLKPQCPGPHQFPPLMPPPTSSFFETYLGPSPTPTPTPSEGGVGPQMAGMAPTSSPPVSSGSPAPVAGRRVGDVLALLALCLAAANLLW

SEQ ID NO: 39408 - DNA, 2016 bp, Panicum virgatum
  misc_feature: Ceres CLONE 1998192
  misc_feature: Encodes the peptide sequence at SEQ ID NO. 39409
aactcaccaagaacagcgccatttcttaatcgcagcgcctaaaccaatccctcctaattatatctcctgcacagtggtgttaccaccaggtgtggttgcaagcttaaaacgcgccggcatggccacggtgctggatgccgccggtgtgtcgcatttccacccctacgccgccgccgcggcggtggcattggtctcggcgtacatggtgtggttctgggcgctggcgcggcggctgtcggggccgcggatgtggccgctcgtcggcagcctgcccggcgtcgtgctgaaccgggcgcgcgtccacgactggatcgtcgacaacctgcgctccacgggggaggcggccacgtaccagacgtgcatcctgccgctgccgttcctcgcgcggcgccagggcctggtgaccgtcacgtgcaacccgcggaacctggagcacatcctgcgcgcgcgcttcgacaactaccccaagggccccatgtggcaggcggcgttccacgacctcctcggccagggcatcttcaactccgacggcgagacgtggctgctgcagcgcaagacggcggcgctcgagttcaccacccggaccttgcgccaggcgatggcgcgctgggccaaccgcatcatcaagtaccgcctgtggggcatcctcgccttccactgcgacgccgcggcgagcgtcgacctccaggacctgctcctgcgcctcaccttcgacaacatctgcggcctcaccttcggcaaggaccccgagacgctgtcgccggggttgcaggagaaccccttcgccaacgccttcgactccgccaccgaggcgacgatgcagaggttcctgttccccagcttcctgtggcgcatcaagaaggcgctgggtgtcgggagcgagcggaacctccgcgagagcctcgcgatcgtggaccagtacatgacggaggccatcgcggcgcgcaaggcgacgccgtcggacgacctgctgtccaggttcatgaagaagcgcgacggcaacggccgggcgttcccggaggacgtgctccagtggatcgcgctcaacttcgtgctcgccgggcgcgacacgtcgtccgtcgcgctcagctggttcttctggatgctcatgcagcgccgcgacgtcgagcgcagggtggtcacggagatcgcgtccgtgctcagggagacgcggggcggcgacgccgggaggtgggccgaggagccgctggacttcgacgagctggaccgcctcgtgtacctcaaggcggcgctggcggagacgctgcggctgtacccgtcggtgccgcaggactccaagtacgtggtggcggacgacgtgctgccggacggcaccgtcgtgccggccggctcggcgatcacctactccatctactcggttggtaggatggagagcatatggggcaaggactgcgccgagttccggccggagcggtggctctcggctgatgggacccgattcgagccgaccaaggacgcgtaccgcttcgtggcgttcaacggcgggccgaggacgtgcctcggcaaggacctggcctacctgcagatgaagtccatcgcgtcagccgtgctgctgcgccactcggtggagctcgtcccggggcacaaggtggagcagaagatgtcgctcacgctgttcatgaagaacggtctccgcgtgcacgtcaagccgcgggacctcgccggctacgtcgtcgcggcgctggaggaggcgccgcagcagctgggagcctttgtgatcccgaccaccaccgcggcagccgcgtaagtcctggatgtgcgacgtgcccacgaacattggtttctactacgttcatgctgcctcctctcaagttgttcggcctgtcaaagtcataccgtttcccccctttgagcggttagattgttattgctaggtttgtttgctcctgttgtctactacatgtgtacgtttgtgtgaatcggttttgtgtactttttgttgaggtctgttggatgaaaaaaaagctaagcaatggaactttactttggtgggtc

SEQ ID NO: 39409 - protein, 549 aa, Panicum virgatum
  misc_feature: Ceres CLONE 1998192
  misc_feature (39)..(518): Pfam Name: p450 Pfam Description: Cytochrome P450
  misc_feature: SWISSPROT Homolog: EC 1.14.13.30 Leukotriene-B(4) 20-monooxygenase
MATVLDAAGVSHFHPYAAAAAVALVSAYMVWFWALARRLSGPRMWPLVGSLPGVVLNRARVHDWIVDNLRSTGEAATYQTCILPLPFLARRQGLVTVTCNPRNLEHILRARFDNYPKGPMWQAAFHDLLGQGIFNSDGETWLLQRKTAALEFTTRTLRQAMARWANRIIKYRLWGILAFHCDAAASVDLQDLLLRLTFDNICGLTFGKDPETLSPGLQENPFANAFDSATEATMQRFLFPSFLWRIKKALGVGSERNLRESLAIVDQYMTEAIAARKATPSDDLLSRFMKKRDGNGRAFPEDVLQWIALNFVLAGRDTSSVALSWFFWMLMQRRDVERRVVTEIASVLRETRGGDAGRWAEEPLDFDELDRLVYLKAALAETLRLYPSVPQDSKYVVADDVLPDGTVVPAGSAITYSIYSVGRMESIWGKDCAEFRPERWLSADGTRFEPTKDAYRFVAFNGGPRTCLGKDLAYLQMKSIASAVLLRHSVELVPGHKVEQKMSLTLFMKNGLRVHVKPRDLAGYVVAALEEAPQQLGAFVIPTTTAAAA

SEQ ID NO: 39410 - DNA, 696 bp, Panicum virgatum
  misc_feature: Ceres CLONE 1998193
  misc_feature: Encodes the peptide sequence at SEQ ID NO. 39411
aaccccattagcagcaggcgtacctccgccttcctctccagcatcaccacaggccctttgagctcgcgctgccctctcccccgccgcctccggcagccccgcaccgccatggccgctgactcctccgccgccccgttccagaagatccagatccagcccgaggacacgacatttgatgcctatgttgttggcaaagaaaatgctcctggaattgtggttttgcaagagtggtggggagtagattatgagataaagaatcatgcaatccacatctcccaacttggtggaggatacagagcacttattccagatttgtaccgtggcaaagttgctctggatgtcgctgaggcacagcatctgatggaaggtctggattggcaaggcgcagttaaggacattcaggcttcagttaaatggctcaagtcaaatggatcacccagggttggtgttaccggctattgcatgggtggtgctttatcgattgcaagtggagttatagtcccagaggttgatgctgttgttgctttctatgggacaccatcttctgaacttgccgacccttctaaggctaagactcctatccaggcccattttggagagcatgacagttttgttgggttttcggatgtcactgcggccaagtccctggaggagaagctcaagtcttctggagtaccatatgaagtccacatatac

SEQ ID NO: 39411 - protein, 195 aa, Panicum virgatum
  misc_feature: Ceres CLONE 1998193
  misc_feature (22)..(195): Pfam Name: DLH Pfam Description: Dienelactone hydrolase family
  misc_feature: SWISSPROT Homolog: EC 3.1.1.45 Carboxymethylenebutenolidase
MAADSSAAPFQKIQIQPEDTTFDAYVVGKENAPGIVVLQEWWGVDYEIKNHAIHISQLGGGYRALIPDLYRGKVALDVAEAQHLMEGLDWQGAVKDIQASVKWLKSNGSPRVGVTGYCMGGALSIASGVIVPEVDAVVAFYGTPSSELADPSKAKTPIQAHFGEHDSFVGFSDVTAAKSLEEKLKSSGVPYEVHI

SEQ ID NO: 39412 - DNA, 667 bp, Panicum virgatum
  misc_feature: Ceres CLONE 1998202
  misc_feature: Encodes the peptide sequence at SEQ ID NO. 39413
atcactcgatcgctctcccactcacgtcacggctcacgggtcgccgtcgtcaacatggctcggagcttcagcgacatcgtggtggcccgcgtcgccgccgaccccgccgcgctccccgccaagctgctccgcctgttcttccacgactgcttcgtcagagggtgcgacgcgtcggtgctgatcgactcgacgccgggcacgggcggcggcggctgcggcgcggcggagaaggacgcggcgccgaacgcgtcgctgggcgggttcgacgtgatcgacaccgccaaggccgtgctggaggccgtgtgccccggcaccgtctcctgcgccgacatcgtcgcgctcgcggcccgcgacgccgtctccttccagttcgggcgggagctgtgggacgtgcagctggggcggcgcgacggcgtggtgtcgcgggcgtcggaggcggcggcgggcatcccctcgccgtccgacaacttcaccgccctcgaggccaacttcgccgccaagggcctcgacgtcaaggacctcgtcatcctctccggcgcgcacacgatcggcgtggcccactgcaacaccttcgcggcgcgcctgggcggcggctccggctccaactccgccgccggcgccgacccggcgctgaacgcggcgtacgcggcggagctccgggtgcggt

SEQ ID NO: 39413 - protein, 204 aa, Panicum virgatum
  misc_feature: Ceres CLONE 1998202
  misc_feature (5)..(203): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
MARSFSDIVVARVAADPAALPAKLLRLFFHDCFVRGCDASVLIDSTPGTGGGGCGAAEKDAAPNASLGGFDVIDTAKAVLEAVCPGTVSCADIVALAARDAVSFQFGRELWDVQLGRRDGVVSRASEAAAGIPSPSDNFTALEANFAAKGLDVKDLVILSGAHTIGVAHCNTFAARLGGGSGSNSAAGADPALNAAYAAELRVR

SEQ ID NO: 39414 - DNA, 713 bp, Panicum virgatum
  misc_feature: Ceres CLONE 1998208
  misc_feature: Encodes the peptide sequence at SEQ ID NO. 39415
aaaaaaaaaaaaaaaaaatccagcagagcgcagcaggatggtgtacgcgctcctgctggtcgccttggcggccgtcgccgccgcggcggtgctccgccactacctcccgctgctccgcggcggcctccccaagggcagcttcggctggcccctcatcggcgagaccatcggcttcctccacgcgcacccgtccaacaccgccggcggcttcctcaaggagcacgtcgccaggtacgggacggtgttcaagtcgcacctcttcggctcgccggcggtggtctcctgcgacgaggagctcaaccacttcgtgctgcacaacgaggagcgcctgttcgagtgcagctaccccggcgccatccgcaccatcctcggcgagtcctccgcgctggtggtcaccggcgagcgccaccgccagatccggagcatgttcctcgccctcgtcgcctccacggggctcaaggcctcctacgtcgccagcgtcgacgagtccgcgcgctccctcatcgcgtcctggcgcggccgcgagaccatcagcttctgcgaggaggcgaggaagttcccctacaaggtgatcatggagcaggtgctgggcctgccgccggacggcccggtggccctccggatcctggaagagtaccagatcttcatgaaggggatcatctccctccctatcaccctccccgggacagcattttccaaggccgtcaaagcaa

SEQ ID NO: 39415 - protein, 225 aa, Panicum virgatum
  misc_feature: Ceres CLONE 1998208
  misc_feature: SWISSPROT Homolog: EC 1.14.13.77 Taxane 13-alpha-hydroxylase
  misc_feature: Useful for making plants with modulated oxidative stress sensitivity
MVYALLLVALAAVAAAAVLRHYLPLLRGGLPKGSFGWPLIGETIGFLHAHPSNTAGGFLKEHVARYGTVFKSHLFGSPAVVSCDEELNHFVLHNEERLFECSYPGAIRTILGESSALVVTGERHRQIRSMFLALVASTGLKASYVASVDESARSLIASWRGRETISFCEEARKFPYKVIMEQVLGLPPDGPVALRILEEYQIFMKGIISLPITLPGTAFSKAVKA

SEQ ID NO: 39416 - DNA, 695 bp, Panicum virgatum
  misc_feature: Ceres CLONE 1998210
  misc_feature: Encodes the peptide sequence at SEQ ID NO. 39417
atgcccaccaacacacacacacacacagagcctagcttgcaataacagttgtagggctagcaagcagctcgtttgatcacgcaggcgtagcaggtgccgggtggccatggggttctcagtgcagaggacgagccggtcgtacgtgcgcccaagcgccgcgacgccgtccggcgcgctggagctctccgtgatcgaccgcgtcgtggggctgcaccacctggtgcgctctctccacgtcttcgccgcgcccgtcgccgggagccaggaccacgcgaggtccccggcgcgcgcggtccgggacgcgctcgggaaggcgctggtggactactacccgttcgcggggcggttcgtggcgggcgcgcgcgtggagtgcaccggcgagggcgtgtggttcgtggaggccgccgccgcgtgcagcctggacgacgccggccgcctcgaccagtacccgctggccatcccggaggacgacctgctgccggacgccgcgccggacgtcgagccgctcgacctcccgctcgcgatgcaggtgacggagttcagctgcggcagcttcgtggtggggctcatctgctgccacgccttggccgatggcctcggcgccgcccagttcatcaattccgtcggcgactacgcccgcggcctccccaagccccgcgtcagccccgtctgggcgcgcgacatcgtcccgagcc

SEQ ID NO: 39417 - protein, 196 aa, Panicum virgatum
  misc_feature: Ceres CLONE 1998210
  misc_feature: SWISSPROT Homolog: EC 2.3.1.167 10-deacetylbaccatin III 10-O-acetyltransferase
MGFSVQRTSRSYVRPSAATPSGALELSVIDRVVGLHHLVRSLHVFAAPVAGSQDHARSPARAVRDALGKALVDYYPFAGRFVAGARVECTGEGVWFVEAAAACSLDDAGRLDQYPLAIPEDDLLPDAAPDVEPLDLPLAMQVTEFSCGSFVVGLICCHALADGLGAAQFINSVGDYARGLPKPRVSPVWARDIVPS

SEQ ID NO: 39418 - DNA, 715 bp, Panicum virgatum
  misc_feature: Ceres CLONE 1998210-R
  misc_feature: Encodes the peptide sequence at SEQ ID NO. 39419
gccgggttctacggcaactgcttcttcgcggtgacggcgagcgcggagagaggcgcggtggaggcggcggacgtggccggcgtcgtggccatgatccgggacgccaaggcgcggctccccgccgagttcgcgcggtgggcggccggcgagctcgcggagcaggacccctacgagctgaccttcacgtacgagtcgctgttcgtgtcggactggacgcggctggggttcctggaggccgattacggctgggggacgccgtcgcaggtgatacccttttcgtaccacccgtgcatgcccatcgcgatcatcggcgcgccgccggcgcccaagacggggtcgaggatcatgacacggtgcgtcgaggaggagaacctgctggagttcatggaggagatgaaagcctctcagaagtgacacgacgactatgttcccatgttctcatcgactttattgcttctcctgtctaatattattgtttttgtggactttgctttcaatgtgtgcgtgtgctatttattaaaaaaaatgtgtgtgcgcgcgcgcttgtgcgctctctggctggcttttactttttgagctgtatcttgggctatgatgtgtaataagacgtggcccactgatgataattgtaagatacagtttgtaccaaggtatacagcacgaaggttctcctggattatattatatccctttaatgaagcaaagaattttgtag

SEQ ID NO: 39419 - protein, 137 aa, Panicum virgatum
  misc_feature: Ceres CLONE 1998210-R
  misc_feature: SWISSPROT Homolog: EC 2.3.1.162 Taxadien-5-alpha-ol O-acetyltransferase
AGFYGNCFFAVTASAERGAVEAADVAGVVAMIRDAKARLPAEFARWAAGELAEQDPYELTFTYESLFVSDWTRLGFLEADYGWGTPSQVIPFSYHPCMPIAIIGAPPAPKTGSRIMTRCVEEENLLEFMEEMKASQK

SEQ ID NO: 39420 - DNA, 631 bp, Panicum virgatum
  misc_feature: Ceres CLONE 1998217
  misc_feature: Encodes the peptide sequence at SEQ ID NO. 39421
gttcccctccccacccacactctctctctctctccctcccgcatgtcaacggccctccccgcggactccgtccccgcccccagttcccgggcttagttacgagccgccctcggctccggatcggcgcggcccgccgctctcgtcatggcatttccgtcgcgggtggctctgctcgtcgcgggggtgttggtgatgctggggctctccgcggcggcggcggcggcggcggaagggcgagggagcgtgtgcttccgccgggtgttcagcttcggggactcgctcacggacaccggcaacttcctgctctccgtgccagaggacttcccggaccccgcgcggaacctcccctacggccagaccttcttcggtcgcccatccggacgctactccgacggccgcaacctgctcgacttcttcgcggaagcatttgggcttccattcgtgccgccgtaccttggcggtggggacttccaatatggtgcaaactttgcggtcggcggggctactgccctcaaaggttcgttcttccgggaacgtggtgtggagcctacatggacgccacactgccttgatgagcagatgcagtggttcaagaagcttctcccatcaattgcgccatcagagacagaac

SEQ ID NO: 39421 - protein, 162 aa, Panicum virgatum
  misc_feature: Ceres CLONE 1998217
  misc_feature: SWISSPROT Homolog: EC 3.2.1.51 Alpha-L-fucosidase
MAFPSRVALLVAGVLVMLGLSAAAAAAAEGRGSVCFRRVFSFGDSLTDTGNFLLSVPEDFPDPARNLPYGQTFFGRPSGRYSDGRNLLDFFAEAFGLPFVPPYLGGGDFQYGANFAVGGATALKGSFFRERGVEPTWTPHCLDEQMQWFKKLLPSIAPSETE

SEQ ID NO: 39422 - DNA, 1190 bp, Panicum virgatum
  misc_feature: Ceres CLONE 1998218
  misc_feature: Encodes the peptide sequence at SEQ ID NO. 39423
aacagtccccactgcgtctctgccgcagccattgccttcctggctcctctcctctcccttccccgtctcgcctcacaccattaaaccccacccgcgcgcgcggcggccggcggcgagccccacccacccaggcacgcggaggagggagcgggcgcgcggcaccaccaggggcggccatggggaccctcgggcgcgcgatcttcacggtcggcaagtggatccgcggcacggggcaagccatggaccgcctcggatccaccatccagggcggcctccgcgtcgaggagcagctttcaaggcatcgtacagtcatgaacatttttgagaaagagccaaggatccatagagatgtgtttgttgctcccagtgcagcagtcattggtgatgttgagattggacatggatcatcaatctggtatggctccattttgagaggtgacgtcaacaacattcacatcggatctggaacaaatatccaagacaattcccttgtacatgtttcaagagctaacatcagcgggaaggtcctcccaaccataattggaagcaacgttacagtaggtcatagtgctgttttacatgcgtgcaccattgaggatgaagcttttgttggtatgggtgccactctgcttgatggagtggtggttgaaaaacacagcatggttggcgcaggatctcttgttaagcagaatacaaggattccttctggagaggtctgggttggtaaccctgccaagttcctaaggaagcttacagaagaggagatcgcgttcattgctcagtcagcaaccaactatgtcaacttagcccaggtccacgcagctgagaacgccaagagctttgacgagatcgagcttgagaagatgcttaggaagaagtatgcgcacaaagacgaggagtacgactctatgcttggggtggtccgcgagatcccacctgagctcatccttcctgacaatatcctcccgcacaatgctcagaaggctgtcgcccgctgaacgcttcctcggtctgttgtgacgcttggtgttgttgcctgttgacttggaacattttgacacgagtttgggtattatttctctgttttccccgcccaataagattgggtcgagcgttgctttaggatcgaccgtacacaccacctcaatttgaactgcaatgaagataagctcaagatatctttttccccc

SEQ ID NO: 39423 - protein, 273 aa, Panicum virgatum
  misc_feature: Ceres CLONE 1998218
  misc_feature: SWISSPROT Homolog: EC 2.3.1.129 Acyl-[acyl-carrier-protein]--UDP-N-acetylglucosamine O-acyltransferase
MGTLGRAIFTVGKWIRGTGQAMDRLGSTIQGGLRVEEQLSRHRTVMNIFEKEPRIHRDVFVAPSAAVIGDVEIGHGSSIWYGSILRGDVNNIHIGSGTNIQDNSLVHVSRANISGKVLPTIIGSNVTVGHSAVLHACTIEDEAFVGMGATLLDGVVVEKHSMVGAGSLVKQNTRIPSGEVWVGNPAKFLRKLTEEEIAFIAQSATNYVNLAQVHAAENAKSFDEIELEKMLRKKYAHKDEEYDSMLGVVREIPPELILPDNILPHNAQKAVAR

SEQ ID NO: 39424 - DNA, 739 bp, Panicum virgatum
  misc_feature: Ceres CLONE 1998226
  misc_feature: Encodes the peptide sequence at SEQ ID NO. 39425
gttctttttggggttcccctgtccctgtccctgtccctgtccccgccgccggcacgagatggaggtcgcccccgccgccgccaagcagaagacgaagaagcacatacacctcttctactgctccgaatgcgaggagcttgcgctcaagatcgccgccagctccgatgcgatcgagctccagtccatcaactggcggagcttcgatgacgggttcccgaacctgttcatcaacaaggcgcacgacatccgggggcagcacgtggcgttcctggcctccttcagctcgccggcggtaatcttcgagcagatctccgtcatcttcgcgcttcccaagctcttcatcgcctccttcacgctcgtgctgcccttcttccccacgggctccttcgagcgcgtcgaggaggagggggacgtcgccaccgccttcaccctcgcgcgcatcctctccatggtccccaagtcgcgcggtgggccgactagcgtcgtcatctacgacatccacgcgctccaggagaggttctacttcggggacgacgtcctgccatgcttcgagacagggatcccgctcctgctgcagcgcctccgccagctcccggacgcagaaaatattacaatcgccttcccagatgatggggcgtggaagcgattccacaagctctttgcacactttccaatgatagtctgtaacaaggttcgtgaaggtgacaagagaatagttcgaataaaggaaggaaatcct

SEQ ID NO: 39425 - protein, 226 aa, Panicum virgatum
  misc_feature: Ceres CLONE 1998226
  misc_feature: SWISSPROT Homolog: EC 2.7.6.1 Ribose-phosphate diphosphokinase
MEVAPAAAKQKTKKHIHLFYCSECEELALKIAASSDAIELQSINWRSFDDGFPNLFINKAHDIRGQHVAFLASFSSPAVIFEQISVIFALPKLFIASFTLVLPFFPTGSFERVEEEGDVATAFTLARILSMVPKSRGGPTSVVIYDIHALQERFYFGDDVLPCFETGIPLLLQRLRQLPDAENITIAFPDDGAWKRFHKLFAHFPMIVCNKVREGDKRIVRIKEGN

SEQ ID NO: 39426 - DNA, 727 bp, Panicum virgatum
  misc_feature: Ceres CLONE 1998228
  misc_feature: Encodes the peptide sequence at SEQ ID NO. 39427
gtctttccttctatttccttcgactcgcgttcgaatctgccgccccgagtcgatcctaccccggcccgttcgtttctcttttcctccgtccccgagatctcgaggcagcatggtggaggcgaaggacaacgaggtgtacgaggaggatctcgtcgactacgaggaggaggtggagaatgtcgccgacggcgccccaaccaacggctccgccgatgtcgtcaaaaaggggtacgtggggatccacagctcggggttcagagacttcctgctcaagccggagcttctccgggccatccaggattgcggatttgagcatccttccgaagtgcaacatgaatgcatccctcaagccattcttggaatggatgttatctgtcaagcaaaatctgggatgggtaagactgcggtttttgtcctctcaactcttcagcagattgatcctgttgctggtcaagtagctgcacttgtgttgtgccacacaagagagctagcttaccagatttgccatgaatttgagagatttagcaaatacctgcctgaattaagaattgctgtcttctatggtggtgttcacataaaaaatcataaggatctgttgaagaatgaatgcccccatattgtggttggcacgcctgggaggatacttgctctagttagagataaggaccttcccttgaaaaacgtgcggcatttcactctcgatgaatgtgataagatgcttgaatca

SEQ ID NO: 39427 - protein, 205 aa, Panicum virgatum
  misc_feature: Ceres CLONE 1998228
  misc_feature (71)..(205): Pfam Name: DEAD Pfam Description: DEAD/DEAH box helicase
  misc_feature: Useful for biocontainment applications
  misc_feature: Useful for making plants with modulated biomass
  misc_feature: Useful for making plants with modulated cold sensitivity
MVEAKDNEVYEEDLVDYEEEVENVADGAPTNGSADVVKKGYVGIHSSGFRDFLLKPELLRAIQDCGFEHPSEVQHECIPQAILGMDVICQAKSGMGKTAVFVLSTLQQIDPVAGQVAALVLCHTRELAYQICHEFERFSKYLPELRIAVFYGGVHIKNHKDLLKNECPHIVVGTPGRILALVRDKDLPLKNVRHFTLDECDKMLE

SEQ ID NO: 39428 - DNA, 676 bp, Panicum virgatum
  misc_feature: Ceres CLONE 1998230
  misc_feature: Encodes the peptide sequence at SEQ ID NO. 39429
aacaaggcccgctcctttccttcggcaccttcgctcccccagcgcccgccgctctccacgcggtcggcccgtgcgccgccctccacgcgcacctgcccagctgcagctcgagtcctgctggtgcggcggcaccctcccttcccttcccacgacttctctgtactttctctcggcctcggtcttcctttcctagcggcgacgacagggcgagttgcgctgcccgttgttcgtcgagcgacgggcgcttcgccggcgacgaacatccgacagggttattgggtgtacatgtataactgggtccgcccctgattacagagatgaacgtggcagcgccaccacccccaccaccacatcttcgcctatatgaattcgccaagaccgctctcgtcaaaatttttgcctttccttatgccacggtctgtgacttgtattgcgatggtggacttgatacggacaagtggtgtgatgcccaggttggccactatataggaatcgatgcctctgcatcgggtgtcagcgatgcccgtgagctatgggagaacaagaggaaacctttcactgctgagttcattgagttggatccttctgatgatgatttcgaagctcaagtgcaggaaaagggcatccaggcagatattgtttgttgtatgcagcacttgcagttatgctttgagag

SEQ ID NO: 39429 - protein, 119 aa, Panicum virgatum
  misc_feature: Ceres CLONE 1998230
  misc_feature: SWISSPROT Homolog: EC 2.1.1.56 mRNA (guanine-N(7)-)-methyltransferase
MNVAAPPPPPPHLRLYEFAKTALVKIFAFPYATVCDLYCDGGLDTDKWCDAQVGHYIGIDASASGVSDARELWENKRKPFTAEFIELDPSDDDFEAQVQEKGIQADIVCCMQHLQLCFE

SEQ ID NO: 39430 - DNA, 678 bp, Panicum virgatum
  misc_feature: Ceres CLONE 1998241
  misc_feature: Encodes the peptide sequence at SEQ ID NO. 39431
ctctctctctctctctcccctcaagccctcctccctcctccaccaccacccaccattccggcgcggagaccgcttcccttcgcccacccccgcaaccctctcctcccccgcctcctccgcgcttccctccatttgtccgcgcccccctccctcccgatcttaaccacccgccgcgcgctcccgccacccggcttcctctggtccgccccactccccccccccccccccctcaagccaaaacgctcggctccctcccccactttccatctctcttcttgttcccccggaggacgaggaggaggaagaagaagaagagtagcgagagggagggcggaagaggatgagcgcgtccaggttcataaagtgcgtcacggtcggggacggcgccgtcggcaagacctgcatgctcatctcctacacctccaacaccttccccaccgactatgttccaacggtgtttgacaacttcagtgctaacgtcgtggttgatggtaacactgtcaacctcgggctatgggacactgcaggtcaagaggattacaacagactgagaccactgagttatcgtggagctgatgttttccttctggccttctcactgatcagtaaggctagctatgagaatgtttcgaagaagtggatacctgaactgaagcattatgcacccggtgtgccaat

SEQ ID NO: 39431 - protein, 112 aa, Panicum virgatum
  misc_feature: Ceres CLONE 1998241
  misc_feature (8)..(112): Pfam Name: Ras Pfam Description: Ras family
  misc_feature: Useful for making plants with modulated nitrogen use efficiency
MSASRFIKCVTVGDGAVGKTCMLISYTSNTFPTDYVPTVFDNFSANVVVDGNTVNLGLWDTAGQEDYNRLRPLSYRGADVFLLAFSLISKASYENVSKKWIPELKHYAPGVP

SEQ ID NO: 39432 - DNA, 679 bp, Panicum virgatum
  misc_feature: Ceres CLONE 1998259
  misc_feature: Encodes the peptide sequence at SEQ ID NO. 39433
aggctggctcgagctcggctcattgaccgccctccccatcagggctcagtgcctcaggcagtccgcagtcaggttcatctctccgactccctcctcccttggtcttcactccctggcggcgacgagtgggggcgcgcggtggcggcattcgtcacgtcttcgcccagccctttgccggctacgagcatccgccagaaagtaccactgtccccagagaagttgtgtagaagatgggtatccttgagaggatcaaggagattgaggccgagatggctcggacgcagaaaaataaagcaacagaatatcatcttggacaactgaaggcaaagttagcaaagctgaggacacaactattggagcctccgaagggttccagtggaggaggagatggttttgaagtcacaaagtttgggcatggtcgtgttgcactgattggatttcccagtgttggaaagtcaactcttttaactatgttgaccgggacacactctgaagctgcatcatatgagttcacaaccctgacttgcattcctggaattattcactacaatgataccaaaatccagcttcttgatcttcctggtattattgaaggagcctctgaaggcaaagggcgtggtaggcaggttattgctgttgcgaagtcatcagatcttgtactgatggttctggatgcctc

SEQ ID NO: 39433 - protein, 149 aa, Panicum virgatum
  misc_feature: Ceres CLONE 1998259
  misc_feature (63)..(148): Pfam Name: MMR_HSR1 Pfam Description: GTPase of unknown function
MGILERIKEIEAEMARTQKNKATEYHLGQLKAKLAKLRTQLLEPPKGSSGGGDGFEVTKFGHGRVALIGFPSVGKSTLLTMLTGTHSEAASYEFTTLTCIPGIIHYNDTKIQLLDLPGIIEGASEGKGRGRQVIAVAKSSDLVLMVLDA

SEQ ID NO: 39434 - DNA, 711 bp, Panicum virgatum
  misc_feature: Ceres CLONE 1998273
  misc_feature: Encodes the peptide sequence at SEQ ID NO. 39435
gtcctcttcttcccgtcgcttcaccgtgctgcaccagggaagggaggaggcttccccgcgaagctcgccatgatctcgccggagaggagcccgtcgcagagcccgcggtcgccggcggggccaggggcggcggcggcgccgttcctttcgatctccgtcacggatcccgtcaagatgggcaccggcgtgcaggcctacatctcctaccgcgtcatcaccaagaccaacttgcctgaatttgagggaccagagaaaattgttattcgtcgctatagtgattttgaatggttgcatgataggcttgctgagaggtacaaaggcatttttatacctccccttccagagaagaatgctgttgagaaatttcgttttagcaaggagttcattgaattgcggcgtcaagctctggacttattcgtgaacaggatagcttcacaccctgaactcaagcaaagtgaagtcttgagggtatttttgcaggctgatgaagagaaaatggatagggcaaggtcttatgagactggcatttttaagaaaccagcagatttcttacagatgtttaaggatgtacagtcaaaagttagtgatgttgttctgggaaaagaaaagccggtggaggaatctactcctgaatatgagaagcttaaaaattacatatttgagctagaaaatcatttagcagaggcacagaaacaagcataccgtcttgtg

SEQ ID NO: 39435 - protein, 236 aa, Panicum virgatum
  misc_feature: Ceres CLONE 1998273
  misc_feature (46)..(162): Pfam Name: PX Pfam Description: PX domain
  misc_feature: SWISSPROT Homolog: EC 2.7.11.1 Non-specific serine/threonine protein kinase
VLFFPSLHRAAPGKGGGFPAKLAMISPERSPSQSPRSPAGPGAAAAPFLSISVTDPVKMGTGVQAYISYRVITKTNLPEFEGPEKIVIRRYSDFEWLHDRLAERYKGIFIPPLPEKNAVEKFRFSKEFIELRRQALDLFVNRIASHPELKQSEVLRVFLQADEEKMDRARSYETGIFKKPADFLQMFKDVQSKVSDVVLGKEKPVEESTPEYEKLKNYIFELENHLAEAQKQAYRL

SEQ ID NO: 39436 - DNA, 712 bp, Panicum virgatum
  misc_feature: Ceres CLONE 1998286
  misc_feature: Encodes the peptide sequence at SEQ ID NO. 39437
atctcgatcgaacagcagctacagctgcagaagaagaagaaggggtgtgtcctatcctcctaccagagcaatgccggtgcgtaacggaggtggagccttgggcgcggcggcgttcctggcggccgtggccgcgctgctgggcgccgccggggtggcggcggcggcgagcaagttcgacgacgtggtgcagccgagctgggccaacgaccacatggtgtacgacggcgacctcctcaagctccgcctcgacgccaactcgggcggcgggttcgtgtcccggagcaagttcctctacggcaaggccagagccgacctcaagctcgtgccgggggactccgccggcgtagtcaccgctttctatgtgagtgagtgcaggccttgctttgcttacctctgcgccgccgccgctgctgctgctactgaacttcaatgctgctgttttctgttgcgcgttcttattactgcattggtccaggcattgatctttgtttggcctctgcatttcttgctgttcttggttgcatctacaagtccgcattttcctaagaaaatactcaaaagattaaaaatggggagaatgtgtctctgataaaggcattaaacaaggttatcgaaaaccaatgctgggacatccgtgccatgtctgtcctgcgatactgccaagaaccattttacaaagacaacggcacggggacaagtgctgcagagagta

SEQ ID NO: 39437 - protein, 172 aa, Panicum virgatum
  misc_feature: Ceres CLONE 1998286
  misc_feature (35)..(171): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MPVRNGGGALGAAAFLAAVAALLGAAGVAAAASKFDDVVQPSWANDHMVYDGDLLKLRLDANSGGGFVSRSKFLYGKARADLKLVPGDSAGVVTAFYVSECRPCFAYLCAAAAAAATELQCCCFLLRVLITALVQALIFVWPLHFLLFLVASTSPHFPKKILKRLKMGRMCL

SEQ ID NO: 39438 - DNA, 483 bp, Panicum virgatum
  misc_feature: Ceres CLONE 1998291
  misc_feature: Encodes the peptide sequence at SEQ ID NO. 39439
atgtcgtcttcttgcttgcccatcccgtcgctccacctgagcccaccggcgaagaggaggcgaagaagcgatgggcgtcaccaaggaggacgtcgaggcggccatcacctccgccctcagcccttcccatctcgtggtgacggacacatctggagggtgcggcgcgcgctatgagatcgaggtggtgtcggagaagttcgaggggaagcggctgctggagcggcaccggatggtgaacacggcgctggcgccgcacatggcggagatccacgccgtctccatcaagaaggcgctcactccggcgcaggcccagccccagccccagccggagccggccgccgataagccccaggcttaagtgctcaactcgctccaaacggattgatcacatatgcgcatgagtcaagctcatccgtgttgtactagtatgtggtctctgatacattaactgctggttgaataatgtagcaaacgcaattgcag

SEQ ID NO: 39439 - protein, 95 aa, Panicum virgatum
  misc_feature: Ceres CLONE 1998291
  misc_feature (3)..(80): Pfam Name: BolA Pfam Description: BolA-like protein
MGVTKEDVEAAITSALSPSHLVVTDTSGGCGARYEIEVVSEKFEGKRLLERHRMVNTALAPHMAEIHAVSIKKALTPAQAQPQPQPEPAADKPQA

SEQ ID NO: 39440 - DNA, 1438 bp, Panicum virgatum
  misc_feature: Ceres CLONE 1998300
  misc_feature: Encodes the peptide sequence at SEQ ID NO. 39441
gtagcccacgcacagattcattccacgcccccctctcccctcgcccgcgctcccagatctcgcacgcctcccgcaaggtacgtggattcctccaccgaccctcctaatgctcgtggtgttcgaccttctctgtccataggtagttggtcgattgatttgtgcgacgctgcgagcggcgaggcaacccatagccgtctctcttccctcccggctcccgacttgtgcgcgactgccggccgtcttcctcgcccgatacgacgacgcctggccggtggccgcgtgacagcctcaccccgcctaggatcctggtcgacggccgcccgacgcaagccgccagccccacccgcttgccagatcccaggcgcgcggcgaccggcgagcagcaacaaccggcgcaggcgcacggcggcagcagccgtccgcccgctaccccttcccgttgtggcctcgttctgggtaaatttgagctatgggcacagttgtggatgctccagccgttgtgactgaggaggttgctgagaacactttgggtggcaagaaagttacagttgtatttgttctaggtggccctggaagtggaaaaggcacacagtgtgccaacattgtggaatactttggattcactcatcttagtgctggtgatcttttgcgtgcagagatcaaatctggctccgagaatggaaccatgattgagaacatgataaaggaaggaaagattgttccatcagaggtaactataaaactgttgcaggaggcaatgataaaaaatgaaaatgacaaatttctgattgatggatttccaaggaacgaggagaatcgtgcggcatttgagaacgttaccaaaatttctcctgcattcgtgctattctttgactgttctgggaaagagatggaaagacgtcttttggggcgcaaccaggggagagttgatgataacattgagactattaagaaaaggttcaaaacttttgtggaatcaagtctacctgtcatagagtattataactcaaaggacaaggttaaaaagattgatgctgcaaaaccaattcctgaagtgtttgaagatgtcaaaaccatttttgccccatatgctcccaaggctgaatagagcaatacaaggggcaccataaaggtgatacttggtgccataggcaccgctcaaacatatttgtgattatgaaccctttaatatagaaaggttttggctcatatgagctaccagcatatcagtaggcaattcgatttgttaccagcaataagtagatctgattcccagctgtcatggtagagtaactttttattgttgtcagtgtaccaacccttcgatgttgtaccagtaccaatgtgtaatttaccgcatggacgatgaaaaccttctgcctacccaccagctatctggtggcactacggaaagtaaaactgttgccatattcttttt

SEQ ID NO: 39441 - protein, 212 aa, Panicum virgatum
  misc_feature: Ceres CLONE 1998300
  misc_feature (30)..(183): Pfam Name: ADK Pfam Description: Adenylate kinase
  misc_feature: SWISSPROT Homolog: EC 2.7.4.3 Adenylate kinase
MGTVVDAPAVVTEEVAENTLGGKKVTVVFVLGGPGSGKGTQCANIVEYFGFTHLSAGDLLRAEIKSGSENGTMIENMIKEGKIVPSEVTIKLLQEAMIKNENDKFLIDGFPRNEENRAAFENVTKISPAFVLFFDCSGKEMERRLLGRNQGRVDDNIETIKKRFKTFVESSLPVIEYYNSKDKVKKIDAAKPIPEVFEDVKTIFAPYAPKAE

SEQ ID NO: 39442 - DNA, 1240 bp, Panicum virgatum
  misc_feature: Ceres CLONE 1998303
  misc_feature: Encodes the peptide sequence at SEQ ID NO. 39443
acccccctccccatcggagcagagcagaggccacgatggcggcggcggcgacggcgacgaaccggcgcgtgatcctcaaggagtacgtggaggggtacccgcgcgaggagcacatggagctgctcccgggcgccgaggtgcccctccgcctggccggcgacgagccgcccggctccgtcctcgtccggaacctctacctctcctgcgacccctacatgcggcccaagatgtcgcgcccgctgcgggagtcctacacggccgccttcgtcccgggcgccgtcatcaccggctacggcgtcgcccgcgtgctcgactcctccgacccgcgcctcgcccccggggacctcgtctggggcatcacgggctgggaggactacagcgtcgtccgcccccccaccaccgcgctcctcgccaagatctcccaccacggcggcggcggcggcgtcccgctctcctactacacgggcatcctcggcatgccggggctcacggcctacgtggggttccacgagatctgcgcgcccaaggccggcgaggccgtgttcgtctccgcggcgtccggcgccgtgggccagctggtgggccagttcgcgcggctcgccgggtgccgcgtcgtcggcagcgcggggaccgcggagaaggtggagctcctgcgcgccaggttcgggttccacgacgcgttcaactacaaggaggagccggacctcgccgccgcgctccggcggcgcttcccggaggggatcgacatctacttcgagaacgtgggcggcgcgatgctggacgccgtgctgctcaacatgcgcgtgcgcggccggatcgccgtctgcgggctcatctcgcagtacaacctcaaggacggggagaaggacgccgtgcgcaacctctccgccgtcgtcggcaagcggctccggctgcaggggttcatcgagcccgaccacaagcacctgtaccccaagtacgaggcgtgggtgctcccctacatccgggacggcacgctcgcctacgtcgaggacgtcgccgaggggctcgagagcgcgcccggggcgctcatcgggctcttccacggccgcaacgtcggcaagcagctcgtccgcgtcgccgacgacgcgggaaccggcgcctgattggatcggacccgtcgatgtaccactagtccactactctgtttcggattttccttccatgatatgatgaataagttgtggccgcctttgagcgaattaaacggacgatttggcgg

SEQ ID NO: 39443 - protein, 362 aa, Panicum virgatum
  misc_feature: Ceres CLONE 1998303
  misc_feature (165)..(318): Pfam Name: ADH_zinc_N Pfam Description: Zinc-binding dehydrogenase
  misc_feature: SWISSPROT Homolog: EC 1.6.5.5 NADPH:quinone reductase
  misc_feature: Useful for biocontainment applications
  misc_feature: Useful for making plants with modulated nitrogen use efficiency
MAAAATATNRRVILKEYVEGYPREEHMELLPGAEVPLRLAGDEPPGSVLVRNLYLSCDPYMRPKMSRPLRESYTAAFVPGAVITGYGVARVLDSSDPRLAPGDLVWGITGWEDYSVVRPPTTALLAKISHHGGGGGVPLSYYTGILGMPGLTAYVGFHEICAPKAGEAVFVSAASGAVGQLVGQFARLAGCRVVGSAGTAEKVELLRARFGFHDAFNYKEEPDLAAALRRRFPEGIDIYFENVGGAMLDAVLLNMRVRGRIAVCGLISQYNLKDGEKDAVRNLSAVVGKRLRLQGFIEPDHKHLYPKYEAWVLPYIRDGTLAYVEDVAEGLESAPGALIGLFHGRNVGKQLVRVADDAGTGA

SEQ ID NO: 39444 - DNA, 729 bp, Panicum virgatum
  misc_feature: Ceres CLONE 1998322
  misc_feature: Encodes the peptide sequence at SEQ ID NO. 39445
atcccttgtgtgcctccaggtgcatcaccttatatgtcagctgctgcaccacttctcagccccgaaggaaagactgacaagagggtagcgcttgatctccttatttgtcttcagaaccagaagcaatggcgtctgctactctcctcaagtcgtctttccttaacaagaaggctgaatggggcgccacgcgccaggttgctgctcccaggccggtgactgtttccatggttgtccgtgctagcgcctacgctgatgagcttgtccaaaccgcaaaaaccatcgcatcaccaggaaggggtatccttgccatggatgagtcaaacgctacctgcggcaagaggcttgcctccattggccttgagaacactgaggccaaccggcaggcttacaggaccctccttatcagtgctccaggcctgggacagtacatctctggtgctatcctcttcgaggagaccctctaccagtcaactgttgatggcaagaagattgttgacatccttgttgagcagggaatcgtgcctggtatcaaggttgacaagggtcttgtgccgcttgctggctccaacgacgagtcatggtgccaaggtcttgatggcctcgcttcacgcgaagcagcctactatgaggctggtgcccgcttcgccaaatggcgcactgttgtcagcatccccaatggtccatctgcacttgccgtgaaggaagctgcctggggccttgcccgctacg

SEQ ID NO: 39445 - protein, 201 aa, Panicum virgatum
  misc_feature: Ceres CLONE 1998322
  misc_feature (44)..(201): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
MASATLLKSSFLNKKAEWGATRQVAAPRPVTVSMVVRASAYADELVQTAKTIASPGRGILAMDESNATCGKRLASIGLENTEANRQAYRTLLISAPGLGQYISGAILFEETLYQSTVDGKKIVDILVEQGIVPGIKVDKGLVPLAGSNDESWCQGLDGLASREAAYYEAGARFAKWRTVVSIPNGPSALAVKEAAWGLARY

SEQ ID NO: 39446 - DNA, 724 bp, Panicum virgatum
  misc_feature: Ceres CLONE 1998323
  misc_feature: Encodes the peptide sequence at SEQ ID NO. 39447
acaacacaacacaacacatcaccacaccaccactggtccactgcctctcttccccgcctcttcccactgccaaacttttctgcgtgagctaggcaagaactgaagaacctctcttcttctacctctagctagttagccttcctccagactaagaagttcaagatcaacaacggccatgcaccatctcgcccaggggcacccccatgcgtggccgtggggggtgaccatgtacaccaacctgcactaccaccagcaccagtacgagagggagcacctgttcgagaagcctctgacgcccagcgacgtgggcaagctcaacaggctggtgatccccaagcagcacgcggagaggtatttcccccttggcggcgctggtggggtcggcggcggcgatggcagcgagaagggcttgctgctggccttcgaggacgaggccggcaagccgtggaggttccggtactcgtactggaccagcagccagagctacgtgctcacaaagggctggagccggtacgtgaaggagaagcgcctcgacgccggtgacgtcgtgtgcttcgagcgggtgcgcggcggccttggtgtcggtgaccgcctcttcatcggctgcaggcgccgtggcgagagcgcagcaccaacgccgacgcctccaccgcccgtgcgcgccccggcacctgctctgaaccccggcgagcagcagccttggagcccgatgtgctacagcacg

SEQ ID NO: 39447 - protein, 182 aa, Panicum virgatum
  misc_feature: Ceres CLONE 1998323
  misc_feature (34)..(144): Pfam Name: B3 Pfam Description: B3 DNA binding domain
  misc_feature: The sequence is a functional homolog of SEQ ID NO 2728 in the 10/374,780 US patent application
  misc_feature: The sequence is a functional homolog of SEQ ID NO 374 in the 10/225,066 US patent application
  misc_feature: The sequence is a functional homolog of SEQ ID NO 396 in the 10/666,642 US patent application
  misc_feature: Useful for making plants with altered lignin content
  misc_feature: Useful for making plants with altered terpenoid content
  misc_feature: Useful for making plants with modulated flowering time
  misc_feature: The sequence is a functional homolog of SEQ ID NO 1180 in the 10/374,780 US patent application
  misc_feature: The sequence is a functional homolog of SEQ ID NO 1181 in the 10/374,780 US patent application
  misc_feature: The sequence is a functional homolog of SEQ ID NO 1186 in the 10/374,780 US patent application
  misc_feature: The sequence is a functional homolog of SEQ ID NO 48 in the 10/838,616 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: The sequence is a functional homolog of SEQ ID NO 1183 in the 10/374,780 US patent application
  misc_feature: The sequence is a functional homolog of SEQ ID NO 22 in the 10/838,616 US patent application
  misc_feature: The sequence is a functional homolog of SEQ ID NO 756 in the 11/435,388 US patent application
  misc_feature: The sequence is a functional homolog of SEQ ID NO 1184 in the 10/374,780 US patent application
  misc_feature: The sequence is a functional homolog of SEQ ID NO 24 in the 10/838,616 US patent application
  misc_feature: The sequence is a functional homolog of SEQ ID NO 758 in the 11/435,388 US patent application
  misc_feature: The sequence is a functional homolog of SEQ ID NO 1179 in the 10/374,780 US patent application
  misc_feature: The sequence is a functional homolog of SEQ ID NO 34 in the 10/838,616 US patent application
  misc_feature: The sequence is a functional homolog of SEQ ID NO 52 in the 10/838,616 US patent application
  misc_feature: The sequence is a functional homolog of SEQ ID NO 736 in the 11/435,388 US patent application
  misc_feature: Useful for making plants with modulated water use efficiency
  misc_feature: The sequence is a functional homolog of SEQ ID NO 36 in the 10/838,616 US patent application
  misc_feature: The sequence is a functional homolog of SEQ ID NO 738 in the 11/435,388 US patent application
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
MHHLAQGHPHAWPWGVTMYTNLHYHQHQYEREHLFEKPLTPSDVGKLNRLVIPKQHAERYFPLGGAGGVGGGDGSEKGLLLAFEDEAGKPWRFRYSYWTSSQSYVLTKGWSRYVKEKRLDAGDVVCFERVRGGLGVGDRLFIGCRRRGESAAPTPTPPPPVRAPAPALNPGEQQPWSPMCYS

SEQ ID NO: 39448 - DNA, 1091 bp, Panicum virgatum
  misc_feature: Ceres CLONE 1998326
  misc_feature: Encodes the peptide sequence at SEQ ID NO. 39449
gcgtggccgtgtccacactcgtgaatcacccttctccaataccccaccaaggcttagcgcgctagcattcctcacgccggcgccgccccgatcggagagaagggaacatggacgcggccgtctcgaatccgtcgtcgatcaagaggatcgcgctggtcaccggggggaacaagggggtcggcctggagacgtgccggcagctggcgaccaaagggctcaaggtcgtcctgacggcgaggaacgaggcgagggggttggaagcggtcgaggccatcaggcgctccagcgccgccgccgccgaggttttcttccaccagctggacgtcactgacccctccagcgccgcccggctggcggatttcgtcaggggccagttcgggaggcttgacatcctgatcaataatgctgggatttcaggtgttgaccgagatccaattttggttgccaaagtcaaggatcaggtactcttaagtcttaactatagcaaaacatcacatccaaagtactcttgctttgcaggagcagtttttgagcaattcccatgtaattcttatatatttttttgaaaggtacaattctcatatttcacaattcccatgctataattgctgtttctatagttgtttgctattgtctcccaagatgttgaggtgttatgtgaacatcttcgtttgagattgacaatccttaagttattcaattcagcaagccaaccaccatgtttaagtgaattgcatgttagactgtactttcacctaaaacctgactatttactgaatcacatgattatatttctaagcaataccagaaaactagaagtatctgtgtggttgaagaatgaagggcgggcctggtgcagcgatagagcctaccgtctgtaaccggaaggtcccgggttcgagccccagcctctgcacatttgtgtgggtaaggcttggggcttaaaaacaacccttccccagaccccgcacagtgtggaaagcctacggcactgggtacgccctttttatctgtgtggttgaagaataataaaaatgtttattcaaggacaggttgaaggcatggatgtgaaccagagagttgaatggatg

SEQ ID NO: 39449 - protein, 152 aa, Panicum virgatum
  misc_feature: Ceres CLONE 1998326
  misc_feature (13)..(139): Pfam Name: adh_short Pfam Description: short chain dehydrogenase
  misc_feature: SWISSPROT Homolog: EC 1.1.1.184 Carbonyl reductase (NADPH)
MDAAVSNPSSIKRIALVTGGNKGVGLETCRQLATKGLKVVLTARNEARGLEAVEAIRRSSAAAAEVFFHQLDVTDPSSAARLADFVRGQFGRLDILINNAGISGVDRDPILVAKVKDQVLLSLNYSKTSHPKYSCFAGAVFEQFPCNSYIFF

SEQ ID NO: 39450 - DNA, 686 bp, Panicum virgatum
  misc_feature: Ceres CLONE 1998331
  misc_feature: Encodes the peptide sequence at SEQ ID NO. 39451
taactcccccactccctccaccgtaaaccctcgcccaaccagacgcctcccccgccgccgccggcgacgactacgatggaagggggcgcggcctccgcgatggtacaggtgtgatgtggttcacctaagcaaaaaggataaccattttgtgtgttgattcgaagtacacatctcacaaaatgtctctggttcttcgcttcaatctgctgaggaacaacatatggagcagctgtccagttaggtttctcaagcaacatgctggattttcatatgagaaactgcttcagcctggaagctatgagaagcgacatttcacaacaaagcttacagagacagctagttggcacaaaactgactcagattcatgtattcctgcaatttcgccactgtggcttcaacaaacttctgaacatgaccaacctgcaactattctcgtcttcgatatcgagactactggttttctccatgcagatcatagaatcattgagttcgcactccgcgacctttctggaggaaagaattgcacatttgagactctcattaatcctgaacggaatgttcccagctatgctgcagaagccaacaagattaccactgaattggtctgcaggcctgatgtcccaaggttcagcgatgtacttccaatactactagcatatgttcaaagtcgccaagctcctggcaag

SEQ ID NO: 39451 - protein, 168 aa, Panicum virgatum
  misc_feature: Ceres CLONE 1998331
  misc_feature: SWISSPROT Homolog: EC 2.7.7.7 DNA-directed DNA polymerase
MSLVLRFNLLRNNIWSSCPVRFLKQHAGFSYEKLLQPGSYEKRHFTTKLTETASWHKTDSDSCIPAISPLWLQQTSEHDQPATILVFDIETTGFLHADHRIIEFALRDLSGGKNCTFETLINPERNVPSYAAEANKITTELVCRPDVPRFSDVLPILLAYVQSRQAPG

SEQ ID NO: 39452 - DNA, 708 bp, Panicum virgatum
  misc_feature: Ceres CLONE 1998344
  misc_feature: Encodes the peptide sequence at SEQ ID NO. 39453
aaactcgagcagattcgcgaatcccatcggcgctagcgctgcggcatctccgatcctcctcctgtcctccacaaccccaacccctctcctcctcgatcaagagagggagctcgcccccgccggatcctggatcgatcgcctcgcctgctctgcacatggcggctcccactgccaacggcaatcccactgtcagctctcttgtaaccactgttccggttcaggcagttctgtttgatattgatggaactctctgcgattcagaccctctccaccatgtggctttccaggaattgctcctcgagattgggtacaacaacggcgtgcccatagacgatgagttcttcatcaaaaatattgctggaaggagtgatgttgaggctgcccagaatttgttcccagactgggaccttgacaaggggctcaagttcctagaggagaaggaagctaaatacagaagtttggcaaaagagcgcttggaacctgtgaaaggccttgggaaagtggttcagtgggtcaaggatcacggctacaagcgtgcagcagtgaccaacgcccctaggattaacgcagagctcatgatctcactccttggcctctcggacttcttccaggccattattattggaggtgaatgtgagcagccgaagcctgccccatacccgtacctgaaggccatcaaggagcttcaggtttctgcagaacacacct

SEQ ID NO: 39453 - protein, 184 aa, Panicum virgatum
  misc_feature: Ceres CLONE 1998344
  misc_feature (21)..(184): Pfam Name: Hydrolase Pfam Description: haloacid dehalogenase-like hydrolase
  misc_feature: SWISSPROT Homolog: EC 3.1.3.18 Phosphoglycolate phosphatase
MAAPTANGNPTVSSLVTTVPVQAVLFDIDGTLCDSDPLHHVAFQELLLEIGYNNGVPIDDEFFIKNIAGRSDVEAAQNLFPDWDLDKGLKFLEEKEAKYRSLAKERLEPVKGLGKVVQWVKDHGYKRAAVTNAPRINAELMISLLGLSDFFQAIIIGGECEQPKPAPYPYLKAIKELQVSAEHT

SEQ ID NO: 39454 - DNA, 664 bp, Panicum virgatum
  misc_feature: Ceres CLONE 1998347
  misc_feature: Encodes the peptide sequence at SEQ ID NO. 39455
ggacactgtcatctccaaacactcgcgagccccttcgtgattcctcctcctcccgtccctccctctccctcctccaagatcactgctggtccgcggaggctgctcgcgcgcttagttaagaggagagagagagagagaggaggaggccggtggagatggtggggaggcagcaagcggcaggggggtcgcggtggcgaggcggcggtggcgccgcggcggcgtggtggtgggtggccgtggtcctgggccatttagtggcgcccgcgcgggcggggctcctcgagaccaacccgggcctggcctacaacttctaccagaagagctgccccagcgtggactccatcgtccgcagcgtcacctgggcgcaggtcgccgccaaccccgcgctccccgcccgcctcctccgcctccacttccacgactgcttcgtcaagtggtgcgacgcgtcgatcctgctggacaacgcgcagagcgagaagacggcggggccgaacctgtcggtgggcggctacgaggtgatcgacgccatcaaggcgcaggtggagcaggcgtgcccgggcgtcgtgtcgtgcgccgacatcctcgccctggcggcgcgcgacgccgtctcgtaccagttcaaggcgtcgctgtggcaggtggagaccgggcggcgggacggcac

SEQ ID NO: 39455 - protein, 169 aa, Panicum virgatum
  misc_feature: Ceres CLONE 1998347
  misc_feature (64)..(169): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
MVGRQQAAGGSRWRGGGGAAAAWWWVAVVLGHLVAPARAGLLETNPGLAYNFYQKSCPSVDSIVRSVTWAQVAANPALPARLLRLHFHDCFVKWCDASILLDNAQSEKTAGPNLSVGGYEVIDAIKAQVEQACPGVVSCADILALAARDAVSYQFKASLWQVETGRRDG

SEQ ID NO: 39456 - DNA, 1388 bp, Panicum virgatum
  misc_feature: Ceres CLONE 1998354
  misc_feature: Encodes the peptide sequence at SEQ ID NO. 39457
gccccagcaagctaagaaagcagcagtagagctggcgagcagctagatcgatcgagcccgcggatcacagactagatagctagctaagcaaatagatactagataggatggcggcgaaggacgtggcgccgctgatgagcaacgggcacagcgtgatgccggcggtgggcaacgggcaccgcagcagcagcggcaggaggtcgacaatggcgccggcggtgacgctgagcagcgggcaccggatgccggcggtggggctgggcgtgtggcggatggagaaggcggacgtccggggcctcatccacgccgccatccgccagggctaccgccactttgactgcgccgccaagtaccaaaatgaagctgaagttggtgatgcgcttgcagaggcattcgaaagtgggcttgtcaagagagaggaccttttcatcacaaccaagctgtggaactcagatcatgggcatgtcattgaagcctgtaaggatagcttgaagaagttgaagttagattaccttgatctgtatcttgttcacttcccagtggcttctaggcacactgaaattggcacatttgctagtgttattggtgaagatggtgtgctagacattgataccactgtctcactgaaggcaacatggcatgcaatggaagatcttgttaatatgggactggttcgcagcattggaatcagcaactatggcgtcttcctcaccagagactgcttggcctatgccaagataaagcctgctgttaaccaaattgagatgcacccctacttccagcgtgattctcttgtcaaattctgccagaagcacggcatctgtgtcaccgcccacacccccttgggtggctctactgccaacaccaagctgtttggttcactctcatgcctcgacgaccctgtcatcaaggagttggccgagaagtacggcaagacacctgcacagctggtcctccggtggggcctccagaagaacgcggtggtgatccccaagacctccaaggtggagaggctgcaggagaacctggaggtctttgacttcgacatctcagacgaggacatggaggagatcaaggccatcgacaagaactgccgcagcaaccagcctgccaagttctggggcatcgacatctactcttagcttttcttgcttgcaatctcagctgccgtgtgtaacttcctgaaaacttgctccatccaccatccactggttggaacaaaatcaataatgtgttttattcctgcacgggaactcgatgctattcgccgccaacctattcccatcgatcattgaaagtgatcataacatctgacggggattgttgtattgtatctcatgttgttatgaatttgaaaagcatctagtagctgattaaacactcttttc

SEQ ID NO: 39457 - protein, 344 aa, Panicum virgatum
  misc_feature: Ceres CLONE 1998354
  misc_feature (40)..(327): Pfam Name: Aldo_ket_red Pfam Description: Aldo/keto reductase family
  misc_feature: SWISSPROT Homolog: EC 1.1.1.200 Aldose-6-phosphate reductase (NADPH)
MAAKDVAPLMSNGHSVMPAVGNGHRSSSGRRSTMAPAVTLSSGHRMPAVGLGVWRMEKADVRGLIHAAIRQGYRHFDCAAKYQNEAEVGDALAEAFESGLVKREDLFITTKLWNSDHGHVIEACKDSLKKLKLDYLDLYLVHFPVASRHTEIGTFASVIGEDGVLDIDTTVSLKATWHAMEDLVNMGLVRSIGISNYGVFLTRDCLAYAKIKPAVNQIEMHPYFQRDSLVKFCQKHGICVTAHTPLGGSTANTKLFGSLSCLDDPVIKELAEKYGKTPAQLVLRWGLQKNAVVIPKTSKVERLQENLEVFDFDISDEDMEEIKAIDKNCRSNQPAKFWGIDIYS

SEQ ID NO: 39458 - DNA, 517 bp, Panicum virgatum
  misc_feature: Ceres CLONE 1998367
  misc_feature: Encodes the peptide sequence at SEQ ID NO. 39459
gggggggggggagagggacaggccgagcgcgcacgccaccgcgctcgattgggagagccgttgccatcacgccgattaaactagtcgatcgcccggcctcgccagcttgcttgctagcctgcttgcttctcgcctgcgatccggctgccgcccgtctgcttcctccttcctcttccccggcagcagcagcagcagggaaggcatctggtcatggagggcgaggacgacatgcctgaatggatgatggaggtcggcggctgcggaggggggaagggcaaaggcagcggcggcggcggtctggacaataacaagaagcgcttcagcgaggagcagatcaagtcgctcgagtccatgttcgcgacgcagagcatgctggagccgcgccagaaactgcaactggagcgggagctctgcttgcagccgcgccatgtcgccatctggttccagaacaatcgcgcgcgctggaagtccaagcatctcgagcgcgagtactcggcgctccgcgacgactacgacg

SEQ ID NO: 39459 - protein, 102 aa, Panicum virgatum
  misc_feature: Ceres CLONE 1998367
  misc_feature (33)..(87): Pfam Name: Homeobox Pfam Description: Homeobox domain
  misc_feature: The sequence is a functional homolog of SEQ ID NO 260 in the 10/412,699 US patent application
  misc_feature: The sequence is a functional homolog of SEQ ID NO 571 in the 11/479,226 US patent application
  misc_feature: The sequence is a functional homolog of SEQ ID NO 1075 in the 11/479,226 US patent application
  misc_feature: The sequence is a functional homolog of SEQ ID NO 470 in the 10/412,699 US patent application
  misc_feature: Useful for making plants with modulated flowering time
  misc_feature: The sequence is a functional homolog of SEQ ID NO 218 in the 10/225,068 US patent application
  misc_feature: The sequence is a functional homolog of SEQ ID NO 262 in the 10/412,699 US patent application
  misc_feature: The sequence is a functional homolog of SEQ ID NO 574 in the 11/479,226 US patent application
  misc_feature: The sequence is a functional homolog of SEQ ID NO 74 in the 10/374,780 US patent application
  misc_feature: The sequence is a functional homolog of SEQ ID NO 577 in the 11/479,226 US patent application
MEGEDDMPEWMMEVGGCGGGKGKGSGGGGLDNNKKRFSEEQIKSLESMFATQSMLEPRQKLQLERELCLQPRHVAIWFQNNRARWKSKHLEREYSALRDDYD

SEQ ID NO: 39460 - DNA, 720 bp, Panicum virgatum
  misc_feature: Ceres CLONE 1998376
  misc_feature: Encodes the peptide sequence at SEQ ID NO. 39461
gagcacgccgccatccagatccagccgcccttcctaccgccggaactccgcatccctcgccgtcggccccgcccctcggatcggtcggcgtctcctcttgctgaatcactaaccagatggctgacggcgaggacatccagccccttgtctgcgacaatggcaccggcatggtcaaggctggttttgctggggacgatgcgccaagggctgtcttcccgagtatcgttgggcgccctcgccacactggtgtgatggtggggatggggcagaaggacgcctatgttggagacgaggcccagtccaagaggggtatcctcaccctgaagtacccgatcgagcatggtatcgtcagcaactgggatgacatggagaagatttggcaccataccttctacaatgagctccgtgtcgctcccgaggagcaccctgtactgctgaccgaggcacccctgaaccccaaggctaacagggagaagatgacccagatcatgtttgagaccttcaatgtgccagccatgtatgttgccatccaggctgtgctctccctctacgccagtggacgcactacaggtatcgtgttggactctggtgatggtgtcagccatactgtgccaatctatgaagggtatgcccttccccacgccattctccgtctcgaccttgctggacgtgatctcactgacagcctgatgaagattcttactgagagggggttactcc

SEQ ID NO: 39461 - protein, 201 aa, Panicum virgatum
  misc_feature: Ceres CLONE 1998376
  misc_feature (4)..(201): Pfam Name: Actin Pfam Description: Actin
  misc_feature: SWISSPROT Homolog: EC 2.7.10.2 Non-specific protein-tyrosine kinase
  misc_feature: Useful for making plants with modulated biomass
  misc_feature: Useful for making plants with modulated flowering time
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGLL

SEQ ID NO: 39462 - DNA, 607 bp, Panicum virgatum
  misc_feature: Ceres CLONE 1998383
  misc_feature: Encodes the peptide sequence at SEQ ID NO. 39463
accattacagtacgcactccggctgacgcgccccgcactcacaaagctcaagcctttcgctcgctcgctcgctcgcggctacatctacaatggcgcgattccagctcgcggccctggccatggccatgctcttcgccgcggcggcggcgcaggccccggccgccaccccgacgccggcgcccagggcgtcccccccgccggcgactcctccgccgaccccggcgccggtgtctccgcccgcgcaggcccccgccgttcctcccccggccccggcgcccgcgactccggcccccgcccccgaggccgccgccccggcgccggcggcggccaccgccttcgacgaagctgccgcggctgccggcgtcgggctgggtcacggcgcgcgtttcgcccgcaagcctggacgtgctgccgccgagaagccgctgccggagcctcagcctctgccacaacccaagcctgaaccgaaaccagagcccaagcctgaacccaaaccagaggcggactccaaacctgaacccaaaccagagcacgaaccaaaaccattgccacatcccgagccaaaacctgtgcctcaccctaaactcctgcccaaaccacaacacaa

SEQ ID NO: 39463 - protein, 172 aa, Panicum virgatum
  misc_feature: Ceres CLONE 1998383
  misc_feature: Useful for making plants with altered carbohydrate content
MARFQLAALAMAMLFAAAAAQAPAATPTPAPRASPPPATPPPTPAPVSPPAQAPAVPPPAPAPATPAPAPEAAAPAPAAATAFDEAAAAAGVGLGHGARFARKPGRAAAEKPLPEPQPLPQPKPEPKPEPKPEPKPEADSKPEPKPEHEPKPLPHPEPKPVPHPKLLPKPQH

SEQ ID NO: 39464 - DNA, 1415 bp, Panicum virgatum
  misc_feature: Ceres CLONE 1998389
  misc_feature: Encodes the peptide sequence at SEQ ID NO. 39465
agcataactgtgtcctctgtcctccttggtttccttttcctctccggctccgtcgccgtccagatgctcacgctgctgtgctcgcgtgccgtcgccctcccactcgctccgcctccacgcttccttcaccgcctgccgcacccgcgcgcctcctcctcctcctcctcctcttcctcgctcccgccgccgccgccgtcggggatggagacctcctacaagttcggcccctacaagatcgacgccagggaggtcttccacgccacgcccctctcctacgccatggtcaacctccgccccctgctccccggtagtattccctgctctccttttctcacttcgcctctgctgatgcctgcaccattgctgatttgctgtatgtaccctttgggagttgctagaatcatttatacccaacatcgagtcccaaatgctaaataaaactcaaacgaaagctctcctagtaataacttctgccaggaaccagtgtgccaccggatcgtttctataggcgaagaattatggcattgccttctgcttggcttccaatgtgaactagttccatgcaatctggtggtactttatctagtccctgcctaccagacaagccttaacagttccataatatattttctcctgatgaaacctgacactagaatcatttaggctctgtaaagcttgaaatctccacattgcatttcattttttatcagtttgtgttctccagctttttctcataaccatgcaatttttcttatgcaggtcatatccttttatttcagtaaagctggtactatactttctcggaagctattttttgggcactttggcagattttaccactcacgtgccatgtgctgcctttgtctctgtggccaactaatcaatgaattgctggcacttcagcaaagttcatgaagagcattcaaacaaatatgaaagaaactgactaaccgagcagtggaagttttcatgaaacctttgcaatggttctcttcttttgacacctgtttttcagccgttctagatgatcaagttagctttaggtattcatttagtaagaatgactgtgcttttttgaaccgctggcttcatattttgttgacgtttccatagagactatctgcaactctgtgccatgttattctttttccttcttcatgcaatacatccacctgcagtacatctgtactcaaattgactttattagaatgttacttgcaattggagttgtgaatcaatttttgttgtgttgtcattttggttcaaacatgtcataactcataaccctgcctgaataattttatttggctccaagtttgatacatcacattttgggaaaaatatgttattctatatgcatcatttcttctccttgacaatacatacatgttcttgtgtgccccaagcgtgaagtg

SEQ ID NO: 39465 - protein, 78 aa, Panicum virgatum
  misc_feature: Ceres CLONE 1998389
  misc_feature: SWISSPROT Homolog: EC 3.6.1.29 Bis(5'-adenosyl)-triphosphatase
METSYKFGPYKIDAREVFHATPLSYAMVNLRPLLPGSIPCSPFLTSPLLMPAPLLICCMYPLGVARIIYTQHRVPNAK

SEQ ID NO: 39466 - DNA, 584 bp, Panicum virgatum
  misc_feature: Ceres CLONE 1998389-R
  misc_feature: Encodes the peptide sequence at SEQ ID NO. 39467
atgagacaagtgacttatgggttactgcaaaggaagttggtgcacgtcttgagcagtaccataaagcatcttcacttacctttgctattcaggatggtcctcaagctggccaaacagtcccacatgtccacattcacgtcatcccaaggaagaaaggggattttgagaaaaatgatgaaatatatgatgcgattgatgtgaaagagaaagaattgaaggagaagcttgacctggacattgagaggaaagatagaagcatggaagaaatggctcttgaggccaatgagtaccgtgctcttttctcctagaattgcatctagtatatttagtttctaagttgagctgactgcttgccacaaataagtctatgggctggtccctataagaagggagttgaaggacagaggaggttgcgggctctacgctaatggccactgtcgagttatatataatgtatgaagcctaaacattgtactatgttcctacattaaatacaatattctgttgccctaatgtgttgggatgttgctgcagcggcaagacaccatattttatcttgtaactaattcggatatgtcaagtgg

SEQ ID NO: 39467 - protein, 101 aa, Panicum virgatum
  misc_feature: Ceres CLONE 1998389-R
  misc_feature: SWISSPROT Homolog: EC 3.6.1.29 Bis(5'-adenosyl)-triphosphatase
  misc_feature: Useful for making plants with modulated heat sensitivity
ETSDLWVTAKEVGARLEQYHKASSLTFAIQDGPQAGQTVPHVHIHVIPRKKGDFEKNDEIYDAIDVKEKELKEKLDLDIERKDRSMEEMALEANEYRALFS

SEQ ID NO: 39468 - DNA, 698 bp, Panicum virgatum
  misc_feature: Ceres CLONE 1998398
  misc_feature: Encodes the peptide sequence at SEQ ID NO. 39469
ctacagctttggtgtcgtgcttctggagctggtaactggaaagaagccggtaggggagtttggggatggtgtggacatagtccagtgggtcaagacgatgacggactcgaacaaggagcaagtgatcaagattatggaccccaggctttcaactgtgccggtgcatgaggtcatgcatgtcttctatgtcgctctgctttgtatcgaggagcagagcgtgcagcggcctacgatgcgggaggtggtgcagatgcttagtgagcttcccaagccgacaatgaggcagggagaaggagatgaggtacccagtagcgatgatggtgccgcccctgatactccagtgtcgtctggatctgttgtagcactgaatgatgaagccaaagagcagcagcagcagcaaccaagctcacaatcgtccccaactcgagatctcatcagattctgaaagcagtcaagcttaattgttaccattccttcttctgttgaaagtttggatatttcaggtttagggtatggtattttaggtttctgcatttcgggtgtggaattagggtgtcaaatttagctatctggcattcagccatcgtcaattagtgtgtggaatctttagggtctgaaatgtggtgtggtgtgcgccttaattaggtcgttgttctgtatatgtccagcttcctaatgtccattctccctgttagatt

SEQ ID NO: 39469 - protein, 147 aa, Panicum virgatum
  misc_feature: Ceres CLONE 1998398
  misc_feature: SWISSPROT Homolog: EC 2.7.11.1 Non-specific serine/threonine protein kinase
YSFGVVLLELVTGKKPVGEFGDGVDIVQWVKTMTDSNKEQVIKIMDPRLSTVPVHEVMHVFYVALLCIEEQSVQRPTMREVVQMLSELPKPTMRQGEGDEVPSSDDGAAPDTPVSSGSVVALNDEAKEQQQQQPSSQSSPTRDLIRF

SEQ ID NO: 39470 - DNA, 677 bp, Panicum virgatum
  misc_feature: Ceres CLONE 1998399
  misc_feature: Encodes the peptide sequence at SEQ ID NO. 39471
atccaagcccgcttacacgtgaaccctaaccccactttctctgctccggtctcaagcgcgtaccctccgccgccggcgaccattccgcgcgcagccacgcttgcttcccccggccgccacgatgtcgtcggagcctccgcccaccgccgccgccgcggatgagctcgcggctgacctctccgccgccaccctcagcaagaagcagcagaagaaggacgccaggaaggcggagaaggccgagaaagcggcgcagcgccagcagcagcagcagcagccggcggacgccgaggaccccttcgcggccaactacggcgatgtccccgtcgaggagatccagtccaaggccatctccggccgcttgtggaccaagatcggcgacctcgacgccgacgccgcgggttgctccgttcttatccgcggagccacgcaggctatccgtccggtcagcaagaagatggccttcgtcgtcctgcgccagagcatgagcaccgtgcagtgcgtgctcgtcgccagcgccgacgccggcgtcagcacgcagatggtgcgcttcgccaccgccctcagcaaggagtccatcgtcgacgttgagggcgtcgtttccctccccaaggagcccctcaaggctacgacacagcaggtggagattcaagtaaggaagatatattgcatcaataggg

SEQ ID NO: 39471 - protein, 185 aa, Panicum virgatum
  misc_feature: Ceres CLONE 1998399
  misc_feature (96)..(183): Pfam Name: tRNA_anti Pfam Description: OB-fold nucleic acid binding domain
  misc_feature: SWISSPROT Homolog: EC 6.1.1.12 Aspartate--tRNA ligase
MSSEPPPTAAAADELAADLSAATLSKKQQKKDARKAEKAEKAAQRQQQQQQPADAEDPFAANYGDVPVEEIQSKAISGRLWTKIGDLDADAAGCSVLIRGATQAIRPVSKKMAFVVLRQSMSTVQCVLVASADAGVSTQMVRFATALSKESIVDVEGVVSLPKEPLKATTQQVEIQVRKIYCINR

SEQ ID NO: 39472 - DNA, 710 bp, Panicum virgatum
  misc_feature: Ceres CLONE 1998432
  misc_feature: Encodes the peptide sequence at SEQ ID NO. 39473
aacatccgaatctagggtttttatcctcttctccagccgccgccgctccaccggccgctcctccatcccttctgccaatggcgaccactcacgcgatcagcaagaagcggaagttcgtggcggatggcgtgttcttcgcggagcttaacgagatgctcacccgtgagctcgccgaggacggctactccggcgtcgaggtccgtgtcactcccatgcgcaccgagatcataatccgcgccacccgcacccagaacgttctcggcgagaagggcaggaggatcagggaactgacttctgtggttcagaagcgcttcaacttcccggagggcggcgtcgagctctatgccgagaaggtgaacaaccgcggcctctgcgccattgcccaggctgagtcactccgctacaagctcctcggtggactcgccgtcagaaggttatgctcttatcatatacaatgctgttatgataattatataggcatttcagtgatgcacagttacagtcactcacacagcagactcggcttattgctatgccagatctgtgttcgaaggtgacgaaattgaccatctccctccatgctttttataggcagtggaaggatttatcactgttccattgcttgagcgtttgcttgagcgttcgagggatatgtgtattattacttttttttgaaactatgtgtattattacttgtgtgctaatgcatt

SEQ ID NO: 39473 - protein, 159 aa, Panicum virgatum
  misc_feature: Ceres CLONE 1998432
  misc_feature (47)..(104): Pfam Name: KH_2 Pfam Description: KH domain
  misc_feature: Useful for making plants with modulated biomass
  misc_feature: Useful for making plants with modulated water use efficiency
MATTHAISKKRKFVADGVFFAELNEMLTRELAEDGYSGVEVRVTPMRTEIIIRATRTQNVLGEKGRRIRELTSVVQKRFNFPEGGVELYAEKVNNRGLCAIAQAESLRYKLLGGLAVRRLCSYHIQCCYDNYIGISVMHSYSHSHSRLGLLLCQICVRR

SEQ ID NO: 39474 - DNA, 1505 bp, Panicum virgatum
  misc_feature: Ceres CLONE 1998448
  misc_feature: Encodes the peptide sequence at SEQ ID NO. 39475
tccggtcttgaaacctaatcctctaatcgctgcgagcctgcgagctgcggctggagggccgccgccggggtcgccgcttccccgccgccggggccgcccctcccgtcgctgcggccggagagctcgtgcttgagcccatcttgctggtgccgctgctcccccggcgccgcgccgccgccgccgccgctaggagctcgtgcacccgcatctccggcgtcgcgtcccagccatcctctctaggtcagccagtatactagtatctgctcgtcgacatcgaggtcgtgccggggatcaaaaggttcgtccgcggaggcgccgagctcgtcgaccaccgcggtcatcctcgccaccagctaccacagcaaggtccctcagtggctaaaggactaccctagttccaattcctaggtccgccactgccacctgctcccaactgagcggccaggatgcgggttaagaagcgttcgaagcaccgcaaggcggtcaagttctattccacatgcttcggcttccgtgagccttacaaggtcctcatcgatggcaccttcgtccagcacctcatcacccagcgcctcctcccagccgatgaggcactccgcgacctcctatcggcctccagggcgccagccctcttcacctccaagtgtatcgtcgcagagctcaggcgactcggcaagtcacatgccgaatccttcgacaacgctcagcttctcgccacaaacaagtgtgagcatgacaaggttgtcagtgcagtgaattgtatcctatcactgataggtgataggaatcctgagcgattctttgttgccacccaagacgctgatctccgggaaaagctaagagagattcctggggttcctgtaatatatggattgaagaactccttatttatagagcaaccctctgttcagcaacgcaagtttgctcaattggatgaggagaagcgtctcaatatggatatatctgagtataagaagttaatgaaggctgcatcagaaggaaagacaacagctagtgaaaatggaagtgacggagaacaacatgagaggcctatcagttcccttgtaaaaaatgcacttggtgttgcagataaaagcaagtttaaaaggaacagagcaaagggtccaaacccactctcctgcaagaaaaagaaaccaaacccccagccctcagctattcaaaataagggggctacggttgatggcgaggcaaagagaaagagagttcgtaagcggaagagaagccagaaagataacaaacaagcagagacctaaatggtcttgcatacaagtttcagtgctcttgctgcgtctccatcttgacccctgaggacctgaacaagaactaagtcaactaggggagcttgaatctggctttgcctgattaatgtattgcatcagtgtggttgaacctatgctttatttttggtaacaaatctgtactatggttggatcattttggccaatctggtgaatgtttcttcattcagaaaaaatgttatctgt

SEQ ID NO: 39475 - protein, 275 aa, Panicum virgatum
  misc_feature: Ceres CLONE 1998448
  misc_feature (51)..(152): Pfam Name: Fcf1 Pfam Description: Fcf1
MRVKKRSKHRKAVKFYSTCFGFREPYKVLIDGTFVQHLITQRLLPADEALRDLLSASRAPALFTSKCIVAELRRLGKSHAESFDNAQLLATNKCEHDKVVSAVNCILSLIGDRNPERFFVATQDADLREKLREIPGVPVIYGLKNSLFIEQPSVQQRKFAQLDEEKRLNMDISEYKKLMKAASEGKTTASENGSDGEQHERPISSLVKNALGVADKSKFKRNRAKGPNPLSCKKKKPNPQPSAIQNKGATVDGEAKRKRVRKRKRSQKDNKQAET

SEQ ID NO: 39476 - DNA, 682 bp, Panicum virgatum
  misc_feature: Ceres CLONE 1998449
  misc_feature: Encodes the peptide sequence at SEQ ID NO. 39477
  misc_feature (611)..(611): n is a, c, t, g, unknown, or other
accgcaacccatctcctcccttcgctcccccagcgcccgccgctctccacgcggtcggcccgtgcgccgccctccacgctcccctgcccagctgcagctccagtccggctgctgcggcagcatcctcccttcccacgacttctctgttctttctctcggcctcggtcttcctttcctagcggcgacgaccgggcaagttgcgctgcccgttgttcgtcaagcgacgggcgcttcgccggcggcgaacatccgacacgggccgtcactgctactttgggtgccagtgcaatgcccggtggatcttcagctgctgatggtgatgtggaggcagggtttgcaaagctccagggcgaagatttcgagtactacatgcagacatattcaatcatgctgggccgcaacagcaagaaatcgacagtggatgtggatctctcgagcctcggcgggggtatgaacatctcccgccaccatgcccggatattctacgatttccagcgtcgtcggttcgccctcgatgttattggcaagaatggattccttgttgagggtgttctgcacctccctggaaacccgcctgttaagcttgattcacaggatctgctgcagattgnggacaaaaagttttactttctgctgccgacgcgatctatcttcgcctcagcggctgctgctcgacatgctc

SEQ ID NO: 39477 - protein, 131 aa, Panicum virgatum
  misc_feature: Ceres CLONE 1998449
  misc_feature (33)..(108): Pfam Name: FHA Pfam Description: FHA domain
  misc_feature: Useful for making plants with altered alkaloid content
  misc_feature: Useful for making plants with altered lignin content
  misc_feature (108)..(108): Xaa is any aa, unknown, or other
MPGGSSAADGDVEAGFAKLQGEDFEYYMQTYSIMLGRNSKKSTVDVDLSSLGGGMNISRHHARIFYDFQRRRFALDVIGKNGFLVEGVLHLPGNPPVKLDSQDLLQIXDKKFYFLLPTRSIFASAAAARHA

SEQ ID NO: 39478 - DNA, 1378 bp, Panicum virgatum
  misc_feature: Ceres CLONE 1998452
  misc_feature: Encodes the peptide sequence at SEQ ID NO. 39479
accgcgggaacgcgccgtgtgctagctctgctcacccggtccaaccctaaccgatccgcagttcacgactgccccgcacggccgagtgcacgagctctcccgctagtcctctgtcctcggccactgaaattcacgggcgggtcgaggggtccattggagaggacggcgaggggccgggggataggaggaagccaaagcgaggaagaagagagagacgagaagggaaggagtttgggggtgtgggaccggcagattcagagtcgtttttgttccgaattttcaagcgattgaggcgcgaggagcaagcgagagaggagcggagatggttgtggtgaagcagaggaggatgtcgggagagagctcagacaacttccaactgcttccgtcaaaaagaacaatttgcaactgagagcttcgctaggacgatgctgattggcggcgccgttgctgtgcgggtgcaggtgttctggcccaagatcgtgctcaagaagtggctcaacctcaagagcaaggacttggactttggcgccgacgaggacgaggacgacgacgacggcagcgacattgacgaccaagagaactgcggttgcgacgacgtcgcggccgccgccgacgagctccttcccggcacggacaccgagaccgacaccgatgacgacgcgccgttcgccttccccgtgcggccggagcagttcgtcgcggcgaccccgaggaagctgagcaggctcaaccacttcagcgtcgtggatgactcggagctcaacggcgacgaacctgacgagcttgaccaggagccgcagccagaagctccgcagaggacgcttctaaggtcgctgagcagggcggacagggtcgggctggtctggccggagcagccgctggacctggtgcccgcgcgcgccatgaacgccgcgtcgtcggcgtcgttcaaggcgtccaggtcgttcagggcctacaagtcgttcaggggttcgtcccgcgtcgccgacgcgccggcggacgacctgccaatgatcccggacctggacctcgacggcgcgctgcgcaagaagagccggtcgccgttcgtgaggatcgtgagcaagcagatggtgggcatcttcctgacggtctgggtgaggaggggcctcaggaagtgcgtccagaacctcaaggtctccaccgtcggcgtcggcgccatgggctacatcggcaacaagggagccgtgtcagtgagcatgtccatctaccagaccatgttctgcttcgtgtgctgccacctcgccgccggcgagaagcccggcgacgtccacaagcggaacgccgacgtgcaggagatccaccggcggacgcgtttccctgccccgggtgaccagcagctgctcagagacatccacaa

SEQ ID NO: 39479 - protein, 317 aa, Panicum virgatum
  misc_feature: Ceres CLONE 1998452
  misc_feature: SWISSPROT Homolog: EC 3.1.3.56 Inositol-polyphosphate 5-phosphatase
MLIGGAVAVRVQVFWPKIVLKKWLNLKSKDLDFGADEDEDDDDGSDIDDQENCGCDDVAAAADELLPGTDTETDTDDDAPFAFPVRPEQFVAATPRKLSRLNHFSVVDDSELNGDEPDELDQEPQPEAPQRTLLRSLSRADRVGLVWPEQPLDLVPARAMNAASSASFKASRSFRAYKSFRGSSRVADAPADDLPMIPDLDLDGALRKKSRSPFVRIVSKQMVGIFLTVWVRRGLRKCVQNLKVSTVGVGAMGYIGNKGAVSVSMSIYQTMFCFVCCHLAAGEKPGDVHKRNADVQEIHRRTRFPAPGDQQLLRDIH

SEQ ID NO: 39480 - DNA, 1029 bp, Panicum virgatum
  misc_feature: Ceres CLONE 1998460
  misc_feature: Encodes the peptide sequence at SEQ ID NO. 39481
atccattctccttcctccccacaaaaacatttctcccccttcggctgctgccgccgctgcctcccctttccgcctgccttccccctttccccctccctccttctagggtttcccccgccgccgccgccgccgctcgatccgaggcagatgccgcccgcagccatggcgccgccgccacgccgaggccagccgtcaggtccttctgcaagactctcaccgcgtccgacaccagcacacacggtggcttctctgtgctgcgccgccacgctgacgagtgtctccctcccctggatatgacccagtcacctccaacacaagagcttgtggcgaaggatctgcatggcatggagtggcgcttccgacacatctttcgtgggcaacctaggaggcatctcctccagagtggttggagcgtgtttgttagttctaaaaggcttgttgctggcgacgccttcattttcctcagaggagaaaatggtgaacttcgagttggtgttaggcgggctatgaggcagttgtctaacgtaccttcttcagtcatatctagccaaagcatgcacctcggagtccttgcaactgcatggcatgccatcaacactaaatccatgttcactgtgtaccacaaacctaggacgagcccctcagagttcatcataccatatgatcagtatatggagtcattaaagaacaactattctattgggatgagattcaggatgcggtttgaaggggaagaggccccagagcagaggtttactggtactatagttgggtgcgaaaatcttgacccgttatggcccgattccagttggagatacttgaaggtgcgttgggatgaaccttcaactatcccacgtcctgatagggtctctccgtggaagatagagcctgcttcatcacctcctgttaatccccttccactttcttctagagtcaagagacctagacaagctcctccaccttcacctgaatcatcagttcttaccaaagaaggtgcaactaagattgatatcaactctgctcaaacac

SEQ ID NO: 39481 - protein, 342 aa, Panicum virgatum
  misc_feature: Ceres CLONE 1998460
  misc_feature (193)..(274): Pfam Name: Auxin_resp Pfam Description: Auxin response factor
  misc_feature (66)..(171): Pfam Name: B3 Pfam Description: B3 DNA binding domain
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
  misc_feature: The sequence is a functional homolog of SEQ ID NO 298 in the 10/412,699 US patent application
  misc_feature: The sequence is a functional homolog of SEQ ID NO 300 in the 10/412,699 US patent application
  misc_feature: Useful for biocontainment applications
  misc_feature: Useful for making plants with modulated flowering time
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 576 in the 10/666,642 US patent application
  misc_feature: The sequence is a functional homolog of SEQ ID NO 100 in the 10/666,642 US patent application
  misc_feature: Useful for making plants with modulated light quality sensitivity
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
PFSFLPTKTFLPLRLLPPLPPLSACLPPFPLPPSRVSPAAAAAARSEADAARSHGAAATPRPAVRSFCKTLTASDTSTHGGFSVLRRHADECLPPLDMTQSPPTQELVAKDLHGMEWRFRHIFRGQPRRHLLQSGWSVFVSSKRLVAGDAFIFLRGENGELRVGVRRAMRQLSNVPSSVISSQSMHLGVLATAWHAINTKSMFTVYHKPRTSPSEFIIPYDQYMESLKNNYSIGMRFRMRFEGEEAPEQRFTGTIVGCENLDPLWPDSSWRYLKVRWDEPSTIPRPDRVSPWKIEPASSPPVNPLPLSSRVKRPRQAPPPSPESSVLTKEGATKIDINSAQT

SEQ ID NO: 39482 - DNA, 441 bp, Panicum virgatum
  misc_feature: Ceres CLONE 1998462
  misc_feature: Encodes the peptide sequence at SEQ ID NO. 39483
cattgctccagcacttctggcctcccctgagaaggcttgcactgggggcggtggctgcccgcttgtcacccatcctcctgagaagcattgtaccttcccctaggctgacgctagatgtcaatatactcactgctgattgcagtttctggggcaatagctcttaaggatctctccgacgctggcttcattgttttcctattcactataactcactggcttgacaccagcgccagccacaaggcaactgctcggatgtcatcactaatgaccacgacacccccacaagctgttctatcagagactggtgaagtggttgcagctcaggatatcaaggtcaatacagcaatagctgccaaagctggggaaatcatcccaattgatggtgttgctgttgatggaccgagctaggtctgatgaagaataccctcactggcaaatcct

SEQ ID NO: 39483 - protein, 97 aa, Panicum virgatum
  misc_feature: Ceres CLONE 1998462
  misc_feature: SWISSPROT Homolog: EC 3.6.3.4 Copper-exporting ATPase
MSIYSLLIAVSGAIALKDLSDAGFIVFLFTITHWLDTSASHKATARMSSLMTTTPPQAVLSETGEVVAAQDIKVNTAIAAKAGEIIPIDGVAVDGPS

SEQ ID NO: 39484 - DNA, 1487 bp, Panicum virgatum
  misc_feature: Ceres CLONE 1998480
  misc_feature: Encodes the peptide sequence at SEQ ID NO. 39485
ctgtctgtctctctcgtcctcctcactcagacctctccgcacccccgcgcaatggctgattcgccaaaccctagctccggggacctccccgccggctccgggggctcgccggagaagccggtcctcgcggatcggcgcgtggcggcgctcgccggtgcgggcgcgggcgcgaggtacaaggccatgtcccccgcgcggctgccgatctcgcgggagccctgcctcaccatccccgccgggttcagccccggcgctctcctcgattcccccgtcctcctcaacaacttcaaggttgaaccctctccaactactggtactctgagcatggctgcgatcatcaacaagagcacccatctggacatactgccttcaccccgggacagatcagctggcagtggccatgaagatggggattctcgggattttgaattcaagcctcatctcagttgtcagccagcgggtcctgctgtcaatgatccaaatcatcatgacacttctatgcaaaatcatacctcatcatcgagcaatttaatgactgaaaataaatctctctactcacaggagtcgattcatcagacagcaaatatttcaagtgttccaaatcaacctgttgcaatagttggtccttctgacaacatgcctgctgatgttggtacatcagagatgaaccagatgaatagctctgagaatgctgcccaggagacacaaactgaaaatgtagctgaaaaatcagctgaggatggttataactggcgtaaatatggacagaagcatgtcaagggaagtgaaaaccctagaagttattacaagtgcacacatcctaattgtgaagttaaaaaactcttagagcgctcgcttgatggtcagattactgaagttgtttataaagggatccataatcatcctaagccccaacctaataggaggttatctgctggtgcggttccttcaagccagggtgaagaaagatatgatggtgcagcacctgttgaagacaagccttcaaatatttatcccaacctctgtaatcaagtacattcagctggcatgattgaacctgttccgggtccagctagtgatgatgatggtgacggcggaggtggaagaccctaccccggggatgatgctaacgaggatgatgatttggattcaaaacgcaggaaaatggagtccgctggcatcgatgctgctttgatgggtaaaccaaatcgtgagccccgtgttgttgtacaaactgttagtgaagttgatatcttggatgatggatatcgctggcgcaagtatgggcagaaagtagtgaaaggaaaccccaatccacggagttactataagtgcacacatacaggatgtccggtcaggaagcatgttgagagagcatcgcatgacccaaagtcagtgatcacaacatatgaaagaaaacataattatgaagtcccagcttccaggaatgcaagtcatgagatgtctgcagctcccatgaagcctgc

SEQ ID NO: 39485 - protein, 478 aa, Panicum virgatum
  misc_feature: Ceres CLONE 1998480
  misc_feature (228)..(286): Pfam Name: WRKY Pfam Description: WRKY DNA -binding domain
  misc_feature (402)..(461): Pfam Name: WRKY Pfam Description: WRKY DNA -binding domain
MADSPNPSSGDLPAGSGGSPEKPVLADRRVAALAGAGAGARYKAMSPARLPISREPCLTIPAGFSPGALLDSPVLLNNFKVEPSPTTGTLSMAAIINKSTHLDILPSPRDRSAGSGHEDGDSRDFEFKPHLSCQPAGPAVNDPNHHDTSMQNHTSSSSNLMTENKSLYSQESIHQTANISSVPNQPVAIVGPSDNMPADVGTSEMNQMNSSENAAQETQTENVAEKSAEDGYNWRKYGQKHVKGSENPRSYYKCTHPNCEVKKLLERSLDGQITEVVYKGIHNHPKPQPNRRLSAGAVPSSQGEERYDGAAPVEDKPSNIYPNLCNQVHSAGMIEPVPGPASDDDGDGGGGRPYPGDDANEDDDLDSKRRKMESAGIDAALMGKPNREPRVVVQTVSEVDILDDGYRWRKYGQKVVKGNPNPRSYYKCTHTGCPVRKHVERASHDPKSVITTYERKHNYEVPASRNASHEMSAAPMKP

SEQ ID NO: 39486 - DNA, 751 bp, Panicum virgatum
  misc_feature: Ceres CLONE 1998480-R
ggccttggtggcatgatgagagcatgcgatggcagggccttcaccaatcaatattctcaggcagccgaaagtgacaccatcagtcttgaccttggagttggaatcagcctgaaccacagcgacgcaacaaaccaaatgcacccttcagttccagaagcaatgcagtatcaaatgcaacacatggctcctgtgtatgggagcatgggatttccaggaatgccagtgccaacagtacctggaaatgcagctagcaatgtgtacggatccagagaggaaaaagcaaatgaagggtttactttcaaagccacaccattggaccgttcagctaacttgtgttacagtagtgctggtaacttagtgatgggtccatgagtgtcttaactgatggttatacctccatgaatcacatattaccgtcgtcatgaaatctcttcaggtgatgctctactgtgcatcatccacacataattgaatcggaggcggaccaagtttatacctgagagccgcagctattacacaggaggtcttttgctgttaggatgtattctctgtatgatgctgcagctcaacattcgttgtacagcaaaccagttatgattaattagattatgataatttggatatgtaaacttctttctgtaccggaatatgggatagaaccaaagagctatcctgtggcaaaaactcgttatcttctgcatatgaacgatgccagtttgatattgatatatggaatgaaatatatcatttc

SEQ ID NO: 39487 - DNA, 739 bp, Panicum virgatum
  misc_feature: Ceres CLONE 1998482-R
  misc_feature: Encodes the peptide sequence at SEQ ID NO. 39488
ctagggattacaatgcaaactggatgactgcagtcgagatgcttgatgatgaagcctatatcggggcagaaaatggctataacctattcactgtacgcaagaacagtgatgcagccacagatgacgaaagggccaggctggaggttgttggggagtaccatctcggagagtttgtgaataggttccgccatggttcactcgtaatgcgccttccggactcagagatagggcagattcccacagtcatctttggcacaataaatggggtaattagcatcatcgcctccctcccacatgaccagtatgtgtttctagagaagctccagtccactcttgtgaagttcataaagggtgtcggaaacctgagccatgagcaatggcgttcgttccataatgacaagaagacggctgaggctcggaacttccttgatggcgacctgatcgaggcatttcttgaccttagcaggagtaagatggaggaggtgtccaaggctatgggtgttcctgtggaggagctgtctaagagagtggaagagttgacaaggctgcactagatgaataagtttgcagcttgctgtaacatgtaaatcctttgtaacttgtattttgtagtgtcgccgtggcatgtagttttcagtgcagggagtttcctccgtgatgctgttaccgccggttgcacaagtgttcacccgtggttgtagtttcgtttgctttgttggatagctacttttcagctgac

SEQ ID NO: 39488 - protein, 183 aa, Panicum virgatum
  misc_feature: Ceres CLONE 1998482-R
  misc_feature (1)..(122): Pfam Name: CPSF_A Pfam Description: CPSF A subunit region
RDYNANWMTAVEMLDDEAYIGAENGYNLFTVRKNSDAATDDERARLEVVGEYHLGEFVNRFRHGSLVMRLPDSEIGQIPTVIFGTINGVISIIASLPHDQYVFLEKLQSTLVKFIKGVGNLSHEQWRSFHNDKKTAEARNFLDGDLIEAFLDLSRSKMEEVSKAMGVPVEELSKRVEELTRLH

SEQ ID NO: 39489 - DNA, 1432 bp, Panicum virgatum
  misc_feature: Ceres CLONE 1998482
gacatctctctcgtcgtccctctctgtggctcggaccacctccttccgcgaccttccagaacccactgcccccggcggcggcggcaccgtcggcggcggcggagatgagcgtgtggaactacgtagtcacggcacacaagccgaccagcgtcagccactcctgcgtcggcaacttcaccagccccaaccagctcaacctcatcatcgcgaaatgtacccgcattgagatccatttgcttactcctcagggccttcagcctatgcttgatgtccctatatacggaaggatcgcatcatcaatttcatatctcgataatggtgttgtttatgttggttcacgatttggcgattcacagctggtgaagctgaacctccaagctgatgcaagtggttcatttgttgaagttctggaacggtatgtgaatcttggacctattgtggacttctgtgtggttgaccttgatagacagggtcagggtcaggtggtcacttgttctggggcatttaaagatggttcccttcgcgtggttcggaacggtatagggattaatgagcaggcttcagtagaactccaaggtatcaagggattatggtcattgaaatcttctttcaatgatccttacgacatgtacctagtcgtgagctttataagtgagacacggttcttggcaatgaacatggaagatgaactagaagaaactgagatagaggggtttgatgcgcaaacacagaccctcttttgtcaaaatgcgatcaatgatcttctcatacaggttactgctaattctgttcggttagtcagttgcacctctcgggagctagtggatcaatggactgcacctgcaggattttcagtcaatgttgcttcagctaatgctagtcaggttctgctggcaacaggtggtggccatcttgtttacctagaaattagggatgctaagcttgttgaagtgaagcatgcacagctagaacatgagatttcttgtctcgatttgaacccaattggggagaatccacagtatagttccctagctgctgttggaatgtggacagatataagtgttagaatattttcacttccagatcttgaattaataaggaaggaaaatttgggtggagaaattgttcctcggtctgttctgctgtgcaccttggagggggtttcgtatttgctttgtgctcttggagatggtaacctgttcagttttctgctgaatgcgagtacaggtgaactcactgatagaaagaaggtttcccttgggacccaaccaatcagccttcgtacattctcatcaaagggtaccacccacgtgtttgcttcatcagataggccaactgtcatctatagcagcaataagaaacttctctatagcaatgtcaatttgaaagaagttaatcatatgtgccctttcaatacagccgcttttccaga

SEQ ID NO: 39490 - DNA, 546 bp, Panicum virgatum
  misc_feature: Ceres CLONE 1998512
  misc_feature: Encodes the peptide sequence at SEQ ID NO. 39491
atctcctctcctctcctctccctctcccctccctccctctccgtgcgctcgtagtgcattcccgttgtccgcggtagaggaaccctaacgctccccggatcccgcggcggggtggaatggccgcgccggcgttcctgccctagctggccacgcaggtggtggtgcccgtcgcggccgtggtgggcatcgccttccccgcgctgcagtgggtgctggtctccaaggtgaagctctcccccgacccgcagcgccgggacgggtcctccccgaagatcgggaccggtccctgccagtacctcatccatgaggaggagaggctcaacgagcacaacgtcctggtcaagtgcgccgagatcccaaacgccatctccgagggagcaacttctttccttttcactgaatataaatatgtcggactattcatgggtatttttgctgtcctgatcttcctcttccttggctctgctgcggggtccagtaccgacagtccgccttgccactacggcaagggcaatacgtgcaagcctgcccttgccaatgctcttt

SEQ ID NO: 39491 - protein, 41 aa, Panicum virgatum
  misc_feature: Ceres CLONE 1998512
  misc_feature: SWISSPROT Homolog: EC 3.6.1.1 Inorganic diphosphatase
  misc_feature: Useful for making plants with modulated water use efficiency
MGIFAVLIFLFLGSAAGSSTDSPPCHYGKGNTCKPALANAL

SEQ ID NO: 39492 - DNA, 710 bp, Panicum virgatum
  misc_feature: Ceres CLONE 1998516
  misc_feature: Encodes the peptide sequence at SEQ ID NO. 39493
gacaacaggcgctcgatatgttttgttctctcgaacctacaggcatctcaacgccggaatcttcggcaatggttccgacggccacacgctcccgtccgaggtgtcacgcgcggccatgctcgtccgcatcaacaccctgctccagggctactccggcatccgcttcgagatcctcgaggccctcaccaagctcatcaacaccggcgtcagcccgtgcctgccgctccggggcaccatcaccgcgtccggcgacctcgtcccgctgtcctacattgccggcctcatcaccggccgccccaacgcgcaggccgtcaccgccgacggcaggaaggtggacgccgccgaggcgttcaaggtcgccggcatcgaggggggcttcttcaagctcaaccccaaggagggtctcgccatcgtcaatggcacgtccgtcggctcggccctcgccgccatggtctgcttcgacgccaacgtcctcgccgtcctgtccgaggtgctgtccgccgtcttctgcgaggtcatgaacggcaagcccgagtacaccgaccacctcacccacaagctcaagcaccacccgggctccatcgaggccgccgccatcatggagcacatcctggacggcagctccttcatgaagcacgccaaggaggtgaacgccatggacccgctcctcaagcccaagcaggaccggtacgcgctccgcacgtcgccgc

SEQ ID NO: 39493 - protein, 236 aa, Panicum virgatum
  misc_feature: Ceres CLONE 1998516
  misc_feature (2)..(236): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature: Useful for making plants with altered cell wall content and/or composition
  misc_feature: Useful for making plants with altered lignin content
TTGARYVLFSRTYRHLNAGIFGNGSDGHTLPSEVSRAAMLVRINTLLQGYSGIRFEILEALTKLINTGVSPCLPLRGTITASGDLVPLSYIAGLITGRPNAQAVTADGRKVDAAEAFKVAGIEGGFFKLNPKEGLAIVNGTSVGSALAAMVCFDANVLAVLSEVLSAVFCEVMNGKPEYTDHLTHKLKHHPGSIEAAAIMEHILDGSSFMKHAKEVNAMDPLLKPKQDRYALRTSP

SEQ ID NO: 39494 - DNA, 1250 bp, Panicum virgatum
  misc_feature: Ceres CLONE 1998518
  misc_feature: Encodes the peptide sequence at SEQ ID NO. 39495
actcgttaacgctcacatttcccacgccacactgcgcctgcaactactccgtagtgccgtcccgtcccgtcccgtcccagccgcctcgctcctccggctccgtgcccccacctcgccccgccgccgccgcccggggaggcttccgcgaccaccctgctccgtccccgctgtgcgggccctgcggctcgcggcgagcattccgggctccgggtcgccggggcccgagggttgccgcgcggatctgagcccgccgggtcggaattcgggcgaatagctggcagcgggcgttgggtcgggttgggttggcgagtttaggcgggtttgcgcggtgggaggagtttgggggaggaagagttggtgaggtcgtcgctgggtacatgcgcatgcgccccggaggcctctgccaccgccgccgcgccgtcgtgaggaagcgatgatcgagcagttcgtcaacttcgtcatccggccgcctcgtgcagagtacaacccagaccagtatttatgggagacggagtttactcttgctggaaggaagtacaaaaggctagatttggagcttactaatgaaagaggtcagacattaaaatgcagccactatgttcctgctgtcataccggaagacactgcccttccgtgtgttatctactgtcatgggaatagtggatgcagggcagatgcaaatgaagccgctgtaatacttcttccgtcaaacatcaccctctttacgcttgactttgcgggatcagggctatcaagtggagagtatgtcagcctaggttggcatgagaagcaggatctcaaatgtgcggtgtcctttctacgtaataataagcaagtttcttgtataggcctttgggggcgctcaatgggtgctgttacaagcctgctgtatggagcagaagacccctcaattgctggcatggttttggacagtgctttctccaacttatatgacttaatgatggagcttgtagaagtttacaaaatacgagcccctaagttcacggttaagatggctgttcagtacatgcgacgcgtcattcagagaagagctaaatttgacataatggatcttaatgttgtccagtttgcaccaaagatgtttattcctgcattatttggacatgcatcgaatgatatgtttatccagccacatcacacagaacgtattcaccaggcatatgcgggggataaaaatttaatcaaatttgagggtgatcacaattccccaaggccctcaattttattta

SEQ ID NO: 39495 - protein, 272 aa, Panicum virgatum
  misc_feature: Ceres CLONE 1998518
  misc_feature: SWISSPROT Homolog: EC 3.1.1.23 Acylglycerol lipase
MIEQFVNFVIRPPRAEYNPDQYLWETEFTLAGRKYKRLDLELTNERGQTLKCSHYVPAVIPEDTALPCVIYCHGNSGCRADANEAAVILLPSNITLFTLDFAGSGLSSGEYVSLGWHEKQDLKCAVSFLRNNKQVSCIGLWGRSMGAVTSLLYGAEDPSIAGMVLDSAFSNLYDLMMELVEVYKIRAPKFTVKMAVQYMRRVIQRRAKFDIMDLNVVQFAPKMFIPALFGHASNDMFIQPHHTERIHQAYAGDKNLIKFEGDHNSPRPSILF

SEQ ID NO: 39496 - DNA, 1302 bp, Panicum virgatum
  misc_feature: Ceres CLONE 1998526
  misc_feature: Encodes the peptide sequence at SEQ ID NO. 39497
gccaattcttggcgccatcacccggtaacccgcgccatatatgcatccccctccgtacctcgtttcaccgcaggtaatccccactccatccaaaccctcccgcccgccgccgccgccgccgcaattctcccctccccgagatggagatggacgccggcactccgtcgaagaaggccaagacatcggcggctgcgggcgccacgccgcagaagccgtggaaggcctctccgaccgaccagatcctgacgccggagaagctgacgcagagggtcacggcggcggcgccggcggccgagcagatctggacgccggagaagcccgaggagaggccgagggtacgcggccgcagcgtggcgttctccgtaaaggaggtgcgccgggcggcgctcgagctgcggaggccggacaagggaacgccggcggcggccgaggaggcggacgagctcgagtccctcgagcgggagctcggtgttggcgccggggccggccaaagccccgtcaagcgcaaggccgaagtcaagctgccggaaagttatgagatgctttgtgagttcttcaactgcctggagagctccactcggctgctccgtatgaagggatccaagacctctttccccaacatctgcgctagcatccagcatctgtctgaacggaggtttacctacagccatcttgcgcagctcaagtacatcatgcccgaggcaattgtcatcaataagatccttttgcgtgatgacataacatgctgtatgaagccagatcttcaggtgaaccttgtggttggtgctgttgagagcgtcaagaagcaaaagggggaaactgcatactcagcattgagaaggatcttcaggcagaggctagtggatttcttcagggaccatcctgagggagatgacataccagagcatgaattgccacatccatttaatcgaacaagattaagcatgccccaggctgccccaagagttgttcctgaaccggcatccccaatcgaggcttctgatgtcaatggacaacaggctactatgatgtcacacatgtcacagtcattcaagagaaggttttcgcagaggtctccaatcagttctgcaacagctaatgcaaccagtcaattggcgaaggttgagtccgctgttctatcaccattgagcaggaattccttctccagtagctatgtttctgcttctaaagaagctcagccagaggaggatggcaaggctgttgtatccatgtctggagtttcagagggcacacctgctaaatatgcctctacaccagtgaggttaatggcgtccacaccag

SEQ ID NO: 39497 - protein, 387 aa, Panicum virgatum
  misc_feature: Ceres CLONE 1998526
  misc_feature (128)..(260): Pfam Name: CDT1 Pfam Description: DNA replication factor CDT1 like
MEMDAGTPSKKAKTSAAAGATPQKPWKASPTDQILTPEKLTQRVTAAAPAAEQIWTPEKPEERPRVRGRSVAFSVKEVRRAALELRRPDKGTPAAAEEADELESLERELGVGAGAGQSPVKRKAEVKLPESYEMLCEFFNCLESSTRLLRMKGSKTSFPNICASIQHLSERRFTYSHLAQLKYIMPEAIVINKILLRDDITCCMKPDLQVNLVVGAVESVKKQKGETAYSALRRIFRQRLVDFFRDHPEGDDIPEHELPHPFNRTRLSMPQAAPRVVPEPASPIEASDVNGQQATMMSHMSQSFKRRFSQRSPISSATANATSQLAKVESAVLSPLSRNSFSSSYVSASKEAQPEEDGKAVVSMSGVSEGTPAKYASTPVRLMASTP

SEQ ID NO: 39498 - DNA, 655 bp, Panicum virgatum
  misc_feature: Ceres CLONE 1998526-R
ctgctgttgatgatgatgatgaaattactcagttttcttccacaatccctccttcagtcggtaaagcagaaggaacagagggttatggaggagaagaaaactggttttgctgataaggttaaaaggcagaagttgattgcttccctgccaagtatgtttgatgttgtatttcttatctaccagtcaagacagctgtctgtaatgacaaagcaggagctgattcataagatagttgcaagcagtccaaagattgtggacaaaagtgaagtagaagagcagctgacattgttgaaagagcttgttcccgagtggatctctgagaagagtgcacggagtggagatgttctatgctgcgttgatgcaactttgagccaagcagatattcgccaaagactttatgctgctgagtaggaaggatatactaaatgccacaatcaccttgtttgggaacatgtacatatgccaacagtgtaaatcagaattcactcagccatgtgttacctgagatgtggtgcatgtgtcttctgcatctgatctaatagataccttgactatatgtaacggatgacatgtacagcaaaaccattctaacaactgattgtgaccattccctttttttcttcatgtgtatattccattgtctggaatatctctc

SEQ ID NO: 39499 - DNA, 1414 bp, Panicum virgatum
  misc_feature: Ceres CLONE 1998545
  misc_feature: Encodes the peptide sequence at SEQ ID NO. 39500
aaaaaatggtaaaaaaggtcaaacggctaatcccccaatgcaatctcccaatttttttaaggacttcgatctcctgcagctcttttttttacctcacgctgttcttgtttatagtccagttgtacccgatgtctccagcttacctccatccatatcttgatgctgggcgatgtttcttttggaagcaattgggcaccgctcggcagccaaatttttcttgacattttctgtctagtttttttgcaattttttttcttttagattgcaccaataggttcaagcaaacctttgatctgatacctttgcaaatagcctgacactctcttggttttaaaagaccttttggatcgatataggcgcaccagctccgatcttattgttgctttccatatcgcttaggattcaagaaaccccgaatctgtgcttggagcatccctcacccagattcagcatggagagattcggcaaaacccggtgaggaatccgagctctaccgcgcaatctccctaccggccattggagatctcgcgcgggagcacgagcgaccaagaaaatgtcgccgcagccgccccccgacctcaccgaggacaaggagagggagacaaatgtcctcatcgaggcggccccggggtcgccggcgaaggcggcggaggacgacggcgccggcaggcagctgtcgccggccgcgtggctccggatgctagccagggagctgcactggagcttcgtgctcggcgtggtggccacgtacggcgtcagccaggggctcggtggcggcatcagccgcgtcgcgtccgactactactggaaggacgtgcagcgggtgcagccgtcggtggcgcaggtgtaccagggcatcacgtccataccctggatgatcaagccgctctggggactgctcaccgacgtgctccccgtcgccggataccggcgccggccgtacttcattcttgcaggcttcgtcggagttattgcaatgcttataatctctctccacagcaagcttcatgcactgttcgccttgttggcattgatggccggaagtgctagtgtggcaatagctgatgttactatagatgcttgtgtggcggaaaacagtatactgtaccctcatcttgctgctgacatgataagcttaaatggattctgttcatctgttggaggtcttattggattctcaataagtggttttcttgttcatgcgataggggctcaaggtgccctcggcctgttaactataacctccgccttggtcattttatctggaatgctgctaaaggagatccatacccccaactttccatacgggcaggctcataagaagtttgtagaagcaagtggaaaaatgttaacgaccttaaaatgtcctgaagtatggcggccatgtgtatacatgtatgtgtcacttgctttg

SEQ ID NO: 39500 - protein, 286 aa, Panicum virgatum
  misc_feature: Ceres CLONE 1998545
  misc_feature (70)..(286): Pfam Name: BT1 Pfam Description: BT1 family
MSPQPPPDLTEDKERETNVLIEAAPGSPAKAAEDDGAGRQLSPAAWLRMLARELHWSFVLGVVATYGVSQGLGGGISRVASDYYWKDVQRVQPSVAQVYQGITSIPWMIKPLWGLLTDVLPVAGYRRRPYFILAGFVGVIAMLIISLHSKLHALFALLALMAGSASVAIADVTIDACVAENSILYPHLAADMISLNGFCSSVGGLIGFSISGFLVHAIGAQGALGLLTITSALVILSGMLLKEIHTPNFPYGQAHKKFVEASGKMLTTLKCPEVWRPCVYMYVSLA

SEQ ID NO: 39501 - DNA, 701 bp, Panicum virgatum
  misc_feature: Ceres CLONE 1998545-R
cccactggcattgagggcacattctacgcgttgcttatgtccattgacaatattggcggattgactggacaatgggttggtggactgctccttcatttgttgagaatcacaagaacagaattcaacaacctctgggctgctatcatgattcgaaatgtgatgaggctgctaccgctggcgctgttattcttggtgccaagtagcgatccgaactccactcttcttccatctgatttgctgaatgaggatgacggtgaaggtcaccgaatggagaatattgagttaacctcgcttgctgtggacaggggctctttacctgacaaatctccccaagaatgcgggaagaaccgggaagtccatgatgtagagcaggatgatgatggagtttcactgcttgccaacaggggttgatactggatgcatacgaagaattttttttctacacgagcaaatagttgaaatttagaaaaaaaatgtagacatttcatcaaaggcattcattagatatcctccatgttgttaaattcattcatttacagtagggtagcgaagtcttgagagacatataccacagacactttggagttttgttctccagttctccgaacttccacatgttacagcatttgaaccaagttttaccaagtgtaaaaattctgtcatccgcgcaagtttaaatttgctgtgacagtttagctgcg

SEQ ID NO: 39502 - DNA, 1288 bp, Panicum virgatum
  misc_feature: Ceres CLONE 1998550
  misc_feature: Encodes the peptide sequence at SEQ ID NO. 39503
attcctccccacccagcccggccgcgcgcccgccccgatcctcgctacccaccaccgcgcatgccagcgccgccgccgatcagcaggcgccaccaccccctcctcctccggcggcggatcagcagtagcttcgactctgagctgttcctgctcctgcggtgactctcgctagttctttctttccctcttcatccgtcgaggtgcgagggaaggaagcttgttgccggcttgaggagggttcgtcggagaccggaaggaaggtcgagcgtcgagcagctaatgcctcccaacgcccaggacgcgcacggaagcaccggtctcgccgtgacggcggcagcggcgaacaagatggactgcttcctgaccaccgcctgcacgccgctcaacctccaggtaggcagtaggcacctgcttccattccaccgccgccgccgcctaggacgacggcggcggcggcggcggctgctctctgctactagctgcttggttcgacttcgaactgagatgttgagctgttgacggtgtcgggtgcagttcatcgacgtgtcgtaccgcgtgaagcagacggagcggtcggcggcggcgaaggcggcgccgcccggccggatatcctcgcactccggcgccggcggcggcgcagcggcggaggagcggacgatcctcaggggcgtcacgggcgaggcgcggccgggggaggtgctcgcggtgctgggcccgtcggggagcggcaagtcgacgctgctctccatcctcggcggccgcctcgcggggcgccacgccgggacggtcctcgccggcgggcggccgccgtgctgcggcgtgcggcggcgcacggggttcgtggcgcaggacgacgtgctccacccgcacctcaccgtgcgggagacgctcgtcttctgcgccatgctgcggctgccccgcgcggcgccagcggcggccaaggccgccgccgccgaggccgtgatcgccgagctggggctcgctgcgtgcgccgacaccgtcgtgggcaacgcgttcgtgcgcggtgtgtccggcggcgagcggaagcgcgtcagcatcgggcacgagatgctcgtcaacccgagcctgctcatcctcgacgagcccacgtcggggctcgactccaccgccgccgcgcgcctcgtcgccacgctctcggcgctggccaggaagggccgcaccgtcgtcatgtccgtgcaccaaccgtcgtcccgggtctaccgcatgttcgactccgtcctgctgctcgccgagggcagctgcctctactttggcgccggccgcgacg

SEQ ID NO: 39503 - protein, 128 aa, Panicum virgatum
  misc_feature: Ceres CLONE 1998550
  misc_feature (1)..(118): Pfam Name: ABC_tran Pfam Description: ABC transporter
  misc_feature: SWISSPROT Homolog: EC 3.6.3.29 Molybdate-transporting ATPase
MLRLPRAAPAAAKAAAAEAVIAELGLAACADTVVGNAFVRGVSGGERKRVSIGHEMLVNPSLLILDEPTSGLDSTAAARLVATLSALARKGRTVVMSVHQPSSRVYRMFDSVLLLAEGSCLYFGAGRD

SEQ ID NO: 39504 - DNA, 646 bp, Panicum virgatum
  misc_feature: Ceres CLONE 1998550-R
atcatgctcgccttcctcctcaccggcgggttctacgtgcgcaacgtgccgggcttcatggcgtgggccaagtacacctccttcaccctactactgctaccgcctgctcatcgccgtgcagtacggcggccacctgcgccgcctcctcccgccggaggacgtcgacggcgaggccggcatcggcgcatgcgtcgccgcgctcgtcgccatgttcttcgggtaccggttgctggcgtacctcgcgctgcgccgcgtcaggaagtgatctggccaccgccggcgctgtaggttgctagctaggtacgtgtccattagcgattccgaccggccggccggcccgacacgatgaccaaaggctccggctggccggagcgcgcggcggcgaactgagatccgccgcgccggcggacggggcgggcgtcggggagatgaaccgaccagatgacgcggttgttgttggcgtcgccggcgaccgacgaggccgtcttcttcctcttgggatttcttgtttttttcctcctacctaaaatttggcggtctccgcgccatcgatcgatcgagatgccttcttgaaagcaagtgtactatatattgatcaatcactgggtgtaagttgtgagagctgaattgagcttcttggtctgat

SEQ ID NO: 39505 - DNA, 1251 bp, Panicum virgatum
  misc_feature: Ceres CLONE 1998562
  misc_feature: Encodes the peptide sequence at SEQ ID NO. 39506
ccccacctcctctgtctctgttctgtcctgtcctccaccctcctcctcctcgtcgtcctccgcctccgccatagtggcgagcacgccacccgccccgccccccaatcattcgcctgcccaccccaacctctccctcggcgccgtttagccggaggcttcgcctggctttcgcggccccataacgccagccagggcgcgcgctaacggcagcagcgacagcaacccgctggcttagctagtcttccccacgattcgacgccgccaccgcccccggcccagcacaccttttcttctcttgtgaagcaaaaaccaccaaagactagcccaacaaaatctaggggtactatggctgtttcaatgagggaggtggattctgtttttcaaggcgtgggtcaaaaaaatggattggaaatctggcgtattgaaaagttacaggctgttcctgtccccaaggactcatatgggaagtttttcacaggcgattcatacataatactgaagacaactgcccttaaaaatggttcttttcggcacgatatacattattggcttggtaaagataccagtcaggatgaggctggtacagctgcaatcaagactgttgaactggatgctgctcttggtggacgcgctgtacaataccgtgaagtacagggaaatgagactgagaaatttctttcgtattttaaaccttgtattatacccgaggaaggaggggttgcatctggtttcaggcatactgaagtcaatgagcgggagctcaacacacgattatttgtctgcagaggaaagcatacagttcatgttaaagaggttccttttgcacgatcatcactcaaccatgatgacatatttattttagatacaaaatctaagatattccaatttaatggatcaaattcaagtattcaggagagggctaaagcccttgaagttgtgcaatatcttaaagatacgaaccatgatggtaaatgcgaagtagcagcagttgaggatggaaaattgatggcagacgttgatgctggtgaattctgggctctctttggtggatttgctcctttgccaagaaagccattttctgaacttaacggcaaagattcagcttccacttcaaaattgctttgtgtcaataaaggccaagcaccaccaattaattgtgaaattctgacaagagaagctactagatttcaaccaaatgttacctgctagaacggtggttctgaaatttagtgcctggatgggtagagaaaa

SEQ ID NO: 39506 - protein, 287 aa, Panicum virgatum
  misc_feature: Ceres CLONE 1998562
  misc_feature (28)..(111): Pfam Name: Gelsolin Pfam Description: Gelsolin repeat
  misc_feature (150)..(221): Pfam Name: Gelsolin Pfam Description: Gelsolin repeat
MAVSMREVDSVFQGVGQKNGLEIWRIEKLQAVPVPKDSYGKFFTGDSYIILKTTALKNGSFRHDIHYWLGKDTSQDEAGTAAIKTVELDAALGGRAVQYREVQGNETEKFLSYFKPCIIPEEGGVASGFRHTEVNERELNTRLFVCRGKHTVHVKEVPFARSSLNHDDIFILDTKSKIFQFNGSNSSIQERAKALEVVQYLKDTNHDGKCEVAAVEDGKLMADVDAGEFWALFGGFAPLPRKPFSELNGKDSASTSKLLCVNKGQAPPINCEILTREATRFQPNVTC

SEQ ID NO: 39507 - DNA, 637 bp, Panicum virgatum
  misc_feature: Ceres CLONE 1998569
  misc_feature: Encodes the peptide sequence at SEQ ID NO. 39508
aaccccatccctctcgccactctccctaggctgagggctcctccccttctctctctctccccctaccgtctcctgcgatcccatcgcctcgccgccgccgccgccgccgccgccatggcgttcctcgcgagggcgctccgccagtcgaactcgcgcctgtcgtcgcgctgccccgccgtggccgcgtcctgccgctggatctccccgaccgctgccgcgggatcgccggaggccggcgcggcggtggcgctggccgacccggagccgccgccgccgcgggagcccgtggggggcgctcgggtggagctcccgcccaacccggaggacgcgctcgaggtgttcgtggacgggcacgcggtgcggatccccaaggggttcaccgtgctccaggcctgcgaggtcgccggcgtcgacataccgcgcttctgctaccacagccgactctccatcgccgggaactgccgcatgtgcctcgtcgaggtcgagaaatcgcccaagcccgtcgcctcctgcgccatgcccgcgctcccagggatgaagattaagacaaacactccagtggcgaagaaggcaagggagggtgtcatggagttcctgctgatgaaccatccacttgactgcccaatctgcgatcagg

SEQ ID NO: 39508 - protein, 174 aa, Panicum virgatum
  misc_feature: Ceres CLONE 1998569
  misc_feature (75)..(139): Pfam Name: Fer2 Pfam Description: 2Fe-2S iron-sulfur cluster binding domain
  misc_feature: SWISSPROT Homolog: EC 1.6.99.5 NADH dehydrogenase (quinone)
MAFLARALRQSNSRLSSRCPAVAASCRWISPTAAAGSPEAGAAVALADPEPPPPREPVGGARVELPPNPEDALEVFVDGHAVRIPKGFTVLQACEVAGVDIPRFCYHSRLSIAGNCRMCLVEVEKSPKPVASCAMPALPGMKIKTNTPVAKKAREGVMEFLLMNHPLDCPICDQ

SEQ ID NO: 39509 - DNA, 1677 bp, Panicum virgatum
  misc_feature: Ceres CLONE 1998574
  misc_feature: Encodes the peptide sequence at SEQ ID NO. 39510
aactaactagatcgcacggtcgagctggcgcagaatcgcacgccgcctgctcacgagctccatctcttccttccgcctctccgttgtacgggttcgacgacatggcagccccgctccggcggcgcctcctctccatcggccgcgcactcctcacaccggagccggcgcggatgctctcctccgggaactcggacgcccttgtcgagatcaagcccggagagatctggatggtctccggcatccccgaggagcaccggcgccgcagggttgtaatttattcaccagctaggaatgcatcccagcaaggttcaggcaaagttgggaagtggaaaatcgactttatgtcaacacaaaagtgggagaacccattaatgggatggacatctactggggatccatatgctaatgttggtgaagcagaacttgcatttgatagcgcagaatcagcaaaagcgtttgctcgaaaaacacggatggaactatgtggtgtgtcttcttttttccctttttaacagggagctgacaattgagttagcaaattaaatgctcaatttgtcactgcctagaccattcggtaaatggtaatattggagttctttaatcacacaatcttctgaaattttacgtgagggctgctatcttgcatccattttgctttgctgctttccatgttgtcaacaacagtgaaattttacatgaggactgctatctcctttcatgctgtgaagttagacatctgcagtccacattcttgagtaaaacttactgttgagttcgtaaacgtcatacacctcttttaaaggtctgtattttccctacatgacatttcatggtgtatatattttcttcaactcataagatacagtatacttattggaagtagttaacatcaaatgtcaaggaagaattatgaagtaaaaagtgctcctcaagagagtagacttcagtaaaagagcttatgttcaatgttagtttcgatgaaaatgtgactcccctgtttgcttctgatgtggtgggaccaatttcagttgctgatcgtatttcacccaagtcttatgcagaaaacttcaagtggagagggcccccgaagacggagcaagcatgagctcttgcctccgcccacgctgcgaatatgatatgtcccccttctgcctttgcttccatcggtatctgttgtgaaagcatcatccgtcaaactggtaataagcattcgtgccgatcatacgaggtgccacaatgacgtccttttcttgcaccgaaatttgaatttggtaatctctataagtagtgatcttcgatattgtgtttgtaattataggtctgattgtgcgtgtgtagttacggattgtggtgtaagttcatacatatatgaacagccgttacagtctgtactggtatagtatgtgatgccttaaataatgtcgaagctgcaattaggcagaatacatgtagtacaagagcgtgttttgtaggtgttagaaaacgcggtgatcaagttgaactgaccatggggcagttcatccccggcatccagaccggttggctggttgggcaacggacacatctggtcgtggaggcatccattcgtggaacggcttccactaacggacatgtccctatgtaacattcctataaatttctttaaagcttatagaaactcacataaaggatgctcag

SEQ ID NO: 39510 - protein, 136 aa, Panicum virgatum
  misc_feature: Ceres CLONE 1998574
  misc_feature (54)..(127): Pfam Name: ETC_C1_NDUFA4 Pfam Description: ETC complex I subunit conserved region
MAAPLRRRLLSIGRALLTPEPARMLSSGNSDALVEIKPGEIWMVSGIPEEHRRRRVVIYSPARNASQQGSGKVGKWKIDFMSTQKWENPLMGWTSTGDPYANVGEAELAFDSAESAKAFARKTRMELCGVSSFFPF

SEQ ID NO: 39511 - DNA, 697 bp, Panicum virgatum
  misc_feature: Ceres CLONE 1998576
  misc_feature: Encodes the peptide sequence at SEQ ID NO. 39512
actgatcccgcaaccaaacacacggttcctctcctgttcgagctccgcgcagccagaaacccatggcggacacgccctcgtcctcgtcggcgccggcgcccccggtggtagacgcagcctccgtggcggaggcggcgccaccggaggagataactctggtggtgaagtggcgcgggcaggagcagacggtgcggatggtcggggacgacacgctcggggagctcaagctccgcatctgcgaggccacgggggtgctccccaagcgccagacgctgctctaccccaagctcatgctcaaggacatcgacgactccaccctcctctcctccatccccttcaagcccaacggcaagatcagcatggtcggtactgttgaagaagaaatatttgtcggccaagaagatgatccggagttacttgatgattttgacttcgagcagaatgaagatacacccattaaggataaagatgtctacaagcaaaaattaaagcggcgtgcaagtcagtataagatcaagctcttgaatccatgccgccaaggaaagaagctgcttgtcttggacattgactatactctgtttgaccataagtcgccagctgagaatcctaaggaactcatgcgtccatatcttcaccagttcccttgcgcagcatatacaaaatatgacatcatgatatggtcagcaactagtatgaa

SEQ ID NO: 39512 - protein, 211 aa, Panicum virgatum
  misc_feature: Ceres CLONE 1998576
  misc_feature: SWISSPROT Homolog: EC 3.1.3.16 Phosphoprotein phosphatase
MADTPSSSSAPAPPVVDAASVAEAAPPEEITLVVKWRGQEQTVRMVGDDTLGELKLRICEATGVLPKRQTLLYPKLMLKDIDDSTLLSSIPFKPNGKISMVGTVEEEIFVGQEDDPELLDDFDFEQNEDTPIKDKDVYKQKLKRRASQYKIKLLNPCRQGKKLLVLDIDYTLFDHKSPAENPKELMRPYLHQFPCAAYTKYDIMIWSATSM

SEQ ID NO: 39513 - DNA, 681 bp, Panicum virgatum
  misc_feature: Ceres CLONE 1998590
  misc_feature: Encodes the peptide sequence at SEQ ID NO. 39514
agcagtgctgtgcagccgcatccgcccgcctcgcccgcagcgagcgcatcagggcggagccgcaggggcagggggccgaggctggcggcgctccaccaagtaaagcaaaggaggaatccccagcccatccattgtttgtgagtttgttattgctttgctgccgctcaaacctagaactcaattattgtcgtagatcgatcgatccatccatccatcgactagattgatatatagatagatgctccgccgcgattgcatggcgctgccgccgtgctcccgcatcccgccgtcctgaccccaaccacgtcccctgtgggaaggcgagcgaaaacctcagccgaaccaaccaccagagcaacaggatggccgacagcggcgggctcagcgccaacatcgccgccgccgccgcccacgacgacgacgacaccaacgccgcacctttccccggcaccgtccagatcggaggatccccggagtacaaggtcgacaggaagctgggcaaaggtggctttggccatgtctttcttggccgacgcctaactgcggcatgctcctcggcttccgctgcccaagaggttgctatcaaatttgagcacactaccagcaagggctgtagctacggccctccgtatgaatggcaagtctacaccgctctaagcggaacgcatggcgtgccccagg

SEQ ID NO: 39514 - protein, 106 aa, Panicum virgatum
  misc_feature: Ceres CLONE 1998590
  misc_feature: SWISSPROT Homolog: EC 2.7.11.1 Non-specific serine/threonine protein kinase
MADSGGLSANIAAAAAHDDDDTNAAPFPGTVQIGGSPEYKVDRKLGKGGFGHVFLGRRLTAACSSASAAQEVAIKFEHTTSKGCSYGPPYEWQVYTALSGTHGVPQ

SEQ ID NO: 39515 - DNA, 652 bp, Panicum virgatum
  misc_feature: Ceres CLONE 1998594
  misc_feature: Encodes the peptide sequence at SEQ ID NO. 39516
agcagtctctctttcttgggcggtgggagctggggaacagctcgactcgtcggcaagcaccgagagagagagggctgaccgcggcggcgaaagaaaggtagcttttggctagcttgccatggcggccacgtcgccgctgccgcggtgggcgccgacgccgagcccgtcgcggccgctctggcgctggggcggcggcacgcccgacgctgcggcccgggcggccgctggccgcggcggcggctggtcgctcggcagcgtcttcgcgtgggctacgggcggcagccggcaccgtggtgccggcgcggcatcgaacggatcggcggcaggagcgctagcaccgcccggcgacggcggcggcggcgtcgtctgcgtccccggctcggggtgtgagctgatgccgccggcgtcgccgtcggcggctggcggcgacgccgaccccacggtgttcctgacgtgggaggacgtgcgggtgacggtggcgggcggcgcccacggcgcgccgccggtggagatcctggacggggtgagcggacacgcgcggcccggggaggtgctggccatcatgggcccgtccgggtgcggcaagaccacgctcctcgacacccttgcaggaagattaggaccaggcatgaataaaacagggctgatttta

SEQ ID NO: 39516 - protein, 177 aa, Panicum virgatum
  misc_feature: Ceres CLONE 1998594
  misc_feature: SWISSPROT Homolog: EC 3.6.3.36 Taurine-transporting ATPase
MAATSPLPRWAPTPSPSRPLWRWGGGTPDAAARAAAGRGGGWSLGSVFAWATGGSRHRGAGAASNGSAAGALAPPGDGGGGVVCVPGSGCELMPPASPSAAGGDADPTVFLTWEDVRVTVAGGAHGAPPVEILDGVSGHARPGEVLAIMGPSGCGKTTLLDTLAGRLGPGMNKTGLI

SEQ ID NO: 39517 - DNA, 723 bp, Panicum virgatum
  misc_feature: Ceres CLONE 1998596
  misc_feature: Encodes the peptide sequence at SEQ ID NO. 39518
accagcagcagcgccaaccacagaaatctacttataattcaagcccctcgaccaccttcctcctcttacttcccctccccagctagctgctgcttcccttcccttgcaatccgctcgatcccctgcatcgccacccaagaacagcgtacggcaacgacgacctgctagccggagccagagctagctagctagctgcttaattcttcctcagagtgaaattttcctgaagattcctgcgctgcatgttgaattccacaagactaccagaacacgtgaggatatgagttggtgttgtattcctagaaccaagaaacaagagaatccttactccaacagcataggcggtatttattctgagaagaacataaggctcttctcctatgctgagttaagatctgccacagacaacttcaaccgcacaaacaaagtaggtagaggtggctttgggacagtttataagggaaccattcgaaatgggcgagaggttgcggtaaaagttctttctgctgaatccaggcagggcattagagaattcttgacagaaattgatgtcattagcaacgtgaagcatcccaaccttgttgaattaattggctgttgtgttgatggaaataaccgaattttggtgtatgaatatcttaagaacagcagtcttgaccgtgcactgttgggttctaacagtgagcctgctgactttacttggagcataagatctgctatatg

SEQ ID NO: 39518 - protein, 147 aa, Panicum virgatum
  misc_feature: Ceres CLONE 1998596
  misc_feature (44)..(147): Pfam Name: Pkinase_Tyr Pfam Description: Protein tyrosine kinase
  misc_feature: SWISSPROT Homolog: EC 2.7.11.1 Non-specific serine/threonine protein kinase
MSWCCIPRTKKQENPYSNSIGGIYSEKNIRLFSYAELRSATDNFNRTNKVGRGGFGTVYKGTIRNGREVAVKVLSAESRQGIREFLTEIDVISNVKHPNLVELIGCCVDGNNRILVYEYLKNSSLDRALLGSNSEPADFTWSIRSAI

SEQ ID NO: 39519 - DNA, 692 bp, Panicum virgatum
  misc_feature: Ceres CLONE 1998598
  misc_feature: Encodes the peptide sequence at SEQ ID NO. 39520
ctctctctctctctctcctctacccccttttcctctaacctttagctttcctccctccctccttcggtccttccctctcctctcctctcctcttccattcctctaactagtcctagccattcagatcctaagttgctggccttgctgcttcttgttggagaaagatttgttggttccaagttggaagtatcatgagtccaccgagtgtgatggggcaatttggagacacaacctataccaaggttttcgttgggggactcgcatgggaaacccagaaggagaccatgaggaagtacttcgagcagtttggggagatcctggaggccgttgtcatcacagacaagaataccggcagatccaagggctacggatttgttaccttccgggacccggatgcggcgatgagagcttgtgttgatcctgcgccggtgatagacgggaggagggctaactgtaatctggcttcacttggggttcaaagatctaggcctccaacaccccagcatggaggagctaggagcttcagggtgatgaaatccttcagccagcaggcagggatccaaggtggactgggcgcagcttttccttcccatgccacctttcctcattataccatcccacaaggcctcccctaccatgtctatgggtactctccctatactccagactatggctatccaacaaacttctac

SEQ ID NO: 39520 - protein, 160 aa, Panicum virgatum
  misc_feature: Ceres CLONE 1998598
  misc_feature (12)..(82): Pfam Name: RRM_1 Pfam Description: RNA recognition motif. (a.k.a. RRM, RBD, or RNP domain)
  misc_feature: Useful for making plants with modulated biomass
MGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGARSFRVMKSFSQQAGIQGGLGAAFPSHATFPHYTIPQGLPYHVYGYSPYTPDYGYPTNF

SEQ ID NO: 39521 - DNA, 1313 bp, Panicum virgatum
  misc_feature: Ceres CLONE 1998607
  misc_feature: Encodes the peptide sequence at SEQ ID NO. 39522
aagtcgcaacgcgcaatccctcctccctcgccctcatctcgtcatctccctaaccctccaaaccctagagacgcgccgccgccgccgccgccgcggcaccaccgacacccggagcgagatgaggccgcgcggcaggggcgacgacgtcgacgatgacgacgacgaggacgagtacgaggacatcacgccgccgcggagtacgccggagcccgaggccgaccccgcccccgcgcccgcgccctcgccttcgccttcgcccgcccccgcccccgcgccgccgcagcctgcgcgggccccgcttagcagcctcgttgtcaagccgccttcgccgcaagagaacggcggtgggtcgtccccaccctctcccgccgcccgcgcggcccgctcgccctcgcccgggggcggcggtagctaccgcgcccgcggggcctcgcccccgcggcaccggcgggagttctcgccgccgcgaccccgaggctgggagcggcgccggtctccgccgccgccgccggagaggcggcgtcctgggagcccccctccccagcgccgccgcttcagccccccgccccggttccagcctccgcggcacccgcgcttccacaacgagcaaccaggatatggaatgcatggaggcccttcgccaccacgcccacgcagaccagaagccaggaaatttgatgatgctgttggcccacgttacacccatggttatcaagggggtggtagaggaagtgcgaggttccgagagggttctccgccatacggaagaggcagatcttacgggagaggctttggtgctcctcctggaaaagatttcattaatattgatggagaatatgttcacaggaatgatccaaatttgtcaccaagagaaggtgattggatatgccagaatccaaattgtggaaatctcaattttgctcggcgcacacactgtaacaactgcaataagttccgctattcagcacgtgaagcatatgaacctaggcgcagccctccaaggggttgcccaagtcctccacgagggcctcctaggatggttggtccacccggtgatcgagcccccccaagagagatgtccaggtacatatcaccacctcaaggctggggtgcaggtgatccttggggatatgccactcgatcccctccagaacgcccagtacggttcacagatccatcacctaaggaaagaatgggcttccgtggtgagcgtgacctgagggaccgtgcaaagtttgagtggtctgcccacgtatgattacggtcggagggagcgcccccgtggatggttatcttgacacaaagcggcttca

SEQ ID NO: 39522 - protein, 379 aa, Panicum virgatum
  misc_feature: Ceres CLONE 1998607
  misc_feature (251)..(282): Pfam Name: zf-RanBP Pfam Description: Zn-finger in Ran binding protein and others
MRPRGRGDDVDDDDDEDEYEDITPPRSTPEPEADPAPAPAPSPSPSPAPAPAPPQPARAPLSSLVVKPPSPQENGGGSSPPSPAARAARSPSPGGGGSYRARGASPPRHRREFSPPRPRGWERRRSPPPPPERRRPGSPPPQRRRFSPPPRFQPPRHPRFHNEQPGYGMHGGPSPPRPRRPEARKFDDAVGPRYTHGYQGGGRGSARFREGSPPYGRGRSYGRGFGAPPGKDFINIDGEYVHRNDPNLSPREGDWICQNPNCGNLNFARRTHCNNCNKFRYSAREAYEPRRSPPRGCPSPPRGPPRMVGPPGDRAPPREMSRYISPPQGWGAGDPWGYATRSPPERPVRFTDPSPKERMGFRGERDLRDRAKFEWSAHV

SEQ ID NO: 39523 - DNA, 750 bp, Panicum virgatum
  misc_feature: Ceres CLONE 1998620
  misc_feature: Encodes the peptide sequence at SEQ ID NO. 39524
tttacatcggaggattggagcattgaacccagtctgtttttccctaggcaatacttttcaagcactgacgactttgaagatattatctatccccaaggagatcctgatgctgtttccattagcaaaagagatgttgagctccttcttcctgaaacctttgtcaacgatacaataattgacttttatatcaaatacttgaccacaagaattgaatctaccgagaagtgcaggttccacttctttaatagcttcttttttcgcaagctggcggatcttgacaaagatcaggggagagctccagaaggtagagcagccttcttacgtgttcgcaaatggacccgcaaaataaatgtatttgagaaggattttctgtttattccagtcaacttcaacttgcattggagcttaattgttatttgctatcctggagaagtggcgacatttaaagatgtagatacgaagctctcagctaaagttccatgtattttacacatggattcacttaaaggaagtcatactggactcaaggacatcattcaaagttatttatgggaagagtggaaggaaaggcaccctgaatcagcatcagataattcggacaaattcttgaacttgagatttgtttcccttgagctccctcaacaggattattcatttgattgcggcttgttcttgctccattatgtggaactattttttgatggatgctccaagggaacttcaacccactgaagattgatgttttttctg

SEQ ID NO: 39524 - protein, 243 aa, Panicum virgatum
  misc_feature: Ceres CLONE 1998620
  misc_feature (52)..(242): Pfam Name: Peptidase_C48 Pfam Description: Ulp1 protease family, C-terminal catalytic domain
FTSEDWSIEPSLFFPRQYFSSTDDFEDIIYPQGDPDAVSISKRDVELLLPETFVNDTIIDFYIKYLTTRIESTEKCRFHFFNSFFFRKLADLDKDQGRAPEGRAAFLRVRKWTRKINVFEKDFLFIPVNFNLHWSLIVICYPGEVATFKDVDTKLSAKVPCILHMDSLKGSHTGLKDIIQSYLWEEWKERHPESASDNSDKFLNLRFVSLELPQQDYSFDCGLFLLHYVELFFDGCSKGTSTH

SEQ ID NO: 39525 - DNA, 1272 bp, Panicum virgatum
  misc_feature: Ceres CLONE 1998644
  misc_feature: Encodes the peptide sequence at SEQ ID NO. 39526
ctctttcccatcccatcccttgcgctcactcagtgtgctgcggcggcggcgactgtggttggggatccttccgcgcctccaaatcgctgctgcctgcgggttctcttcatatcctaacagtcgagctcaatggcaaaagaacaggatggatcccccaagccccgccacccagaattccaaaggatgcgtgtaacactcaccataggcgtcattgggctctgtgtcacatcatacattcttggggcttggcaaggcacctccaacagcatcaagccatccttcataagcactaaaactcggtgcgataatatggtgcgatcctctggtactcgcctggatttccaagcccaccaccaggtcagcttcaatgaatcgtcgcgtgcgccagagaaattcccaccttgccagctcaagtacagcgagtataccccctgccaagacccgaggaaggcaaggaagttcccaaagaatatgatgcagtacagggagaggcactgccctaagaaagaggacatgctccgctgcttgattcctgcacctccaggctataagaatcccttcgagtggccgaaaagtcgggactatgcttggtacaataacattcctcatcgggaactcagtattgaaaaggcagttcagaattggattcaagttgagggagacctgcttagattccctggaggtggcaccatgtttccacatggtgctgatgcttatattgacaacataaatgctcttataccattgaatgatggcaacatccgaactgcacttgatactggatgtggtgttgcaagttggggtgcctatcttatgaagaggaacatcatcaccatgtcatttgcaccaagggattcacacgaggcacaggtgcagtttgcattggagcgtggggtgccagccatgattggagtgatggggactgagagaatcccatatcccgctagagcgtttgacatggcgcactgctctagatgtttgatcccatggaataagcttgacggtatctatctgattgaagtagacagagttcttagaccagggggctactggatcctctctgggcctccaatccattggaaaaggcattttaaggggtgggagaggacagaagaagacctgaagcaagagcaagatgagattgaggacttagcgaaacgtctctgctggaagaaggttgtagagaaaggtgatcttgctatatggcagaaacctatcaaccatattgaatgtgttgatagtaggaaggtctatgacgctcctcagatttgt

SEQ ID NO: 39526 - protein, 380 aa, Panicum virgatum
  misc_feature: Ceres CLONE 1998644
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 758 in the 10/412,699 US patent application
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: Useful for making plants with altered cell wall content and/or composition
  misc_feature: The sequence is a functional homolog of SEQ ID NO 1593 in the 11/479,226 US patent application
  misc_feature: The sequence is a functional homolog of SEQ ID NO 560 in the 10/412,699 US patent application
MAKEQDGSPKPRHPEFQRMRVTLTIGVIGLCVTSYILGAWQGTSNSIKPSFISTKTRCDNMVRSSGTRLDFQAHHQVSFNESSRAPEKFPPCQLKYSEYTPCQDPRKARKFPKNMMQYRERHCPKKEDMLRCLIPAPPGYKNPFEWPKSRDYAWYNNIPHRELSIEKAVQNWIQVEGDLLRFPGGGTMFPHGADAYIDNINALIPLNDGNIRTALDTGCGVASWGAYLMKRNIITMSFAPRDSHEAQVQFALERGVPAMIGVMGTERIPYPARAFDMAHCSRCLIPWNKLDGIYLIEVDRVLRPGGYWILSGPPIHWKRHFKGWERTEEDLKQEQDEIEDLAKRLCWKKVVEKGDLAIWQKPINHIECVDSRKVYDAPQI

SEQ ID NO: 39527 - DNA, 1348 bp, Panicum virgatum
  misc_feature: Ceres CLONE 1998661
  misc_feature: Encodes the peptide sequence at SEQ ID NO. 39528
attcccccttctcgtcttctcgcttcgtccgctcctcccctcaccgtccccctcccaaaacccaaaaccctagccgccgccgccgccgccgctgcggcagcagaagcaagcgcagcagccatgtacgccgccctccgccgcgcggcgcctctccggcgccgcgccgtgtccgcgctcgccgccgcgctgctccagcagcagccggcggcgatgggggcggtggccccgcggctgccggcgcccgccgcggccacggcggcgtggttccactcgtccccggcgtggctggggttccgggagacggggcccgcgggcgccgcggcgcggccggagttcgcggcggccgaggagggttcgttctacgaggaggagatgagggctgccggcgccggtgccgcggcggacggggggctggagattgccaagctggggatctcgtccaagatcgtcgataggctcgccaagaagggcatcaccaagctgttccccatccagagagctgttcttgagccagcaatgcaaggaaaggacatggttggtcgtgccaaaactgggactggtaaaactttggcgtttggaatccccataatggatgcaattatccgccacaatgacaaatacaagcctggaaagtttcccttggctattgttttggcaccaacaagagaacttgcaaaacaggttgagagggagttcctcgattcctcccccctggaaactctctgtgtttatggaggaactccaattggtcagcaaataaagcagcttaattatggtgttgatgtggtcatcgggacacctggacgggtgattgatcttctaaaaagaggcgctcttagtttggcagagattcggtttgttgttcttgatgaagcagaccagatgttgtcggtgggttttgatcaagatgttgagacaattttgcagcaggtgcctcagcagcgtcaaacattgatgttctcagcaacaatgccaacctggatacggaagctaacacaaaagtacctcaacaatcctgttacagttgacctagttggtgagaatgatcaaaagctggctgaaggaattagtctgttttctatcgcttcggagaaccgtgaaaaacctgctgtacttggagaacttattaaggaacatgctaaaggtggtaagtgcattgtgttcacgcaaacaaaaagagatgctgatagattgtcatacagcatgagtcgaagtttccagtgtgaagctcttcatggggacatctcacaagcccaaagagagagaacacttggaggctttcgtgatggacggtttaatattttgattgccactgatgttgctgcccgtggtttggatataccaaatg

SEQ ID NO: 39528 - protein, 409 aa, Panicum virgatum
  misc_feature: Ceres CLONE 1998661
  misc_feature (122)..(291): Pfam Name: DEAD Pfam Description: DEAD/DEAH box helicase
MYAALRRAAPLRRRAVSALAAALLQQQPAAMGAVAPRLPAPAAATAAWFHSSPAWLGFRETGPAGAAARPEFAAAEEGSFYEEEMRAAGAGAAADGGLEIAKLGISSKIVDRLAKKGITKLFPIQRAVLEPAMQGKDMVGRAKTGTGKTLAFGIPIMDAIIRHNDKYKPGKFPLAIVLAPTRELAKQVEREFLDSSPLETLCVYGGTPIGQQIKQLNYGVDVVIGTPGRVIDLLKRGALSLAEIRFVVLDEADQMLSVGFDQDVETILQQVPQQRQTLMFSATMPTWIRKLTQKYLNNPVTVDLVGENDQKLAEGISLFSIASENREKPAVLGELIKEHAKGGKCIVFTQTKRDADRLSYSMSRSFQCEALHGDISQAQRERTLGGFRDGRFNILIATDVAARGLDIPN

SEQ ID NO: 39529 - DNA, 600 bp, Panicum virgatum
  misc_feature: Ceres CLONE 1998661-R
  misc_feature: Encodes the peptide sequence at SEQ ID NO. 39530
cggttctggtcgttccggtggatttggggattctggctcaggtcggttcggcggcggttttggtagttccggctcaagtggttttggtggctttggtgacaggaactctggtggatttggcaactcatcttagtctcaggatgaacttgagcaaaacataataacagctactcttaatatggaaatatggatatcctgcctcagattcagctgaatggttagtatggatatggtttcaaggatcatagtagagaatggccactcctgatctgttgttgggtccctctgaatagttacagaggctagtgtcaccatgccgtggaattcatgcgcgtatccttgtgtctcgggagggattgatcggagtgcagcaggaaaataattacgaagtgttattttcattactgttctgtttttattttgcctttgatcccgcaagttgtagcgctagatcgtacctgtaaaatatgcagagtgtcttctgcggatgttcttatctcgtttttggtagtggctctgtactgtatgacgattttggtgcaaccttgttggccgttctgacctaaaatcacgggtctctataatcatatcatattattc

SEQ ID NO: 39530 - protein, 43 aa, Panicum virgatum
  misc_feature: Ceres CLONE 1998661-R
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Useful for making plants with altered lignin content
  misc_feature: Useful for making plants with modulated nitrogen use efficiency
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with modulated biomass
GSGRSGGFGDSGSGRFGGGFGSSGSSGFGGFGDRNSGGFGNSS

SEQ ID NO: 39531 - DNA, 1509 bp, Panicum virgatum
  misc_feature: Ceres CLONE 1998663
  misc_feature: Encodes the peptide sequence at SEQ ID NO. 39532
aaaccctccgcgcctccgtcccctctgtcccgcccgccattctccgtctcccccctcctcgtcctcctagccgctgccgcctccgcacccatcaccgcctcagggatgaagaacccggacttcgccgccgacaaagcgctcgccaaggacttcctgtccaacttcgctgacccgcgcggcgagcccaagtacctgaacatcctgcaagatgtcgccaatcggaagatccgggcagtccagattgagctggacgacctgttccattataaggatgtggatgaggagttcttgcagcgggtcaccgagaacacgcggcgctacataggcattttcgcagagtccatggatgagctcatgcccgagcccacggaggcgtacaccgttgatgaggaccgggacatcctgatgacgcagcgtgtggatgaaggggcagacggtggcgccgacggcactgacccactccagaggatgccaccggagatcaaacggttctttgaggtttacatcaaggcattctcaaaggtgactccactcacaataaggcaagtgaaggcatccaacattgggcagcttgtgaaaatatctggaattgtgactcgctgctcggatgtgaagcccttgatgcaggttgctgtttatacatgtgaagaatgtggttttgagatataccaggaagtgactgctagagtctttatgcctctctttgagtgcccatctcaaagatgcaagctgaataaagcaaaggggaatctaatccttcaactgcgagcatcaaagtttttgaaatttcaggaggtgaagcttcaagagttagcagagcatgtaccaaagggccacatccctcgttctctgactgttcatctaagaggagagctgactagaaaggttgcacctggagatgtggttgagatgtcaggcatttttcttcccatgccatactatggattcagagcaatgcgtgcaggattagttgctgatacttacttggaagcaatgtctgtcacccatttcaagaaaaaatatgaagaatatgaacttaaaggtgatgaacaagagcaaattgatagattggctgaggatggtgatatctatagtaagttggcaaggtccctggcacctgaaatatttggccatgaagacgtaaagaaagcactgctgttgctgcttgttggcgcaccccttcggaagcttggagatggcatgaagataagaggagacctgcacatatgcttgatgggagatcctggtgttgcaaagagtcaacttctgaagcatatcataaatgttgctccaagaggagtctataccactggacgcgggagcagtggtgttggtcttactgctgccgtccagaaagatccaattacaagtgagtttgtcctcgagggtggagcactggtgctagcagatatgggtatttgcgcgatagatgagtttgacaagatggaagagtcagacaggacagcaattcacgaggtgatggagcagcagactgttagcattgcccag

SEQ ID NO: 39532 - protein, 467 aa, Panicum virgatum
  misc_feature: Ceres CLONE 1998663
  misc_feature (315)..(467): Pfam Name: MCM Pfam Description: MCM2/3/5 family
MKNPDFAADKALAKDFLSNFADPRGEPKYLNILQDVANRKIRAVQIELDDLFHYKDVDEEFLQRVTENTRRYIGIFAESMDELMPEPTEAYTVDEDRDILMTQRVDEGADGGADGTDPLQRMPPEIKRFFEVYIKAFSKVTPLTIRQVKASNIGQLVKISGIVTRCSDVKPLMQVAVYTCEECGFEIYQEVTARVFMPLFECPSQRCKLNKAKGNLILQLRASKFLKFQEVKLQELAEHVPKGHIPRSLTVHLRGELTRKVAPGDVVEMSGIFLPMPYYGFRAMRAGLVADTYLEAMSVTHFKKKYEEYELKGDEQEQIDRLAEDGDIYSKLARSLAPEIFGHEDVKKALLLLLVGAPLRKLGDGMKIRGDLHICLMGDPGVAKSQLLKHIINVAPRGVYTTGRGSSGVGLTAAVQKDPITSEFVLEGGALVLADMGICAIDEFDKMEESDRTAIHEVMEQQTVSIA

SEQ ID NO: 39533 - DNA, 748 bp, Panicum virgatum
  misc_feature: Ceres CLONE 1998663-R
ctacacaactatcagaacactcctcagcatactccgcatttcaattgccttagcaaggcttagattttcagaaactgtggctcagagcgatgtcgatgaagcactgcgactgatgcagatgtccaagtactcgttatactcagatgaccgccagcggtctggcctagatgcaatttctgacatatattccatcctgagatatgaagcggcaaggacgagcagcatggatgtgagatatgctcatgctcttaacttaatctccagaaagggatatagtgaggctcaattgaaggagtgtttggaggaatatgcatccctgaatgtgtggcagatccatccgaacaccttcgacatccacttcattgatgcctgatgagaagctgaacccaaccacctgacatttcatcatgagcggaaggatggaatatcaagagttggtgcttcatgatttgtcaccagagtgatgaacaccattgatagagccctaacaagatcgaatagttctagtgatagtgaacaacaaaccatttcatgatatcaatgatgtaatgctcggcagaagcctgtgagaattgtaccagtagagccattgttctttccgcctaatgagtagcctagtgcttttttttttcttctcgcaatctccttgtttcacactgaagtgtatgtacactgctgtgtttccttattgctgcacataggtgcatttctgccattgttattttggggcaaaatagccattttgctc

SEQ ID NO: 39534 - DNA, 605 bp, Panicum virgatum
  misc_feature: Ceres CLONE 1998679
  misc_feature: Encodes the peptide sequence at SEQ ID NO. 39535
atcgacccacccaactcaaatcacggatcagtcaatcgaatctgcaatcgcgatctgtttgttctttttagtagtactgtagcagtaatagcgggggtaattcgttggatgtgactggagattaattaattgttcaatggcatgatcttcatcagggatgctgcggcggcctgcacttcagcgacgtgctgacgctgaacgtggagaccatggcgtggagctccatggccacgacggggcagcgcccgggcacgcgggacagccacggcgccgccctggtgggccaccggatgctcgtcttcgggggcaccaacggcggcaagaaggtgaacgacctccacgcgctggacctgcgcaccggggagtggacccgcccgcagtgcaagggggcgccgccgtcgccgcgggagagccacaccgtcaccgtcgtcggaggcgaccgcctcgtcgtgttcggcgggagcggcgagggggagagcaactacctcagcgacgtgcacgtgctggacgtgcccaccatgacgtggtccacgccggaggtcaagggcgactacgcgccggcgcccagggacagccacggcgccgtggccgtcggcggcaggctc

SEQ ID NO: 39535 - protein, 131 aa, Panicum virgatum
  misc_feature: Ceres CLONE 1998679
  misc_feature (15)..(60): Pfam Name: Kelch_2 Pfam Description: Kelch motif
  misc_feature (65)..(113): Pfam Name: Kelch_2 Pfam Description: Kelch motif
  misc_feature: SWISSPROT Homolog: EC 3.1.3.16 Phosphoprotein phosphatase
MAWSSMATTGQRPGTRDSHGAALVGHRMLVFGGTNGGKKVNDLHALDLRTGEWTRPQCKGAPPSPRESHTVTVVGGDRLVVFGGSGEGESNYLSDVHVLDVPTMTWSTPEVKGDYAPAPRDSHGAVAVGGR

SEQ ID NO: 39536 - DNA, 1203 bp, Panicum virgatum
  misc_feature: Ceres CLONE 1998682
  misc_feature: Encodes the peptide sequence at SEQ ID NO. 39537
aaagcgccattattacaaacacctcgcagctcgaatccgtcacacagccttaccggccggccgccaccgcgagatgcctcggaagtcgtcgagggcgaggggcggggccacgcaaggccccgttggccccgcggcggcgccgaggcctcccgtcaaggccggccccccaaaccctagccccgccgccgagctgccccaggccgcccccgccgccgccgaggccctggagcgcctccatctcgaccccgcttctgatggtgatccgccgccgccgcctcctcctcccgtgaccgagcccgaggcacccgcgccgtctcagccgccgccggtggaggcgtcgtcgtctggaaggtctgaggcgggcgggagcctggagcaggaggctgtgaggaagctgcacgagcttgcggaggctggtggggaggaggtgccgttgactgatgaggaggtgcgcgccaatgatcagaggcaggaggacgagctctgtgccctggaagccatttttggggatgctgtagtaattttggacagaaagggaggccagcggtgtttccaggtccatgttcacattgagattccagatgctatagatgtatcaacaaggctcaattatggtgatggaaaattaaaatatggggcaacatctgacgctgatgctgatgaccttgtttacaagtttagagttgagcatttgcctccaatcctgctaacatttcttctgcctgcatcatacccaagtcaccatgccccccttttcactatctccacatattggcttgataaagggatgattttgtcattatgtcgcatgcttgatatgctttgggaagagcaacaggggatggaaataacatatcaatgggtgcagtggctccaaagttcttccctttctcacttagggtttggtaatgagatagttttgggcaagaatgatgtaacatgtgatgcagataagcgtgcttgtctagataatgcttcaccagatgttgtaattccaaggatgatgagatacaatgacaataagcatcatgaagctttcttacacgctatccatgactgcatgatttgtttcagcgagtgtcctggtgtcgatttcatcaaacttccatgtcatcatttcttttgctggaaatgcatgcaaacatactgcaaaatgaatgttaaggagggaaatggtgtgaagttgctatgtcctgatacaaa

SEQ ID NO: 39537 - protein, 376 aa, Panicum virgatum
  misc_feature: Ceres CLONE 1998682
  misc_feature (128)..(271): Pfam Name: RWD Pfam Description: RWD domain
MPRKSSRARGGATQGPVGPAAAPRPPVKAGPPNPSPAAELPQAAPAAAEALERLHLDPASDGDPPPPPPPPVTEPEAPAPSQPPPVEASSSGRSEAGGSLEQEAVRKLHELAEAGGEEVPLTDEEVRANDQRQEDELCALEAIFGDAVVILDRKGGQRCFQVHVHIEIPDAIDVSTRLNYGDGKLKYGATSDADADDLVYKFRVEHLPPILLTFLLPASYPSHHAPLFTISTYWLDKGMILSLCRMLDMLWEEQQGMEITYQWVQWLQSSSLSHLGFGNEIVLGKNDVTCDADKRACLDNASPDVVIPRMMRYNDNKHHEAFLHAIHDCMICFSECPGVDFIKLPCHHFFCWKCMQTYCKMNVKEGNGVKLLCPDT

SEQ ID NO: 39538 - DNA, 194 bp, Panicum virgatum
  misc_feature: Ceres CLONE 1998682-R
aatccatttttttgaagagagcatcttttcaagtctccaatgtcattgtatccacagtagctccatggtttatattcgcgaacacaaacatggaccattatttcattcactacatggtgaagttttgcgaataccatatgtatacgcaagatgctgatcgaacaaaaaccaatagaaccaattctggagagggc

SEQ ID NO: 39539 - DNA, 1323 bp, Panicum virgatum
  misc_feature: Ceres CLONE 1998689
  misc_feature: Encodes the peptide sequence at SEQ ID NO. 39540
ccctcaaagcctcgcccctcgccgccgagcacaagcccagccgccgccggccccttcccctccgcggtatcctccgtccgctgctcctctttcgctctggcgagctgcgagccggagatccatcaccatctggacgacgactggttccttctcgtgttgggttcgtcttcggcgcgcaagagatcgattgcatcgtagcagttccgtgtacctaatcgaggtgcgggcggagttgatttccaaaattttgggggttcagctgagcccccatgacccaggtgaagcccgcccctgggggaaggatgctgaccgtgctgcgggtgcacctcccgtcggagatcccgatcgtcggctgcgagatcacgccgtacgtgctcctgcgccgccccgacggcggcatcttcactgacgacgtgtctgaggcctctcctgtggatggctacttcatgcgctacaagtggtaccgcatacaaagtgatcgaagagccgctatctgcagtgtacacccaacagaagaagcaacgcttcagtgcatagggtgtctgaagtcaaaaatacctgttgcgaagagctaccattgttctgctaagtgcttctgtgatgcctggcaacaccacagggttctgcacgaacgtgctattagtgctttaaacgaaaatggaacagaagaagaggagttatttggcagatttggcagtggcagttcgagttcagggattatcagtactgctttgtctggttcaactccaactctttcgcagaactcaggttttaataatggacctacacctgtgtatccaactggcactgaaaagagttctggtgaaacatggttcgaagtgggacgctctcggacatatacagcaaccgctgatgatattgggcatgtactaagatttgaatgtgtagttgtggatttggaaacaagggggaccgtcggagttcctacttccgtcatgacatcccgtgtcatcccagcaccaacccccactccacgtcgcttgatccctgtgaatacagctgatgctatggggcactttgatttagatggccgaacttcttcgtttgggacattcactgtgctatcctacaatattctcgctgatacatacgcgacaagtgatacgtacagctattgtccaacttgggcactttcatgggcttacagaagacaaaatttactgcgtgaaattattggttaccatgctgacattatctgccttcaggaggtacaaaataatcactttgaggaattttttgcaccagagcttgataaacatggatatcaagcattttataaaaggaggacaacagaggtgtacg

SEQ ID NO: 39540 - protein, 351 aa, Panicum virgatum
  misc_feature: Ceres CLONE 1998689
  misc_feature: SWISSPROT Homolog: EC 3.1.13.4 Poly(A)-specific ribonuclease
MTQVKPAPGGRMLTVLRVHLPSEIPIVGCEITPYVLLRRPDGGIFTDDVSEASPVDGYFMRYKWYRIQSDRRAAICSVHPTEEATLQCIGCLKSKIPVAKSYHCSAKCFCDAWQHHRVLHERAISALNENGTEEEELFGRFGSGSSSSGIISTALSGSTPTLSQNSGFNNGPTPVYPTGTEKSSGETWFEVGRSRTYTATADDIGHVLRFECVVVDLETRGTVGVPTSVMTSRVIPAPTPTPRRLIPVNTADAMGHFDLDGRTSSFGTFTVLSYNILADTYATSDTYSYCPTWALSWAYRRQNLLREIIGYHADIICLQEVQNNHFEEFFAPELDKHGYQAFYKRRTTEVY

SEQ ID NO: 39541 - DNA, 315 bp, Panicum virgatum
  misc_feature: Ceres CLONE 1998689-R
caacaatgtgaagagaacgtgccctcgtagaagtcaagaatgagaaagcctaagggaaagaggcttgtgattttcctcacccttttacatgctgccctgatgttttgtagtggctctagttggaatgtgacttcctatatctttgcaaagagaaataattcaatagatctggatgacatttttagttttccagcctcacattctcacccctcaccttcagtgtgagtccattgtccacatttttttttaccatggaatctagttcttacaaactggaaatgatcccttcctatgtctcattttattgtgacatgt

SEQ ID NO: 39542 - DNA, 736 bp, Panicum virgatum
  misc_feature: Ceres CLONE 1998690
  misc_feature: Encodes the peptide sequence at SEQ ID NO. 39543
aacaataataataaaaccctctgcttttcattcactagtactcctagtttttccgccgattccttcttccgcctcctcccccctccccctccccctccgtctcctcccccgccgccgccgcctcctcatcgctcaccccgactccgcccctctcccggtgatcttcgatggcggcgccggcgctatggcagccgcaggagcaagggctccgcgagatctgcaccctcctcgaggcgcacatctcccccaactccgaccaagcccgcatctggcagcagctccagcactacagccagttccccgacttcaacaactatctcgtcttcctcctcgcccgcggagaggggaaatccattgaagttagacaggctgctggccttctactgaaaaataatctgcgagcgactttcagttccatgccagttccatcccagcagtatattaaatctgagttgttaccatgtatcggggcaaccaatagggcaattagatccacagttggaacagtgatcagtgtacttttccaaattgttcgagttgctgggtggattgagttatttcaggccctgcacaagtgtttggacagtaacgacttggatcatatggaaggtgctatggatgctatatacaagatatgtgaggatgtacctgaggagcttgacattgatgttgctggtttgcctgaacggccgatcaatgtattcatgcccaagatactgcagtttttttcatcacc

SEQ ID NO: 39543 - protein, 189 aa, Panicum virgatum
  misc_feature: Ceres CLONE 1998690
  misc_feature (34)..(102): Pfam Name: IBN_N Pfam Description: Importin-beta N-terminal domain
MAAPALWQPQEQGLREICTLLEAHISPNSDQARIWQQLQHYSQFPDFNNYLVFLLARGEGKSIEVRQAAGLLLKNNLRATFSSMPVPSQQYIKSELLPCIGATNRAIRSTVGTVISVLFQIVRVAGWIELFQALHKCLDSNDLDHMEGAMDAIYKICEDVPEELDIDVAGLPERPINVFMPKILQFFSS

SEQ ID NO: 39544 - DNA, 1439 bp, Panicum virgatum
  misc_feature: Ceres CLONE 1998695
  misc_feature: Encodes the peptide sequence at SEQ ID NO. 39545
gcttggctcctctatctctcgctctcctccctcccccacgggcgcccacgcctcgccaccccactgccccccccccccccccaccgacgcaaccccttctccccgccgcgctcctccccgccgatcgcggggggctggaccccgtcgccgattcgcgctccgccaagcgccgaaaccctagatctggtgcggatcccgcgcctcccgccacctcgccgccatgttctggcgcatgaccggcctctccgcggcctcgcccgtggacacaattctagacaaggaaaactttacattggaagagcttcttgatgaagatgagattattcaggagtgcaaagcgctgaatactcgactcataaatttcttgcgagataaatcccaagtggagcagttacttcgttacatcgtggaagatgttccagaggattcagagaagaaacgatctttcaagtttccatttattgcttgtgagatttttacttgtgaaattgacattatcttgaggaccttggtagaagatgttgagttaatggatttacttttctcatttgtaaaacctgaccatccgcatagcactttgctagctggttacttcagtaaggtggtgatatgtttgatgctgcggaagaccgcgtctcttatgaattatgttcaggagcatccagatattgttgtccaacttgttgacctcattggtatcacctcgataatggaggtgttgatgagattgattggtgctgatgaaaccatatactcaaattttgctgatacattgcaatggttagagagtacagatgtcctggaaatgattgtggataaatttagctcatctgactcccctgaagtacatgcgaatgctgcagagatcctttctgcagtaactcgatgcgcccctcctgctcttgctgcaaaaatatgcagcccaagttttgttggtaggttgtttcgccacgctcttgaagaatcaagaccaaaatcggttctggttcattcactgtcagtgtgtatatctttgttggacccaaaaagactagcatcagcctcttatcaagcgtttagaagtaacttgagtcatgggacactggtcacagccagtccagagacagttgatggtatgctggagagtttaggtgctttgctgaagttattggacattacttctgaaaatgttttgcctacaacatatggatgtctgcgcccgcctcttggaaaacatcgcttgaagattgtggagttcatctctgttttgctaacaattggtagcgaaatagctgagaaggagctaataagccaatcagcaataaagcattgcatcgacttgttttttcagtacccttacaataactttttgcatcatcatgttgagaacattattgtttcttgcctcgaggttaaaagaaatcagctgattgaccatgtccttaatggctgtggccttg

SEQ ID NO: 39545 - protein, 406 aa, Panicum virgatum
  misc_feature: Ceres CLONE 1998695
  misc_feature (129)..(406): Pfam Name: SAPS Pfam Description: SIT4 phosphatase-associated protein
MFWRMTGLSAASPVDTILDKENFTLEELLDEDEIIQECKALNTRLINFLRDKSQVEQLLRYIVEDVPEDSEKKRSFKFPFIACEIFTCEIDIILRTLVEDVELMDLLFSFVKPDHPHSTLLAGYFSKVVICLMLRKTASLMNYVQEHPDIVVQLVDLIGITSIMEVLMRLIGADETIYSNFADTLQWLESTDVLEMIVDKFSSSDSPEVHANAAEILSAVTRCAPPALAAKICSPSFVGRLFRHALEESRPKSVLVHSLSVCISLLDPKRLASASYQAFRSNLSHGTLVTASPETVDGMLESLGALLKLLDITSENVLPTTYGCLRPPLGKHRLKIVEFISVLLTIGSEIAEKELISQSAIKHCIDLFFQYPYNNFLHHHVENIIVSCLEVKRNQLIDHVLNGCGL

SEQ ID NO: 39546 - DNA, 544 bp, Panicum virgatum
  misc_feature: Ceres CLONE 1998695-R
gagcagtatcgccagccagattcttttgcaggtgaacaatgccacctttttttgcatcacatgctcaggaaccacggacaacccttcagaaggcaaggatgctgtacaatagaaggcgttgctttgctatgtgcagttgttggtactgcatgaatgagcatattcgtgcagctgggcacgccctgttatgatcggactgtttcaccacagtcccatccccagaagcaatttcctcagttcacatggacttcttaccccgcaatggtgggaaaactaattcttgccaatgtcatttggtggttgatgcatgcgaggaggggattaattcatttggtggttcttgattttgggtgcggtgattatttcctttgctagggtactcgaactgtaatatttgcagtgagtttttcccgtgtttacctttttttcccctttgggattagtgttctgtaattgttatctgtccaagtgaaacatctacctttcccttttggattctaaactggatgttctcagcaaaaattgggggcaaatctttcaggat

SEQ ID NO: 39547 - DNA, 712 bp, Panicum virgatum
  misc_feature: Ceres CLONE 1998697
  misc_feature: Encodes the peptide sequence at SEQ ID NO. 39548
gtctccccgcggttgcgctaggatttgcgtctccccgcggcggcaccggcaccggcatcggcaccgccaccggcagcggcagcggcgatggcggggcaggagcggaggacgatcgatctggaggagggatgggccttcatgcagaagggcatcaccaaactgaagaacatccttgagggcaagcccgagccacagttcagctccgaggactacatgatgctctacacgacgatatacaacatgtgcacgcagaagccgccgcacgactactcgcagcagctctacgacaagtaccgcgagtccttcgaggagtacatcacctccatggtactgccttcgttaagggaaaagcatgacgagtttatgttgagggagctagtgcaaaggtggtcaaaccataaagtcatggttcggtggctctcacgcttctttcactaccttgatcggtacttcatctcaaggaggtcacttaccccacttaaagaagttgggcttacttgcttccgagagttgatttatcaagagattaaaggacaagtaaaagatgcagtgattgctctgatagacaaagagcgtgaaggtgaacagattgacagggctttattgaagaatgtcctagacatatttgttgaaattgggttgggtcaaatggattgttacgagaatgactttgaagacttcttgcttaaggatactacagagtactactctg

SEQ ID NO: 39548 - protein, 208 aa, Panicum virgatum
  misc_feature: Ceres CLONE 1998697
  misc_feature (15)..(208): Pfam Name: Cullin Pfam Description: Cullin family
MAGQERRTIDLEEGWAFMQKGITKLKNILEGKPEPQFSSEDYMMLYTTIYNMCTQKPPHDYSQQLYDKYRESFEEYITSMVLPSLREKHDEFMLRELVQRWSNHKVMVRWLSRFFHYLDRYFISRRSLTPLKEVGLTCFRELIYQEIKGQVKDAVIALIDKEREGEQIDRALLKNVLDIFVEIGLGQMDCYENDFEDFLLKDTTEYYS

SEQ ID NO: 39549 - DNA, 717 bp, Panicum virgatum
  misc_feature: Ceres CLONE 1998707
  misc_feature: Encodes the peptide sequence at SEQ ID NO. 39550
agccgcgacgtcgcactcctccctacctccacccgcgccgccatccgccgcggcattccaccgagcatctcgcgcgcgcgcatggccgccgtggccccgcaccacctctcccgccccgctgccgccgccaccgccgcggcatccggcgccgtttcgggtgctctcaacaggcatggcgccttctcatccgcctcctgctcccctctccgcctcccgctcctccgcgccgccgccaccaggcccgcgcgcctctcggccgctgtttccaccgccaccccgactatggaggccgcggcgatggacgccgtggcgaagtgggggctgacctcgctctccgaggccgacccggaggtctacgacctcatcgagcgcgagaagcggcggcagcgcgcgggcatcgagctcatcgcctccgagaacttcacctcgctcgccgtcatggaggcgctcggctccccgctcaccaacaagtactcggagggcatgccgggggcgcgctactacggcggcaacgaggtcatcgacgaggtcgaggagctctgccgcgcccgcgcgctcgccgcgttccacctcgacccgacacgctggggcgtcaacgtgcagccctactcggggtcgccggccaacttcgccgcctacacggggctgctccagccccacgataggatcatggggctcgaactgccgtcgggcggcacctcacccatgggtactaca

SEQ ID NO: 39550 - protein, 211 aa, Panicum virgatum
  misc_feature: Ceres CLONE 1998707
  misc_feature (84)..(211): Pfam Name: SHMT Pfam Description: Serine hydroxymethyltransferase
  misc_feature: SWISSPROT Homolog: EC 2.1.2.1 Glycine hydroxymethyltransferase
  misc_feature: Useful for making plants with modulated nitrogen use efficiency
MAAVAPHHLSRPAAAATAAASGAVSGALNRHGAFSSASCSPLRLPLLRAAATRPARLSAAVSTATPTMEAAAMDAVAKWGLTSLSEADPEVYDLIEREKRRQRAGIELIASENFTSLAVMEALGSPLTNKYSEGMPGARYYGGNEVIDEVEELCRARALAAFHLDPTRWGVNVQPYSGSPANFAAYTGLLQPHDRIMGLELPSGGTSPMGT

SEQ ID NO: 39551 - DNA, 1229 bp, Panicum virgatum
  misc_feature: Ceres CLONE 1998715
  misc_feature: Encodes the peptide sequence at SEQ ID NO. 39552
atggttgaattgcatccgaaggaaaggaaacgctcctcatttcctcaacgactggctggcaggcctggtactgcccccgtcctctctctcgttgccagattcagatccatgccgcccgcctctccactcctgtaagccctcgcgcctccccctccccctcctcactccgctgcctccagcgaggccgccgcccgcgggagctcctcgcgccgccgccgccgctccccccgccccggcgccgccggcccgggcgccctcccccccgcccgcgcgcgccgctccgacagcagccgccgccatggcgcagccgctcgtcgtgaagaaggacgacgacctcgacgaggaagagtactactcgccgttcctcggcatcgagaagggcgccgtgctgcaggaggctcgcgtcttccacgacccgcagctcgacgcgcggcgatgctgccaggttatcaccaagcttctatacctgctcaaccagggtgacacctttaccaaggtggaggccacagaagtcttctttgcaacgaccaagctgttccaatccaaggatgcagggcttaggaggatggtatacctcatgatcaaggaactgtcgccttcagctgatgaggttatcattgtcaccagctctttgatgaaggacatgaatagcaaaactgatatgtaccgtgcaaacgctattcgagttctttgtcgtattatcgactcaactcttctcacccaaattgagaggtatttgaagcaagccattgttgataagaatcctgttgttgccagtgcggcccttgttagtggcatctacttgcttcagacaagtccggaagttgtgaaaagatggagcaatgaagttcaggaggctgtgcagtcaagagctgctcttgtgcagtttcatgcccttgctcttctgcaccaaattaggcaaaatgaccgattggctgtcagtaagcttgttactagtttgaccaggggttcagttcgctcgcctttggcccagtgcctgcttattcggtacactagccaggtgattagagagtctggagtaaaccaaggtggagatcgtcctttcttcgatttccttgagtcctgtctcaggaacaaagcagagatggtcatacttgaggctgcaagagcaataactgaactgaatggtgtcacaagccgtgagctcacacctgcaataactgtcctgcagttattcttaagttcatctaaacctggtctcagatttg

SEQ ID NO: 39552 - protein, 310 aa, Panicum virgatum
  misc_feature: Ceres CLONE 1998715
  misc_feature (26)..(310): Pfam Name: Adaptin_N Pfam Description: Adaptin N terminal region
MAQPLVVKKDDDLDEEEYYSPFLGIEKGAVLQEARVFHDPQLDARRCCQVITKLLYLLNQGDTFTKVEATEVFFATTKLFQSKDAGLRRMVYLMIKELSPSADEVIIVTSSLMKDMNSKTDMYRANAIRVLCRIIDSTLLTQIERYLKQAIVDKNPVVASAALVSGIYLLQTSPEVVKRWSNEVQEAVQSRAALVQFHALALLHQIRQNDRLAVSKLVTSLTRGSVRSPLAQCLLIRYTSQVIRESGVNQGGDRPFFDFLESCLRNKAEMVILEAARAITELNGVTSRELTPAITVLQLFLSSSKPGLRF

SEQ ID NO: 39553 - DNA, 1432 bp, Panicum virgatum
  misc_feature: Ceres CLONE 1998717
  misc_feature: Encodes the peptide sequence at SEQ ID NO. 39554
ggccctgttgtcccttcccctcccccaatctttctctctcctctcctctccctaacaagtcccaccgcgcctttctttaatggggtgagcctaacaaacactccgagcgccgcgacgcacaccacctccaccgccaccggtgcggtgaccaccacacacactgcttctcttccttcgtcgctccccctgctctgctctgcttctcctccccgggaccgggaccgggagccatggcgcaaggacgggagcctgagctgttcgccgagctttggcgcgcctgcgctgggccgctggtggagctgccccagacgggcgagcgggtcttctacttcctgcagggccacctggagcagctgcaggaggccaccgacccggcgctgctggccgagcagatcaagatgttccaggtgcccaacaagatcctctgcaaggtcgtcaacgtcgagctcaaggccgagacggaaacggacgagatgttcgcccagatcactctgcagcccgacccggatcaagtgaatctgcccacattacctgacccgcccctgccggagacaccgaggccagtggtgcactctttctgcaagattctcacaccatccgacaccagcacccatggcggcttctctgttctccgacggcacgcaaacgaatgcctcccaccactggatatgtcgatgccgacccccacccaagagctcatcaccaaggacttgcatggatctgaatggaggttcaagcacatctacaggggccaaccccgtcggcaccttctgactaccggatggagcacgtttgtcacatcaaagaagctgattgctggggatgcgtttgtctacctcaggagcgagacaggagagcagcgtgttggagtaagacgccttgtgcagaagcagagcacgatgccagcatcggttatatccagccaaagcatgcatcttggggtccttgcaagtgcatcacatgccattaagactaattccattttcctggtgtattatagaccaaggttaagccaaagccaatacatcgtcagtctgaacaagtaccttgaagctagtaaaattggatttaaagtgggcgtgaggtttaagatgagttttgaaggggaagatatccctgtgaagaagttttctggaactgtagttgataaaggagatctttctccacaatggcaaggttctgaatggaagacgttgaaggtccaatgggatgaagccacaaatttcaatggccctgatagggtttcctcttgggaaatcgaacaattcgatgcctctgcacctaccataaacatacctgtgcaaccatcaatgaaaaacaaaaggcctagggagacagctgaaggcctggatattcaggcaatggaacctactcaagaattttggctctctggaatatctgaacagcatgagaagacaggcatttggctccc

SEQ ID NO: 39554 - protein, 400 aa, Panicum virgatum
  misc_feature: Ceres CLONE 1998717
  misc_feature (242)..(323): Pfam Name: Auxin_resp Pfam Description: Auxin response factor
  misc_feature (115)..(220): Pfam Name: B3 Pfam Description: B3 DNA binding domain
  misc_feature: Useful for biocontainment applications
  misc_feature: Useful for making plants with modulated flowering time
  misc_feature: The sequence is a functional homolog of SEQ ID NO 300 in the 10/412,699 US patent application
  misc_feature: The sequence is a functional homolog of SEQ ID NO 298 in the 10/412,699 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
MAQGREPELFAELWRACAGPLVELPQTGERVFYFLQGHLEQLQEATDPALLAEQIKMFQVPNKILCKVVNVELKAETETDEMFAQITLQPDPDQVNLPTLPDPPLPETPRPVVHSFCKILTPSDTSTHGGFSVLRRHANECLPPLDMSMPTPTQELITKDLHGSEWRFKHIYRGQPRRHLLTTGWSTFVTSKKLIAGDAFVYLRSETGEQRVGVRRLVQKQSTMPASVISSQSMHLGVLASASHAIKTNSIFLVYYRPRLSQSQYIVSLNKYLEASKIGFKVGVRFKMSFEGEDIPVKKFSGTVVDKGDLSPQWQGSEWKTLKVQWDEATNFNGPDRVSSWEIEQFDASAPTINIPVQPSMKNKRPRETAEGLDIQAMEPTQEFWLSGISEQHEKTGIWL

SEQ ID NO: 39555 - DNA, 746 bp, Panicum virgatum
  misc_feature: Ceres CLONE 1998717-R
atgctatcgaagaaaagaaggaaccctgcatgttccgtctgtttggtgtcaacttgattaaccataccaagattagtgctaccactgacaagatgaccatgggagtaggggaggtatcgacccaagctgctggttcttttgaagactctggtcagttatcagcactttcaaaagtcataaaagatcatacacaggtcctgaatgaaagcccccgagaaattcaaagccatcagagttgcactgggaggactcgaattaaggttcaaatgcatggaaatgctgtgggcagagctgtagatttggcgaacctggatgggtatccacagttgattggtgagcttgaagagatgttcgagataaaagacctgagtttgaaagagaaatggaaggtggctttcagtaatgatgatggtgatacaatggaagtcggcgatgttccttggcttgagttctgcctgaaggtgaggaagattgtgatccattccactgaagatgagagagatatggatccttgcccggagcaggatgtgaagaccggtttttagaagggggacagggatggaaggtggatttttggagcctttcacggttgatgatgaagcatcgttgtttgtctggggcggaagatggttgtagctgaaacatgatggctagcttgtcttgatgacgcaacagattggttgcctggcgtcagttctttcttcgcaagcattttgaggaagaattgatgtaacataggtttgcag

SEQ ID NO: 39556 - DNA, 712 bp, Panicum virgatum
  misc_feature: Ceres CLONE 1998762
  misc_feature: Encodes the peptide sequence at SEQ ID NO. 39557
acccagagctctgtagaagaagcggcgagggggcgaaccggagccactcagccgccacctcaccgcgccacgccgctcctgctcgccgccgcccgctgctctcgccatttcagccgcagcgcctctcctcctccgcagggccgcagcgcctctcctccagtcctcctgcgccgcctgccggctgccttccggatgagaagcggcgcaaccggggcggcggaagcgtggtcggggtgaggcttcgtcggagtccgtgaacgcgccgacaaggatcctggagatcaagcgcatgggttccttggaggcccggtaccgaccgaccggggcagctgaggacacggctaagagaaggactcagaaaagcaaaagtttcaaagaggttgaaaaatttgatgtttttgttctggagaaaagctcgggatgcaaattcagatccttgcaacttttgctctttgctatcatgtctgcggcatttctaacactcctatacacgccgtctgtgtatgaacatcagctacagtcaagctctagacttgtcaatgggtggatatgggataagagaagttctgatcctcgatatgtctctactgccaacattcaatgggaagatgtatataaaagtattcaaaatctgaatggtggtgaacaaaagctcaaagttgcactcctgattttaacagaactgagtttggcacttggacagatatgctcc

SEQ ID NO: 39557 - protein, 140 aa, Panicum virgatum
  misc_feature: Ceres CLONE 1998762
  misc_feature: Useful for making plants with altered carbohydrate content
MGSLEARYRPTGAAEDTAKRRTQKSKSFKEVEKFDVFVLEKSSGCKFRSLQLLLFAIMSAAFLTLLYTPSVYEHQLQSSSRLVNGWIWDKRSSDPRYVSTANIQWEDVYKSIQNLNGGEQKLKVALLILTELSLALGQIC

SEQ ID NO: 39558 - DNA, 959 bp, Panicum virgatum
  misc_feature: Ceres CLONE 1998768
  misc_feature: Encodes the peptide sequence at SEQ ID NO. 39559
atcatcccctcccccgtcttttcccttgcaggtctcctcctcttcctccgtcttcgtcttcttctcctcgcctcgccttctcttcccttcccttcccctatccgccgcttccccttccccccttctttctcaccgcccccccccccccacaacccctcccccggcccgccccgtctcccggcgaattcgccgcgagggccaggaatttcacttggagaaaggagtcatttttttatctgtttctccggatccgcgacccgctgttggtttgttcgcccgttccattcggcctgatttagattcgttcatattcgttcttgctcgttcagttgaggctagccgccgcccggatttatcgctgcgctgtgtggatctggtctcgctgagcccccgccgcccggaatcccgatccgattcggctccgcccggtgccgcccgcctcggcgcgttcggatctcgtaggactagaggggaatagaggcttctcgattcgtgtcgggacgagatggatcatgtggtcgggggcaagttcaagctcggcaagaagatcgggagtggatcgttcggggagctcttcctcgctgtgaatgtgcagactggagaagaggttgccgtcaagctggaaaatgtgaagacaaagcacccacagcttcattatgagtcgaagctctacatgcttctccaaggaggaactggcattccacacttgaagtggtttggtgttgagggggagtataatgtcgtggtgatcgatcttcttgggcctagccttgaggactgattcaactactgcaggagagagttctcgctgaagactgtgctcatgcttgctgatcaaatgattaatcgggttgagtacatgcatcagaaggggtttcttcaccgtgatagaaagcctgataatttccttatggggcttggtaggaagagctaatgccggtgtgatataatagactatg

SEQ ID NO: 39559 - protein, 91 aa, Panicum virgatum
  misc_feature: Ceres CLONE 1998768
  misc_feature: SWISSPROT Homolog: EC 2.7.11.1 Non-specific serine/threonine protein kinase
  misc_feature: The sequence is a functional homolog of SEQ ID NO 32 in US patent 7179962
MDHVVGGKFKLGKKIGSGSFGELFLAVNVQTGEEVAVKLENVKTKHPQLHYESKLYMLLQGGTGIPHLKWFGVEGEYNVVVIDLLGPSLED

SEQ ID NO: 39560 - DNA, 681 bp, Panicum virgatum
  misc_feature: Ceres CLONE 1998773
  misc_feature: Encodes the peptide sequence at SEQ ID NO. 39561
agagctgatcgatcgcttgtgaccgactggccaatataatcgattgaagaatttcgatacgcatcacatttacatatatgcacttgcgtatcgacgaggcagctgagctagagctagagctagagctagagctagagctagagctagagccagagccagagccagagcttgagcttgagatggagaacggcgacgtgaagcctgctcgcagctcggtggcggcgagcgccatggcggcctcgtacaacgaccagattcggccgctgctggacgccgtggaccggctgcggcagctgaacgtgagccaggagggcatccagctcccgaccatcgtcgtggtgggcgaccagtccagcggcaagtcgagcgtgctggagtcgctggccggcatcagcctcccgcgcgggcagggcatctgcacccgcgtgccgctcgtcatgcggctgcaggacggcgacgacccccggctgcaggtggagtacggcaacggcaccgtggtgcccgtcgcctccgaggcggaggtcgccgacgcaatcgaagccgccacggccgagatcgccggctccgggaagggaatctccgactcgcccatcaccctcctggtgcggaagaagggcgtgccggacctcaccctggtggacctgccgggcatcacccgcgtgcctgtgcagggccagccgg

SEQ ID NO: 39561 - protein, 201 aa, Panicum virgatum
  misc_feature: Ceres CLONE 1998773
  misc_feature (85)..(201): Pfam Name: Dynamin_N Pfam Description: Dynamin family
  misc_feature: SWISSPROT Homolog: EC 3.6.5.5 Dynamin GTPase
MHLRIDEAAELELELELELELELEPEPEPELELEMENGDVKPARSSVAASAMAASYNDQIRPLLDAVDRLRQLNVSQEGIQLPTIVVVGDQSSGKSSVLESLAGISLPRGQGICTRVPLVMRLQDGDDPRLQVEYGNGTVVPVASEAEVADAIEAATAEIAGSGKGISDSPITLLVRKKGVPDLTLVDLPGITRVPVQGQP

SEQ ID NO: 39562 - DNA, 1382 bp, Panicum virgatum
  misc_feature: Ceres CLONE 1998778
  misc_feature: Encodes the peptide sequence at SEQ ID NO. 39563
ggcttcggctcgctcctcttgatttcatcctcgcccacccaacccaatcccccttgtccactccgtttctcttgcccacgaatctcccccgccggttcccgacccgccgccgtcgctcctcctcctcctggttcgccgccatgttggaggagctgctcatcttcacgcggggcggcctcatcctctggtcctcgtgccgggcgctcggcgccgccgccctcaagggctcgcccatcgacgccctcatccgatcctgcctcctcgaggagcgctccgccgacgccagcttctcccaggacaactacgccctcaagtggaccttccacaacgacctcggcctcgtctttgtcgccgtctaccagaagattctgcatcttctctacgtcgatgatctcctcgccgccgtccgcaaggacttctcccagatttatgattccaagcgcaccaactacgacgacttcaccgacatattccgccagctccatctcgaggcccaggcgcgtgccgaggacatgaagaagtccaagcaggccatttcgtcccgtacgctgccagccgtctcccacaagactgctcccaaggctcgcggcgctgctgcccgtgctaccagcaagggcaaggatgactctgatggggactcggagcaccacgctttggcaaatggtaccttcacgggccaccagagtgctgcacccaacgacagctctcttgttaagggcaaggagaacggggtccccaaagacaacggggccttcaatgtaactaaactacagaggttgcgaaagaatgataggaagaacaccagtgctgacaacgtatccaagaagctgaccaaacctgacacaaagaagaaagggaagcaagacagggtgtgggatgacaaaccttccaacaagaagttggatttcacagacccggctgatgagagaggggacgaggtgacagaacatgtcgcactcaaccagggagagagcatgatggataaggatgacaacctcagcagcgacagcgaggaggaagaggtcgaagatggaccaaagaagaaaggctggttctcctcaatgtttcagagtattgctggtaacaatgtattggagaagtctgatctacaacctgcgctcaaggctctcaaagatagactgatgacaaagaacgtggcagaggaaattgcggagaagctttgtgaatctgttgcagctagccttgagggcaagaagctaggatcattcacaagaatatcatctacagtccagacagctatggaggaggctcttcttcgcattttgacccccaggcggtctattgacatactgagggatgtacacccagcccaagagcgtgggaggccgtatgtcattgtttttgttggggtgaatggagtt

SEQ ID NO: 39563 - protein, 413 aa, Panicum virgatum
  misc_feature: Ceres CLONE 1998778
  misc_feature (27)..(299): Pfam Name: SRP-alpha_N Pfam Description: Signal recognition particle, alpha subunit, N-terminal
MLEELLIFTRGGLILWSSCRALGAAALKGSPIDALIRSCLLEERSADASFSQDNYALKWTFHNDLGLVFVAVYQKILHLLYVDDLLAAVRKDFSQIYDSKRTNYDDFTDIFRQLHLEAQARAEDMKKSKQAISSRTLPAVSHKTAPKARGAAARATSKGKDDSDGDSEHHALANGTFTGHQSAAPNDSSLVKGKENGVPKDNGAFNVTKLQRLRKNDRKNTSADNVSKKLTKPDTKKKGKQDRVWDDKPSNKKLDFTDPADERGDEVTEHVALNQGESMMDKDDNLSSDSEEEEVEDGPKKKGWFSSMFQSIAGNNVLEKSDLQPALKALKDRLMTKNVAEEIAEKLCESVAASLEGKKLGSFTRISSTVQTAMEEALLRILTPRRSIDILRDVHPAQERGRPYVIVFVGVNG

SEQ ID NO: 39564 - DNA, 752 bp, Panicum virgatum
  misc_feature: Ceres CLONE 1998778-R
  misc_feature: Encodes the peptide sequence at SEQ ID NO. 39565
agcatgtgacaccttcagatctggtgctgttgagcagctgcggactcatgcacgcaggcttcagatacctatttttgagaagggttatgaaaaagatccagcagttgtagcgagggaagctattcaggaagcaagccgaaacaaatcagacgttgttcttgttgacactgctggacgtatgcaggataatgagccactcatgagagcgctctccaagctcatcaatcttaacagcccagatttagttttatttgttggagaagcattggttgggaatgacgctgtcgatcagctcactaagttcaaccagaaattagcagacctgtctgctgttcctactgctagattaattgatggtatcctgctcaccaagtttgacaccattgacgacaaggttggagcagcgctttccatggtgtatatatctggagctccggtcatgttcgtcggttgtggccagtcctacacggacctgaagaagctgaatgtgaaatccatcgttaagaccctcctgaagtgaagggaatgcattgtgttgagctgtaccacacaaatctgttccatctttatatccccagtgaccttgtcatgttcatgttggacgtcgtggatctgtgagactgctgtggtagaaaaccaaacctaatgtatgggtaactcgtgtcatgtgtacttgtgtttacttggtcgtcttgctccaataatgtggatctgtgagactgctgtagtcgaaaaccaaacctaatgttgtc

SEQ ID NO: 39565 - protein, 172 aa, Panicum virgatum
  misc_feature: Ceres CLONE 1998778-R
  misc_feature (1)..(172): Pfam Name: SRP54 Pfam Description: SRP54-type protein, GTPase domain
ACDTFRSGAVEQLRTHARRLQIPIFEKGYEKDPAVVAREAIQEASRNKSDVVLVDTAGRMQDNEPLMRALSKLINLNSPDLVLFVGEALVGNDAVDQLTKFNQKLADLSAVPTARLIDGILLTKFDTIDDKVGAALSMVYISGAPVMFVGCGQSYTDLKKLNVKSIVKTLLK

SEQ ID NO: 39566 - DNA, 1442 bp, Panicum virgatum
  misc_feature: Ceres CLONE 1998779
  misc_feature: Encodes the peptide sequence at SEQ ID NO. 39567
acaagctgcagaggcaggcccagcactcctccctcctccaggaacacgtcctctcgctccgagaggtcaatgccgctgccgccgcctgctccgcagctacagtgccccactactcactctcctcgagatcccacacctatcactagtgcaaatttatgctggttgttgaagctgttcttcttcgccctgcccatctttctttcctgctccgatccaagaagtgggtgacaagagattgcggcggtagggtttggttaaatcgttcgaggtcttgggaaaattttggggctgaactgaagaagggaggtcgcaatgccgaagatgtttgggttctctcggcgccgcatgaagctggggagattaaagggtcatctacacgatcctttccatggctctcggagcccttctcggcacaccaagcgttttagtcaccccaatggagaagatccagtgactacctcagttagtggtcgtgctgatgaccttgcttggcgctgctcatctgatacttttgatctcaatgggcgtgcttttgagagctcagagaactgggcagtgctgtcaacagagggcgacaaaccgactcctcgttttgatcatgcagcagccattgtagggagtaaaatggtagtattcggtggtgattctggtcatcacttgctagatgatacaaagatattgagcttagacaagcttacctgggattccgtgtctcctaatgttcgaccatcatcaaatggacgttctttgaagttgcctccgtgcaaaggtcattgcctggttccatgggggaagaatgtcattcttgtgggagggaaaagtgacccaccttatgacaagatatcagtatggaccttcaatacagaaactgagctttggttgcatatggaagccaagggtgatatcccggtctctcgaagtggccatacggtgatcagagcaggtcctgttctaattctctttgggggagaggatgccaaagggaagaaactacatgatcttcatatgtttgatctgaagtcatcaacatggcttcctctgaactataaaggtgccggaccttctccaagatcaaatcatgtagctgcactttacgacgatagaattctattgatttttggcggtcagtcgaagtccaagactctgaatgacattcatgctctagacttcgaaacaatgatatggtcaagggtcaaaacccatggtcatcatccatctcctcgagcaggttgctgcggagcactttgcgggactaaatggtatatcacggggggtggaagcaagaaaaaacgtcatcctgaaacatgggtctttgatgttctggaatccaaatggtctgtttgtgtagtgcctcctagttcctcaatcactacgaagaaaggtttcagcatggtttcactgtactacagggacaagattgtgcttgttgcttttggaggaaa

SEQ ID NO: 39567 - protein, 376 aa, Panicum virgatum
  misc_feature: Ceres CLONE 1998779
  misc_feature (252)..(298): Pfam Name: Kelch_2 Pfam Description: Kelch motif
  misc_feature: SWISSPROT Homolog: EC 3.1.3.16 Phosphoprotein phosphatase
MPKMFGFSRRRMKLGRLKGHLHDPFHGSRSPSRHTKRFSHPNGEDPVTTSVSGRADDLAWRCSSDTFDLNGRAFESSENWAVLSTEGDKPTPRFDHAAAIVGSKMVVFGGDSGHHLLDDTKILSLDKLTWDSVSPNVRPSSNGRSLKLPPCKGHCLVPWGKNVILVGGKSDPPYDKISVWTFNTETELWLHMEAKGDIPVSRSGHTVIRAGPVLILFGGEDAKGKKLHDLHMFDLKSSTWLPLNYKGAGPSPRSNHVAALYDDRILLIFGGQSKSKTLNDIHALDFETMIWSRVKTHGHHPSPRAGCCGALCGTKWYITGGGSKKKRHPETWVFDVLESKWSVCVVPPSSSITTKKGFSMVSLYYRDKIVLVAFGG

SEQ ID NO: 39568 - DNA, 718 bp, Panicum virgatum
  misc_feature: Ceres CLONE 1998779-R
tcccccagatgctgaagctaaagcaaggaagctgggcagaagttcatcggacatcaaccaccatcaagacttcaggataaccaacctgatccggagaaacatggcgctggaagaacagctttcagcggcgctgacgaccaaggatgaagcagagaagaacctgtctctggtcatcgacagcaaggatgggcttgagaaaaggctggctgagagggacagggaagtcgaggccctgaaggagaaggtgaccgggatggaactggcgcaggaggagtcgaataacctctcgaacaccgtccacgcggacaatgtgcggctcgagcgcgaggttgctttcctgaaggctgtcatggatgagacccagaaggaactgcattcgacccgtggagttctagcaggagaacgtgcaagggcgttccagctccaggttgaagtgttccatctgaagcaacggctgcaaacaatggaaggaaggtcacctacaccacgaaagcctcagaatctgtagagcacatgcggaagtgtatagttttcgagcatcctgttgtaaattcaacggagagccatttgatttgtactcaatgcaaaaactattttgccaccgggacacaactgtgcatcattgagtttggatccatccagaacatatggtatgcacaaattctgagttgtccttcagcagaagattatattgaagatctgctgaattcttttggtg

SEQ ID NO: 39569 - DNA, 729 bp, Panicum virgatum
  misc_feature: Ceres CLONE 1998781
  misc_feature: Encodes the peptide sequence at SEQ ID NO. 39570
ctattaagaactccgttaaacactgcatctgcaacaataattctggtgactactcgtaatgatacagtcacacgagcaattggtgcggaatatgtgcatcgagttgaattgatgtctgatgacataggctgggagctgctttggaaaagtatgaacattaatgaagataccgaagtgcaaaatctaagaggtatagggacagagattgttcgtatgtgcggtggccttccccttgctatcaaggttattgccagtgtcctagcaactaaagagaaaactgagaaccaatggagacaagtcataaacaaaagtgcttggtccatgagcgaacttcctattgagctgagaggagcattgtatttgagttatgatgacctaccatggcatttgaagcaatgcttcctcttctgtgccttatatccagaagatcatagcatgtctcgtaatgatcttataaggttttggattgctgaagggtttgtacaagatcaaggagaacaacttcttgaggatatagctgatgaatattaccatgaattaatatacaggaatcttcttcatccaaatcctgagtatgctcactatcatttttgtaaaatgcatgatcttttgaggcggctaggtcaatatttgtcgcaagatgaatattttttgtggagatcaaaaatcattggagactaaatctttgtcccaactacgacatgtttcgattgttactgacaaagatcc

SEQ ID NO: 39570 - protein, 226 aa, Panicum virgatum
  misc_feature: Ceres CLONE 1998781
  misc_feature (1)..(166): Pfam Name: NB-ARC Pfam Description: NB-ARC domain
LLRTPLNTASATIILVTTRNDTVTRAIGAEYVHRVELMSDDIGWELLWKSMNINEDTEVQNLRGIGTEIVRMCGGLPLAIKVIASVLATKEKTENQWRQVINKSAWSMSELPIELRGALYLSYDDLPWHLKQCFLFCALYPEDHSMSRNDLIRFWIAEGFVQDQGEQLLEDIADEYYHELIYRNLLHPNPEYAHYHFCKMHDLLRRLGQYLSQDEYFLWRSKIIGD

SEQ ID NO: 39571 - DNA, 699 bp, Panicum virgatum
  misc_feature: Ceres CLONE 1998783
  misc_feature: Encodes the peptide sequence at SEQ ID NO. 39572
tgccattggactgctccccgtttgaccattggtaattgagtaccattgagccatggctgccaagctgactcgcctccacagtcttcgcgaacgacttggtgccaccttctcctctcatcccaatgagctgattgcactcttttccagtctttacaggtatgttaaccagggcaagggaatgcttcagcgccatcaactgcttgctgagtttgatgcgctgtttgatagtgacaaggagaagtatgcaccctttgaagactttcttcgtgctgctcaggaagcgattgtgcttcccccctgggttgcacttgctatcaggccaaggcctggtgtctgggactacattcgggtgaatgtaagtgagttggctgtggaagagctgagtgtttctgaatacttggcattcaaggaacagctggtggatggacacaacaacagcaactttgtgcttgagcttgactttgagcccttcaatgcctcattccctcgtccttccatgtcaaagtccattggaaatggagtacagttccttaacaggcacctgtcttccaagttgtttcaggacaaggagagcttgtaccccctgctgaactttctcaaagcccataactacaagggcacgacaatgatgttaaatgacagaattcagagtcttcgcgggctccagtcatccctcagaaaggcagaggagtacctact

SEQ ID NO: 39572 - protein, 215 aa, Panicum virgatum
  misc_feature: Ceres CLONE 1998783
  misc_feature (6)..(215): Pfam Name: Sucrose_synth Pfam Description: Sucrose synthase
  misc_feature: SWISSPROT Homolog: EC 2.4.1.13 Sucrose synthase
  misc_feature: Useful for making plants with altered carbohydrate content
  misc_feature: Useful for making plants with altered cell wall content and/or composition
  misc_feature: The sequence is a functional homolog of SEQ ID NO 12 in US patent 7091398
  misc_feature: The sequence is a functional homolog of SEQ ID NO 2 in US patent 7091398
MAAKLTRLHSLRERLGATFSSHPNELIALFSSLYRYVNQGKGMLQRHQLLAEFDALFDSDKEKYAPFEDFLRAAQEAIVLPPWVALAIRPRPGVWDYIRVNVSELAVEELSVSEYLAFKEQLVDGHNNSNFVLELDFEPFNASFPRPSMSKSIGNGVQFLNRHLSSKLFQDKESLYPLLNFLKAHNYKGTTMMLNDRIQSLRGLQSSLRKAEEYL

SEQ ID NO: 39573 - DNA, 439 bp, Panicum virgatum
  misc_feature: Ceres CLONE 1998788
  misc_feature: Encodes the peptide sequence at SEQ ID NO. 39574
cgtcccccaagcgcgacagccatggcaacccccgccgccgccgccgccgccaccccgctcgacgaagccaaggccaggttgagttctatttcagcgacagcaacctcccccgcgacgggttcctgcggaggagcgtccaggaaagcgaggatggcttggtgagcttggctctcatatgctccttctcgcggatgcggtcgcacctagggttcgaaggggaggtgaagcctgatactgtgccggaggagacggtgctcgcggttgcagaagtgctgcgccgttcctcctccctccgtatctctgaggacgggaagaaagttggtagagctaaggagttgctggagccagatgaggttatagagcaagtggactctacgacaattgctgcgtcacctcttccttacaatgtaaaactggaagatgttgaatcgttttttgc

SEQ ID NO: 39574 - protein, 145 aa, Panicum virgatum
  misc_feature: Ceres CLONE 1998788
  misc_feature (23)..(94): Pfam Name: La Pfam Description: La domain
SPKRDSHGNPRRRRRRHPARRSQGQVEFYFSDSNLPRDGFLRRSVQESEDGLVSLALICSFSRMRSHLGFEGEVKPDTVPEETVLAVAEVLRRSSSLRISEDGKKVGRAKELLEPDEVIEQVDSTTIAASPLPYNVKLEDVESFF

SEQ ID NO: 39575 - DNA, 1316 bp, Panicum virgatum
  misc_feature: Ceres CLONE 1998812
  misc_feature: Encodes the peptide sequence at SEQ ID NO. 39576
caaatccatcaccgcgtcgtccaagcctgtccgtcagactgtagcagccgcgactcgactcgtcgcgcgcccctcgccttctccgcctggtcgtccccgtccccgtccccacccccgccgcgccgcgccgagcgagcccaaccggaagcccgggctcggccgcccccccccccccccaccctcctgccgcggctatggcggtgcgcgcgacggtctcccgcttcccggccacgctggaggcgctggagtcgtgcgccgtccagtggggcgtcgccgtgacgcccttcgccgccgccgacgagcgcggccagcccccgacctccggctccggcggcgaccgcgtcccgcgctgcgagcactgctgggcctacttcagcagccactgcgatctggagcgctggggctggtcctgcgcgctctgcggcacgctcaacggattcgacgacgacaccgcgcgccggttccagcaccccgacgcgtgccccgagctcaactcctctttcgtcgacctcgagatcccagtggatgaggcggagggtggaggagacggcgtgcgggcgcggcctgtttatgtggccgcagtggatctcgcatgttctgaagagttcctggaactcatcaagagtgcgcttctggctgscctagaagctcttattccgggctccctatttgggcttatgacattcagccacaagattggtctgtatgatgtccaaggtccgattccagttgtgaaaaatgtttttattccaccggacatagaggaagatggtcttcctgttgcccttgaagatgccatgcccctacttgcttttttagccccagttgacacatgcaaggatcgaatcactgctgccctggagacactgcgacctacatcttcatgggagcgaggtgctgcttcggggcaggaggaggatactgttttgcttggtggacgaggctttggaacagccatgtctgctttaattgactatctaagttcagaatatggttctacttttgctttggctcgggtgtttgcttttctgtctggtgcacctgattatggagctggtctgctagacaccaggagatatggggagcagtatgctagtaagggggtagatgctgaccttgcattgctccctgaacagatacctttctacagagacctagcagctgttgctgttcaagcaggagtatgcatagacatatttgctgtaactgatgagtacactgatttggcttcactgaagtttttgagtattgaaagtggtggatcattatttctctatgcaaatacagatgattcaaacacttccccaagacatata

SEQ ID NO: 39576 - protein, 373 aa, Panicum virgatum
  misc_feature: Ceres CLONE 1998812
  misc_feature (121)..(365): Pfam Name: Sec23_trunk Pfam Description: Sec23/Sec24 trunk domain
  misc_feature (49)..(86): Pfam Name: zf-Sec23_Sec24 Pfam Description: Sec23/Sec24 zinc finger
  misc_feature (149)..(149): Xaa is any aa, unknown, or other
MAVRATVSRFPATLEALESCAVQWGVAVTPFAAADERGQPPTSGSGGDRVPRCEHCWAYFSSHCDLERWGWSCALCGTLNGFDDDTARRFQHPDACPELNSSFVDLEIPVDEAEGGGDGVRARPVYVAAVDLACSEEFLELIKSALLAXLEALIPGSLFGLMTFSHKIGLYDVQGPIPVVKNVFIPPDIEEDGLPVALEDAMPLLAFLAPVDTCKDRITAALETLRPTSSWERGAASGQEEDTVLLGGRGFGTAMSALIDYLSSEYGSTFALARVFAFLSGAPDYGAGLLDTRRYGEQYASKGVDADLALLPEQIPFYRDLAAVAVQAGVCIDIFAVTDEYTDLASLKFLSIESGGSLFLYANTDDSNTSPRH

SEQ ID NO: 39577 - DNA, 1082 bp, Panicum virgatum
  misc_feature: Ceres CLONE 1998813
  misc_feature: Encodes the peptide sequence at SEQ ID NO. 39578
acggcgcaccgccccccgaccccaaggaccaggccgatatatcgccgcatccccgctgcctcccgtcggctcgcgaaagcgctttgcggagacgacgacgaagcgagaagacgaggcgccgctgctacgaccgagcttccggaggccttgcccccgccccgccgcagggtttgattgtgatctagatctagcctgtactggtcggtagctgagcgcgaatcgacgatgagcgtggtggggttcgaccttggcaatgagagctgcatcgtcgccgtcgcgcggcagcgcggcatcgatgtggtcctcaacgaggagtcgaagcgggagaccccagccatcgtctgcttcggggacaagcagcggttcatcggcaccgccggcgccgcgtcctctaccatgaaccccaagaactcaatctcgcagatcaagcgattgctgggccgcaagttttctgatcccgagctccagaatgatctcgcctccttcccgttccgtgtcacggagggccccgacgggtttcccctggtccatgtgcggttcctgggcgaggagcggacgttcacccccactcagctgcttgccatggtgctgtcaaatctgaagggcattgctgagggaaacctgaaggctgcggttgttgactgctgcatcggcatccctgtgtacttcagtgacttgcagcgcagggctgtccttgatgccgctactattgcaggcctccggccattgcggttattccatgagacaactgccacagcattggcttatggtatttacaagactgatctcccagagcatgaccagctcaacgtcgcatttgttgatgtcggtcatgctagcatgcaggtcagcattgtcggttacaagaagggacagctcaagatgctgtcgcatgcatatgaccgttcacttggtgggagggattttgatgaggccctctttaagcactttgcggccaagttcaaagaggagtataagatcgatgtgtaccagaatgcccgcgcatgccttaaattgcgtgtagcctgtgagaagttgaagaagatgctcagccccaacccggaggcaccactgaatataga

SEQ ID NO: 39578 - protein, 285 aa, Panicum virgatum
  misc_feature: Ceres CLONE 1998813
  misc_feature (3)..(285): Pfam Name: HSP70 Pfam Description: Hsp70 protein
MSVVGFDLGNESCIVAVARQRGIDVVLNEESKRETPAIVCFGDKQRFIGTAGAASSTMNPKNSISQIKRLLGRKFSDPELQNDLASFPFRVTEGPDGFPLVHVRFLGEERTFTPTQLLAMVLSNLKGIAEGNLKAAVVDCCIGIPVYFSDLQRRAVLDAATIAGLRPLRLFHETTATALAYGIYKTDLPEHDQLNVAFVDVGHASMQVSIVGYKKGQLKMLSHAYDRSLGGRDFDEALFKHFAAKFKEEYKIDVYQNARACLKLRVACEKLKKMLSPNPEAPLNI

SEQ ID NO: 39579 - DNA, 109 bp, Panicum virgatum
  misc_feature: Ceres CLONE 1998813-R
  misc_feature: Encodes the peptide sequence at SEQ ID NO. 39580
acaaaaccgaagccagccccgaagccgcagaccccaccaccacagacaccgccgccgcagccggaaacccaagcaccggagccccaaacaccagagcagcaacaaaacg

SEQ ID NO: 39580 - protein, 36 aa, Panicum virgatum
  misc_feature: Ceres CLONE 1998813-R
  misc_feature: Useful for making plants with altered carbohydrate content
  misc_feature: Useful for making plants with modulated nitrogen use efficiency
  misc_feature: Useful for making plants with altered cell wall content and/or composition
  misc_feature: Useful for making plants with modulated cold sensitivity
  misc_feature: The sequence is a functional homolog of SEQ ID NO 824 in the 10/374,780 US patent application
TKPKPAPKPQTPPPQTPPPQPETQAPEPQTPEQQQN

SEQ ID NO: 39581 - DNA, 710 bp, Panicum virgatum
  misc_feature: Ceres CLONE 1998819
  misc_feature: Encodes the peptide sequence at SEQ ID NO. 39582
aaaaaaaaaaaaaaaaaaaacgctcgcgaaaatcacaaatcaagatgtgggggaaggggaagaagcgcttcggcggcggaggcgggggcgagccggcggccaagcgccaggccgccggggacgaggggccctctgaatccgccgaagacggcaccgtcgtggccgagatatcgaagaacaggaaggtgtccgtgaggagctggaagggcaaggtctacgtcgacatgcgcgagttctacgtcaaggacggcaagaccctcccttcccgcaaaggtaccgccagcgccttctccccccgcattgctattctgttattcctgtcgactggactgtttcctagcagcgcctcgcatgtccgagtagagcgctccaaggccatgcgtcttgcacgatttgttgtcttagatggatttgctctaggtctcgacaaaggacgatggtgggtttattgtagaaatcaataaaatgggatgaatggctttgttaactacctccccgcggtaaaggaccattttagttttaatggattgatgcaatttttatttgaaccgcatgtgaatctttaacatatgcagttctaatatttgcctagttagtgtacaatgatggtcttgtgagaggcattcaaagtacatcaaaccaggtatatttatcatgttaagcaggatgagtttcagcactaggtaacagccatttgttagatgaatcgg

SEQ ID NO: 39582 - protein, 139 aa, Panicum virgatum; identical to SEQ ID NO: 20005
  misc_feature: Ceres CLONE 1998819
  misc_feature (12)..(82): Pfam Name: PC4 Pfam Description: Transcriptional Coactivator p15 (PC4)

SEQ ID NO: 39583 - DNA, 692 bp, Panicum virgatum
  misc_feature: Ceres CLONE 1998824
  misc_feature: Encodes the peptide sequence at SEQ ID NO. 39584
tctccgactctccattccagcctccgcaagatctgctcctcgcgctccccctccctggcgtgccccgcacggcccgatccacccctcgagcgcggcccccgaagtcccccggcgatggtcgtgtgcaaatgccgcaaggcgacgagggtttactgcttcgtccaccaggttcctgtgtgcggcgagtgcatatgcttcccggagcatcagctgtgcgtggtaaaaaactatgctgaatgggttgttaattcggattatgattggccacaacattgttcatcttgcaattcagttctgaaagctggaagtgaagaaaccacacgcttgggttgcttacatgtgatgcacacaaaatgcttgatatcacatatccaaagttttccaacccaaacagcaccagctggatatgtctgcccctcgtgttccacgcctatatggccaccgtcaagcattaaagatacaggttctcgccttcatgcaaaactgaaagaagcaataatccagactggattggagaagaatgtatttggaaatcattttgtgacaatatctaaagctgatactcggacccctcctgcttttgcgtcagatcctcttaaacatttatccagttctggtgatagagaatcaaatggtgcaaacataattagttcagctcaagatgcgcctttgccatcaacactgcattctgc

SEQ ID NO: 39584 - protein, 192 aa, Panicum virgatum
  misc_feature: Ceres CLONE 1998824
  misc_feature (54)..(103): Pfam Name: zf-C3HC4 Pfam Description: Zinc finger, C3HC4 type (RING finger)
MVVCKCRKATRVYCFVHQVPVCGECICFPEHQLCVVKNYAEWVVNSDYDWPQHCSSCNSVLKAGSEETTRLGCLHVMHTKCLISHIQSFPTQTAPAGYVCPSCSTPIWPPSSIKDTGSRLHAKLKEAIIQTGLEKNVFGNHFVTISKADTRTPPAFASDPLKHLSSSGDRESNGANIISSAQDAPLPSTLHS

SEQ ID NO: 39585 - DNA, 705 bp, Panicum virgatum
  misc_feature: Ceres CLONE 1998829
  misc_feature: Encodes the peptide sequence at SEQ ID NO. 39586
acctcacacggtcacaccccgaaggccgcggagcctaaacccccttctgaccccccactgccacttgccaccactccgcgtcggagcgtcgccctccgccgcctccccgaacggctccggaacctttcagattgtagggggggtcgtcctcggcgtcggcgagggcgatggaggtcagggggctggggcagctcctggcggcgctggccgcggcgctcttcgtccgcgccatcgccgggcccgggcccgccctcctcccgccggcggaggacgacgagaccgacgcggaggccggcgggggaggaggcggcggcgtccagcccgtgaccatccggtgggcccgcatcacgtgcgcgctgaagaacaagcgcggggaagtggcaaggttcctgctgtcaaatgtgtctggggaggcgaaaccagggaggctgctagcgcttatggggccatccggctctggcaaaacaactctgctcaatgtgttggcagggcagctcacagcatcgccttccttgcatctttcagggtatctgtatgtcaatggtcagcctatctcgaagagcggttataagattgctttcgtgaggcaggaagacctgttcttctcgcagcttactgtgcgggagacactctcacttgctgctgaactccagcttcctgaaacgtgggctcctgagaggaaggggcactatgtaaaatgacttt

SEQ ID NO: 39586 - protein, 177 aa, Panicum virgatum
  misc_feature: Ceres CLONE 1998829
  misc_feature: SWISSPROT Homolog: EC 3.6.3.36 Taurine-transporting ATPase
MEVRGLGQLLAALAAALFVRAIAGPGPALLPPAEDDETDAEAGGGGGGGVQPVTIRWARITCALKNKRGEVARFLLSNVSGEAKPGRLLALMGPSGSGKTTLLNVLAGQLTASPSLHLSGYLYVNGQPISKSGYKIAFVRQEDLFFSQLTVRETLSLAAELQLPETWAPERKGHYVK

SEQ ID NO: 39587 - DNA, 1392 bp, Panicum virgatum
  misc_feature: Ceres CLONE 1998867
  misc_feature: Encodes the peptide sequence at SEQ ID NO. 39588
accacttcgtcttcctcctccaatccccccatccccatcgccgccgtccctttctccctccctcctccctcgctggctagctcctccgacgtcctcactcttttaatctctcactgtttgatcggcgagctgagctcggggtcgatcaatcggctagcgcgtgtgtgacgaagaggaagaagatcggatcggacggagctagccagcgagcagccggccgggtcgcagaggcgtagattcaagctcggggacggtcggtggagcgagaagggaaggggcaggcgcgttcatggtgagattctagggttcatgggaggagcagggtatagcttgcaatagcaggctggctatgcccggcgggatgatgatcccggccggccggaacatgccggcggcgggcatgatcggcggcctcgccagctacgccgcctcccttggccagaacatgatggatgggcagcatcagctcgcggtgatgcaacagcagcagcatcagaaccatggccagcagcagcaggcggccacaaccgggagtgacatgtgcggcccgcaccacaaggagttgctgatggagagcaagtccggcagcgacaacatggagggcggcgttggatcaggctctggcggggaggagctgcaggaggacctcagccttcagaggccccgcaagaagcgctaccaccgccacacccagcaccagatccaggagctcgaagcgttcttcaaggagttcccacaccctgatgacaagcagaggaaggagctgagccgggagctgggcctggagcctctccaagtcaagttctggttccagaacaagcgcactcagatgaagacgcagcaggagcggcaggagaacactcagctgcgggcagagaatgagaagctgcgcgctgagaacgcgcgctacaaggatgcactcaccaatgctgcctgccccaactgtggcggacctgccaccgccgtcatcggggagatgtccttcgacgagcaccatctccacattgagaacatgcgcctccgcgatgagattgaccgcatctccgccatcgctgccaagtatgtcggcaagcccatcgccagcatgctgcccaactcatccaacaactcctcagttgcagttgcgccgtaccctccgccgctctcctcccaccacctcatcaccgcagcaggggacatgtttggcagcctccaccatcatggagctgcggcaggatttgacaagccgctggtgatcgagctcgccgtggccgctatggaggagctggtgcgcatggcccagctcggcgagccgctctgggtccccgccctcatcgatggcactgccactgaaactcttaacgaggaggagtacgcccgtggattccccagaggtgttggccccaagtcacc

SEQ ID NO: 39588 - protein, 347 aa, Panicum virgatum
  misc_feature: Ceres CLONE 1998867
  misc_feature (107)..(163): Pfam Name: Homeobox Pfam Description: Homeobox domain
  misc_feature: The sequence is a functional homolog of SEQ ID NO 244 in the 10/412,699 US patent application
  misc_feature: The sequence is a functional homolog of SEQ ID NO 424 in the 11/435,388 US patent application
  misc_feature: The sequence is a functional homolog of SEQ ID NO 519 in the 11/479,226 US patent application
  misc_feature: The sequence is a functional homolog of SEQ ID NO 58 in the 10/286,264 US patent application
  misc_feature: The sequence is a functional homolog of SEQ ID NO 2670 in the 10/374,780 US patent application
  misc_feature: The sequence is a functional homolog of SEQ ID NO 334 in the 10/225,066 US patent application
  misc_feature: The sequence is a functional homolog of SEQ ID NO 666 in the 11/435,388 US patent application
  misc_feature: The sequence is a functional homolog of SEQ ID NO 2324 in the 10/374,780 US patent application
  misc_feature: The sequence is a functional homolog of SEQ ID NO 246 in the 10/412,699 US patent application
  misc_feature: The sequence is a functional homolog of SEQ ID NO 522 in the 11/479,226 US patent application
  misc_feature: The sequence is a functional homolog of SEQ ID NO 596 in the 11/435,388 US patent application
  misc_feature: The sequence is a functional homolog of SEQ ID NO 716 in the 10/225,066 US patent application
  misc_feature: The sequence is a functional homolog of SEQ ID NO 80 in the 10/286,264 US patent application
MPGGMMIPAGRNMPAAGMIGGLASYAASLGQNMMDGQHQLAVMQQQQHQNHGQQQQAATTGSDMCGPHHKELLMESKSGSDNMEGGVGSGSGGEELQEDLSLQRPRKKRYHRHTQHQIQELEAFFKEFPHPDDKQRKELSRELGLEPLQVKFWFQNKRTQMKTQQERQENTQLRAENEKLRAENARYKDALTNAACPNCGGPATAVIGEMSFDEHHLHIENMRLRDEIDRISAIAAKYVGKPIASMLPNSSNNSSVAVAPYPPPLSSHHLITAAGDMFGSLHHHGAAAGFDKPLVIELAVAAMEELVRMAQLGEPLWVPALIDGTATETLNEEEYARGFPRGVGPKS

SEQ ID NO: 39589 - DNA, 672 bp, Panicum virgatum
  misc_feature: Ceres CLONE 1998867-R
  misc_feature: Encodes the peptide sequence at SEQ ID NO. 39590
gcggggaccccggactacgtggcgctgctgccgtcggggttcgccatcctgcccgacgggcccggcgccggcgccggcgggtcgctgctcaccgtggcgttccagatcctagtggactccgtccccaccgccaagctctccctcggctccgtcgccaccgtcaacagcctcatcgcctgcaccgtcgagcgcatcaaggccgccctcgctgccgacaacaccgccgccggcggcggcgcccggtgaccaccaccgtatggcctgcagggggatgagcgaatctggagacggatgaagagcgggtcgaatcaaaaatcaaaccagatggaatcgagattcgggaggatccggcaaatgcggggagtcaagaacgcaccgcgtgctctccttgcaaggtgttgccctcgtgattcggaggtagtaggcgaggggcgcaacatcctgcaagggggttggttcgggcattgactctcttcctcttcctatctctctctccgcccatccgatcgacctgccactcttttctccaggggttgtagcacaagttcatcagcttaattagcatctagaccatgcaagcatagtagctttttattggactagttcttccgttataatgtgtctgtacctgctgtgttctcttctctgcgtgcatggaggttaattcgactc

SEQ ID NO: 39590 - protein, 81 aa, Panicum virgatum
  misc_feature: Ceres CLONE 1998867-R
  misc_feature: The sequence is a functional homolog of SEQ ID NO 2324 in the 10/374,780 US patent application
  misc_feature: The sequence is a functional homolog of SEQ ID NO 246 in the 10/412,699 US patent application
  misc_feature: The sequence is a functional homolog of SEQ ID NO 522 in the 11/479,226 US patent application
  misc_feature: The sequence is a functional homolog of SEQ ID NO 596 in the 11/435,388 US patent application
  misc_feature: The sequence is a functional homolog of SEQ ID NO 716 in the 10/225,066 US patent application
  misc_feature: The sequence is a functional homolog of SEQ ID NO 80 in the 10/286,264 US patent application
  misc_feature: The sequence is a functional homolog of SEQ ID NO 92 in the 10/666,642 US patent application
  misc_feature: The sequence is a functional homolog of SEQ ID NO 2656 in the 10/374,780 US patent application
  misc_feature: The sequence is a functional homolog of SEQ ID NO 326 in the 10/225,066 US patent application
  misc_feature: The sequence is a functional homolog of SEQ ID NO 70 in the 10/286,264 US patent application
  misc_feature: The sequence is a functional homolog of SEQ ID NO 1024 in the 10/225,066 US patent application
  misc_feature: The sequence is a functional homolog of SEQ ID NO 2886 in the 10/374,780 US patent application
  misc_feature: The sequence is a functional homolog of SEQ ID NO 434 in the 10/666,642 US patent application
  misc_feature: The sequence is a functional homolog of SEQ ID NO 1030 in the 10/225,066 US patent application
  misc_feature: The sequence is a functional homolog of SEQ ID NO 144 in the 10/286,264 US patent application
  misc_feature: The sequence is a functional homolog of SEQ ID NO 2338 in the 10/374,780 US patent application
  misc_feature: The sequence is a functional homolog of SEQ ID NO 280 in the 10/412,699 US patent application
AGTPDYVALLPSGFAILPDGPGAGAGGSLLTVAFQILVDSVPTAKLSLGSVATVNSLIACTVERIKAALAADNTAAGGGAR

SEQ ID NO: 39591 - DNA, 1356 bp, Panicum virgatum
  misc_feature: Ceres CLONE 1998878
  misc_feature: Encodes the peptide sequence at SEQ ID NO. 39592
ccttttctccagccatccagccgtcgcctcaccaactccccctgtctcggttagcgtggagagagaaagggtggcgagcgaggtcaggtcaagccacaagccggagccgagaacagctcaacagcaggggaggccgaggaaaaggggaggcgtggccgcgtgggaggcccgccctcgagggagccagagccaccgcggctgccgtgcgcggagcaaaagcctgcatctggatcaggtgtccccttcgcgccgctccctgctcccgccgccgccacccggggccgccgccgagcggagatccgccccggggcctgggcgcaggctggtctctggctctctgccttcgctggtacaattcgtttgattacctcctaaattctcgatccccgttttcacatgagtacaagggacaaaaagtgcagcaattgtgactagaggctcgtgcttttgagtaattaaggagggatacatgcgtaacgaaaccctgattctggaatggtgtccagtcgaaggagcagcgggattatcatacgggaagggtctagaaactggtctgagttcaatgatccctcgccgtctccamaactgctgtattcacagtcctatgttgcattgagggggttggtggcctcagtgatatccttggactttttcctgttgtcaagcaagctaaaatctgcatgggcaggtatgacgtcccagaggcatattcgatctcaggagagatcaaaatcaaggggattgaactgcaagagggttgtggttcatctgctattgtgtttcatggttggcattttcattggattcatgccattcttctcagttgatgtttataagaaaattgtctctgaaaatgagaggcttccgttccatgagagtgtggttgagacggagatgatggatactaaagttaaggagttggagacagttgtagtagagaaagaggttgaactgattgatgagccagaagttggagagagtcctccagttcctgcaatgttggatgacgaggcagattttgctgaatcaacacgtgcattacctgctattgaagattccgatatcagtgtgaagaagctgctgataattgtgacaattacttctgttcggccacaacaggcatattacttgaatcggctagcccatgttttgaaagctgtacaagcacctctactgtggttagtggtggaatggcctgaacagtcctatgaaacaacagaaattttgaggtcttctgggattatgtacaggcatcttatatgtagaaagaatactacaagtgggcgaaagattgctgtctgtcaaaggaataatgcaatctatcatgtcaaaaagcatcacctggatggtataatg

SEQ ID NO: 39592 - protein, 286 aa, Panicum virgatum
  misc_feature: Ceres CLONE 1998878
  misc_feature: Useful for making plants with altered carbohydrate content
  misc_feature (30)..(30): Xaa is any aa, unknown, or other
MVSSRRSSGIIIREGSRNWSEFNDPSPSPXLLYSQSYVALRGLVASVISLDFFLLSSKLKSAWAGMTSQRHIRSQERSKSRGLNCKRVVVHLLLCFMVGIFIGFMPFFSVDVYKKIVSENERLPFHESVVETEMMDTKVKELETVVVEKEVELIDEPEVGESPPVPAMLDDEADFAESTRALPAIEDSDISVKKLLIIVTITSVRPQQAYYLNRLAHVLKAVQAPLLWLVVEWPEQSYETTEILRSSGIMYRHLICRKNTTSGRKIAVCQRNNAIYHVKKHHLDGI

SEQ ID NO: 39593 - DNA, 1329 bp, Panicum virgatum
  misc_feature: Ceres CLONE 1998898
  misc_feature: Encodes the peptide sequence at SEQ ID NO. 39594
acactgcagctgcagacccctcacactgactgacacatcatctcgcgatagctccatgcagctgaagctctgctcggaggtgcaggtgcctgggcgtggttgagccggccggagcagtagatcgccgggaggtgctcgatcgcgcggtgaccgccgacgcaccggtcggtcgtgatggcggcgacggcgaggaagctgatcgtggaggtggtggaggcgcgggacctgctgcccaaggacgggaccggcacgtcgagcccctacgcgcgcgccgacttcgacgggcagcgccgcaagacgcgcacggtgaccagggacctcaacccggcgtggaacgaggcgctcgagttcgacttccccgccgccggcgtcggcgtcgaccccgtcgcgggggagccgctcgaggtcgccgtcctgcacgacgtccgcgtcgggcccagccggcggaacaactttctcggccgcgtccgcctcgacgcgcgccagttcgtgcgcaagggcgaggaggcgctcatctacttcccgctccagaagaagagcctcttcaactgggtccgcggcgagatcgggctcaaggtctactacgtcgacgtgccgctcgcgccgccggagccggagccaccagccgttggtgatgccgctccagatgccgcggcggcggaagcagaagcaccaccgccgccgcccgttgctccgaaggaggcttctgcggatgagccgccgaaggaggaggagccggcggacgaagctccggcgccacagccggaaccggcggcagaggctgcatccggcgacggatccaccacggagaagccacctgaggaggctgaccccgcagcggcgaccccggcaccaaaagctgcacacgaaatggcggcagaggcggcggtggcagcaccagaggagaagccaccggaagaggagccggtgctgagcccgccaccgcagccgacgccgacaccgatgccgcggcaggtatccatgcctgtgcgaaggccgccgccgccgcctccaccggaggagccggtggagcggagcaagcacgatctggtggacaagatgccgtacctgttcgtccgggtggtgcgcgcgcgggggctgcccgccggcgcgcacccgcacgtccgcgtggccgccggcggcatccacgcgtccacgcgagaggcgcgccgcggcgcctttttcgagtgggaccagaccttcgcgttcgtgcgcgacccggacaccgattcgccaggccccacgctcgaggtctccgtgtggaacctcccgcccgacgccgacgtgtccgtcgccgacgatcgccacttcccttggcggcctctgctt

SEQ ID NO: 39594 - protein, 384 aa, Panicum virgatum
  misc_feature: Ceres CLONE 1998898
  misc_feature (8)..(99): Pfam Name: C2 Pfam Description: C2 domain
  misc_feature: SWISSPROT Homolog: EC 2.7.11.13 Protein kinase C
MAATARKLIVEVVEARDLLPKDGTGTSSPYARADFDGQRRKTRTVTRDLNPAWNEALEFDFPAAGVGVDPVAGEPLEVAVLHDVRVGPSRRNNFLGRVRLDARQFVRKGEEALIYFPLQKKSLFNWVRGEIGLKVYYVDVPLAPPEPEPPAVGDAAPDAAAAEAEAPPPPPVAPKEASADEPPKEEEPADEAPAPQPEPAAEAASGDGSTTEKPPEEADPAAATPAPKAAHEMAAEAAVAAPEEKPPEEEPVLSPPPQPTPTPMPRQVSMPVRRPPPPPPPEEPVERSKHDLVDKMPYLFVRVVRARGLPAGAHPHVRVAAGGIHASTREARRGAFFEWDQTFAFVRDPDTDSPGPTLEVSVWNLPPDADVSVADDRHFPWRPL

SEQ ID NO: 39595 - DNA, 669 bp, Panicum virgatum
  misc_feature: Ceres CLONE 1998898-R
  misc_feature: Encodes the peptide sequence at SEQ ID NO. 39596
ggcgaccgcgatggcgcacgccgtgctggtcctcctcgcgtggcacccggacctcgtggtgccgacggtcacgctccacgtcgccgccgtgggcgtgtggaagtacaggcgcaggccgcgcgcgccggcgccgcacccgtgcgtgcgcgcgtccatggcggaggcgccggacagggaggagctggacgaggagttcgacacgattccgagcgcgaggccgccggaggtggtgcgggcgcggtacgaccgcgccaggatggtgggcgcgcggctgcagcagatggtcggcgacgtcgcgacgcaggcggagaggttgcaggcgctcgtgtcgtggcgcgacccgcgcgccaccgggatgttcgtcgcgctgtgcgtcctcgtggccatggtgctgtacatggtgcccatcaagatggtggccgtggtcgccgggttctactacctccggcacccgatgttccgggaccggatgccggcgccggtgatcaacttcttccggcggctgccttccatgtctgaacgaatcatgtaggagcaagcaagcagtagcagcgtggcatcagttggccacttctggagagccgagagaccacatatgcagtaccagttatactttagcagcaacatgttaatgcatacttcttgagcagaataaagcaattttctttc

SEQ ID NO: 39596 - protein, 176 aa, Panicum virgatum
  misc_feature: Ceres CLONE 1998898-R
  misc_feature (20)..(176): Pfam Name: PRT_C Pfam Description: Plant phosphoribosyltransferase C-terminal
ATAMAHAVLVLLAWHPDLVVPTVTLHVAAVGVWKYRRRPRAPAPHPCVRASMAEAPDREELDEEFDTIPSARPPEVVRARYDRARMVGARLQQMVGDVATQAERLQALVSWRDPRATGMFVALCVLVAMVLYMVPIKMVAVVAGFYYLRHPMFRDRMPAPVINFFRRLPSMSERIM

SEQ ID NO: 39597 - DNA, 695 bp, Panicum virgatum
  misc_feature: Ceres CLONE 1998900
  misc_feature: Encodes the peptide sequence at SEQ ID NO. 39598
accaatccattccacccccgttcaccccgtccatttgatttgcgtttagtgcgttgcgtttcttgggtttctcctagttcggaaggagcacctccttcctctggcactcttgttctccgctcggagaaaggcttgaggacccaagaagaggataacaatgggggaagctgccggcgaccgcgtcctgagcgcgagaagctgaaggatggtgcctttgaggacgtcctgagggcagctcaggaagctattgttatccccccatgggttgcactcgccatccgccctaggcctggtgtctgggagtatgtgagggtcaatgtcagcgagctcgcggttgaggagctgagagtccctgagtacctgcagttcaaggaacagcttgtggaagaaggccccaacaacaactttgttcttgagctggacttcgagccattcaatgcatccttcccccgtccttctctgtccaagtccattggcaatggtgtgcagttcctcaacaggcacctgtcgtcaaagctcttccatgacaaggagagcatgtaccccctgctcaacttccttcgcgcccacaactacaaggggatgaccatgatgttgaacgacagaatccgcagcctcagtgctctccaaggttctctgaggaaggctgaggagcatctgtccagtcttccagctgataccccatactctgactt

SEQ ID NO: 39598 - protein, 231 aa, Panicum virgatum
  misc_feature: Ceres CLONE 1998900
  misc_feature (9)..(231): Pfam Name: Sucrose_synth Pfam Description: Sucrose synthase
  misc_feature: SWISSPROT Homolog: EC 2.4.1.13 Sucrose synthase
  misc_feature: Useful for making plants with altered carbohydrate content
  misc_feature: The sequence is a functional homolog of SEQ ID NO 2 in US patent 7091398
  misc_feature: The sequence is a functional homolog of SEQ ID NO 12 in US patent 7091398
  misc_feature: Useful for making plants with altered cell wall content and/or composition
TNPFHPRSPRPFDLRLVRCVSWVSPSSEGAPPSSGTLVLRSEKGLRTQEEDNNGGSCRRPRPEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGSLRKAEEHLSSLPADTPYSD

SEQ ID NO: 39599 - DNA, 674 bp, Panicum virgatum
  misc_feature: Ceres CLONE 1998904
  misc_feature: Encodes the peptide sequence at SEQ ID NO. 39600
aagaggttcccttcgcccggtcatcgttaaaccatgatgacgtgtttgtcttagatactgaaaataagatataccagtttaatggtgctaactccaatatccaagaaagggccaaagcattggaagtgatccaatatttaaaagagaaatatcatggtggtgtgtctgatgttgcaatcgtcgatgatgggaagttacaagcagagtcagactctggtgaattctgggtcctttttggaggttttgcaccaatagggaaaaaacctgtgagtgatgacgatgttgtacttgaaactacggcaccaaagctctacagcatcaatgatggtcaactgaagctggaagaggcagctcttacaaaagctatgcttgaaaataccaaatgtttcttacttgattgtggggctgaaatatatgtatgggttggccgggtaactcaaatggaggatagaaaatctgccaccaaagcggttgaggaattccttattaatcaaaagcgtccaaagacaacaagagttacacaagtcattcaaggttatgagagtcatgctttcaagtccaagtttgaatcatggccagtgggcaatgctgctgggagccctggcgtagaggaagggaggggaaaagttgcagctttgttgaaacacaaggtgttgatgtaaagggagctgcaa

SEQ ID NO: 39600 - protein, 219 aa, Panicum virgatum
  misc_feature: Ceres CLONE 1998904
  misc_feature (109)..(185): Pfam Name: Gelsolin Pfam Description: Gelsolin repeat
  misc_feature (1)..(75): Pfam Name: Gelsolin Pfam Description: Gelsolin repeat
EVPFARSSLNHDDVFVLDTENKIYQFNGANSNIQERAKALEVIQYLKEKYHGGVSDVAIVDDGKLQAESDSGEFWVLFGGFAPIGKKPVSDDDVVLETTAPKLYSINDGQLKLEEAALTKAMLENTKCFLLDCGAEIYVWVGRVTQMEDRKSATKAVEEFLINQKRPKTTRVTQVIQGYESHAFKSKFESWPVGNAAGSPGVEEGRGKVAALLKHKVLM

SEQ ID NO: 39601 - DNA, 593 bp, Panicum virgatum
  misc_feature: Ceres CLONE 1998909
  misc_feature: Encodes the peptide sequence at SEQ ID NO. 39602
attaaaccactcctcctcgcgaacgccactgctgctgccccaacgcggctcaacagctccaccggccatgaaccgcctcctccgggccctcgccgccctcctcctcctcgcggccgtcgccgtcgccgacgacggggcaacactgctggagatcaagaagtccttccgcaacggaggcaacgcgctgcacgattggtccggcgacggcgcgtcgctgggctactgctcttggcgcggcgtgctatgcgacaacgtcaccttcgctgttcgggcgctcaacctctcggggctcaatctcgagggtgaaacctcaccagctattgggagcctgaaacgtgttgtctcaatagatttgaagtcgaatggactttccgggcagatccctgatgagattggcgattgttcgttgcttgaaactctggacttgtcctctaaccatctagaaggagacataccattctccgtatctaagctgaagcaccttgagaacttgatcttgaagaacaaccagctggttggggtgataccatctacactctctcaacttccgaatttgaagatattggacttggctcagaacaagctaagtgggt

SEQ ID NO: 39602 - protein, 175 aa, Panicum virgatum
  misc_feature: Ceres CLONE 1998909
  misc_feature (19)..(61): Pfam Name: LRRNT_2 Pfam Description: Leucine rich repeat N-terminal domain
  misc_feature: SWISSPROT Homolog: EC 2.7.11.1 Non-specific serine/threonine protein kinase
MNRLLRALAALLLLAAVAVADDGATLLEIKKSFRNGGNALHDWSGDGASLGYCSWRGVLCDNVTFAVRALNLSGLNLEGETSPAIGSLKRVVSIDLKSNGLSGQIPDEIGDCSLLETLDLSSNHLEGDIPFSVSKLKHLENLILKNNQLVGVIPSTLSQLPNLKILDLAQNKLSG

SEQ ID NO: 39603 - DNA, 658 bp, Panicum virgatum
  misc_feature: Ceres CLONE 1998914
  misc_feature: Encodes the peptide sequence at SEQ ID NO. 39604
aattttcgacacagctgctgccatctctcatcatcggtcctgctcctccccgtcgacgccccgtttgtgcgcgccatggagatctcgctcgagcgcttcgtcgcaccccacttcgtgtggaatctccttggggtcggctgccaccgtagaagaaagatggagctgctcagcatcattctattcgttacatctttgctcccgttttcagcatcttatcttcaaggtcttgtattgtacgacatgaagctgaaactgaaagctaccggcagcaatcagctttctgattggacctctgatgatgttttaggctgcgttttcagtcatgtcacttgtgatataaacaacaatgtcgttgaagtaaaattggcttctatgggacttactggagttttatcatcaagaattggagagctggagtatttgagtgctttgtaagtgaactttttcagattgatagaatttagatgttatgtggtgataagtatgtggtaaattctcagcatgagctatttctatgcttcctaaaaataatagccgtgcttatatgtgatgtgaccatactctccagagtttactatatagtatatgatactgcatggttgtagagccactattttttagataatggaaaacagttcccgcctctgcatcccccgga

SEQ ID NO: 39604 - protein, 92 aa, Panicum virgatum
  misc_feature: Ceres CLONE 1998914
  misc_feature: SWISSPROT Homolog: EC 2.7.11.1 Non-specific serine/threonine protein kinase
MELLSIILFVTSLLPFSASYLQGLVLYDMKLKLKATGSNQLSDWTSDDVLGCVFSHVTCDINNNVVEVKLASMGLTGVLSSRIGELEYLSAL

SEQ ID NO: 39605 - DNA, 657 bp, Panicum virgatum
  misc_feature: Ceres CLONE 1998919
  misc_feature: Encodes the peptide sequence at SEQ ID NO. 39606
atcgcgcgacctcaccagcgcgaacggcgaaccccgcgaagccgccaggccactgcgccgaggggctcttccgcaagcggctatggggcggcacatttggcgacgtatacaagagacctttatgctgggttgaacatatgtcattggacaatgaaactggattagacaagccaggaataagggttaggccggtcacaggtcttgttgcagcagactattttgtacctggatattttgtttgggctgtgttaattgccaacttagctcgtattggatatgaagaaaagaccatgtatatggctgcatatgattggaggttatctttccagaacaccgaggttcgtgatcaaactttgagcagaataaagagtaacattgaactcatggtagcgacaaatggtggaaatagagttgtggtgatcccacactctatgggggtcctctattttctgcattttatgaagtgggtcgaggcacctcctcccatgggaggtggcggtggtccaaactggtgtgaaaagcatattaaagctgtactgaatattggtggacctttcttgggagttcccaaggctgttgctgggcttttctcatctgaagccaaagatgttgctgttgccagagctattgcacctgatgttctggactctgactttc

SEQ ID NO: 39606 - protein, 218 aa, Panicum virgatum
  misc_feature: Ceres CLONE 1998919
  misc_feature (17)..(217): Pfam Name: LACT Pfam Description: Lecithin:cholesterol acyltransferase
  misc_feature: SWISSPROT Homolog: EC 2.3.1.158 Phospholipid:diacylglycerol acyltransferase
RATSPARTANPAKPPGHCAEGLFRKRLWGGTFGDVYKRPLCWVEHMSLDNETGLDKPGIRVRPVTGLVAADYFVPGYFVWAVLIANLARIGYEEKTMYMAAYDWRLSFQNTEVRDQTLSRIKSNIELMVATNGGNRVVVIPHSMGVLYFLHFMKWVEAPPPMGGGGGPNWCEKHIKAVLNIGGPFLGVPKAVAGLFSSEAKDVAVARAIAPDVLDSDF

SEQ ID NO: 39607 - DNA, 695 bp, Panicum virgatum
  misc_feature: Ceres CLONE 1998924
  misc_feature: Encodes the peptide sequence at SEQ ID NO. 39608
ccgcaaggcgccacgccgcccacgtctcagaggatggaatatatgccatgaagaaggtgctgatacagagcaaggagcagttggatctggtgagggaggagatccgtgtgtcgtcattgttcaatcaccccaacctgttgccgcttcttgatcatgctataatagccgtcaagagtacacggggagattggagccatgaagcgtacctgctctttccagtccatctggatggtactttatttgacaacgctaacctcatgctgtccagaaaggaattctattcaacagctgacgttctgcaaatattccatcagatgtgtgacggactgaagcacatgcacagctttgatcctccatatgctcataatgatgtgaagcctggtaacgttcttattacccgtcgtaaaggacaagcacctgttgcaactttgatggattttggaagtgcaagacctgcaagaaagcaaatccgttctcgttctgaggcgttacagttgcaggagtgggctgctgagcattgctctgcaccttatcgtgaccctgaattatgggactgcccaagccatgctgatattgatgagaggacagacatatggtctttaggatgcaccctttacgcaatcatgtttaatgtttcaccatttgagtatgctcttggtgaatctggaggaagtttgcaacttgctatttgtcat

SEQ ID NO: 39608 - protein, 230 aa, Panicum virgatum
  misc_feature: Ceres CLONE 1998924
  misc_feature (3)..(229): Pfam Name: Pkinase Pfam Description: Protein kinase domain
  misc_feature: SWISSPROT Homolog: EC 2.7.11.1 Non-specific serine/threonine protein kinase
ARRHAAHVSEDGIYAMKKVLIQSKEQLDLVREEIRVSSLFNHPNLLPLLDHAIIAVKSTRGDWSHEAYLLFPVHLDGTLFDNANLMLSRKEFYSTADVLQIFHQMCDGLKHMHSFDPPYAHNDVKPGNVLITRRKGQAPVATLMDFGSARPARKQIRSRSEALQLQEWAAEHCSAPYRDPELWDCPSHADIDERTDIWSLGCTLYAIMFNVSPFEYALGESGGSLQLAIC

SEQ ID NO: 39609 - DNA, 625 bp, Panicum virgatum
  misc_feature: Ceres CLONE 1998933
  misc_feature: Encodes the peptide sequence at SEQ ID NO. 39610
gcaaaacatctccccaccccacctccgcctccgcctccgcctccgccattttcaaccgggcggcgatcaccgccaccgccaccgccaccgccaccgccaaggccacctcgccctccaatgcggcagtagctccgccgcctcacccagcgaagcgatggccctctccgccgcgctccgcgtcccgctcccgcgcctccttttcctcggcccctccgcctccgtcctcggcgccgcctcccgccgccgcgccgccgcggcccccgcggccaccctccggttcctcgcctcctcgtcccccaggtccgcgcccttcacctcgcgctccgcgcggcccctccgctcgcgccgccgcgaccgtgacggcgatgggcgcgcggcggccgccggcgggggtgcgggcggcggcggggagggcgacggagggggtgtggcggtcaaggagcggattgtgcccgtggagctgcacaaggaggccacggaggcatacatggcgtacgccatgtccgtgctgctcggccgcgcgctccccgacgtccgcgatgggctcaagccggtgcaccgcatgatactctatgccatgcatgagatgggtcttgcgtctcgtagaccattcagaaaatgtgcc

SEQ ID NO: 39610 - protein, 156 aa, Panicum virgatum
  misc_feature: Ceres CLONE 1998933
  misc_feature: SWISSPROT Homolog: EC 5.99.1.3 DNA topoisomerase (ATP-hydrolyzing)
MALSAALRVPLPRLLFLGPSASVLGAASRRRAAAAPAATLRFLASSSPRSAPFTSRSARPLRSRRRDRDGDGRAAAAGGGAGGGGEGDGGGVAVKERIVPVELHKEATEAYMAYAMSVLLGRALPDVRDGLKPVHRMILYAMHEMGLASRRPFRKC

SEQ ID NO: 39611 - DNA, 667 bp, Panicum virgatum
  misc_feature: Ceres CLONE 1998935
  misc_feature: Encodes the peptide sequence at SEQ ID NO. 39612
aaccatccccgcagccgcagagccccgcgccgaggtcaaagccccgccattggtggcggcgcggagatggcggcggagcgggacatcgacgacctgccgcggaacgacgccaactacacggcgctcacgccgctctggttcctcgagcgcgccgcgctgtcccacccggccagggcctccgtcgtgcacgggcccgtgcgatacacctgggccgacacctacagccgctgccgccgcctcgcctccgccctcgcgcgccggtccgtcgagcacggaagcacggtagctgtaatagctccaaatatcccagcaatttatgaagctcattttggagtgcccatggcgggggcagtggtcaattgtgtcaacattcgactaaatgctgccactgttgcatttctcttggagcactcctcggctgaagttgtgatggttgaccaagaatttttctccctggcagaggaatctttgaggattattgcagatcaaaagaaaggtgctttcaaacagccacttcttatagttattggtgatcaaacatgcgatccagcagccctccaagatgctttgagaaaaggagccatcgaatatgaggcgttcttggaaagtggtgatccagagtttgcctggaaaccaccacaggatgaatggaagagtattgcattag

SEQ ID NO: 39612 - protein, 200 aa, Panicum virgatum
  misc_feature: Ceres CLONE 1998935
  misc_feature: SWISSPROT Homolog: EC 6.2.1.26 o-succinylbenzoate--CoA ligase
MAAERDIDDLPRNDANYTALTPLWFLERAALSHPARASVVHGPVRYTWADTYSRCRRLASALARRSVEHGSTVAVIAPNIPAIYEAHFGVPMAGAVVNCVNIRLNAATVAFLLEHSSAEVVMVDQEFFSLAEESLRIIADQKKGAFKQPLLIVIGDQTCDPAALQDALRKGAIEYEAFLESGDPEFAWKPPQDEWKSIAL

SEQ ID NO: 39613 - DNA, 792 bp, Panicum virgatum
  misc_feature: Ceres CLONE 1998939
  misc_feature: Encodes the peptide sequence at SEQ ID NO. 39614
actcgtctcgtcctgctgctgcagctacctttcttcggcccccctcaaaatcctccaactaatcccaccagcttctcagctgaaatccaccccgaaacctcccggctcccgcaccttccgcccgttcgtgtgcgatcagcggctgccctgacctctcggatcgagaaaggaggctgctctggtggttcgggcggccgaatctcgcggcgactcgctcagatttggatttagggtttttggaggtggtagtgggtctgtgccgccgggagagatgtcggcggctgtggcatgcgcggagagggcgaccaacgacatgctcatcggcccggactgggccgttaacatcgagctctgcgacatcatcaacatggatcccgggcaagcaaaagatacactcaagctcctaaagaaacgtcttggaaccaagaattcaaaagtgcaaattctgacgctttatgtgctggagacactaagcaaaaattgtggggatgttgttcaccaactgattgttgaacgcgacatattaagtgaaatggttaagatagtaaagaagaagccagacttaaatgttcgggagaagatattgagtttgattgacacttggcaagtggcttttggaggtccttctggaagatatccacagtatcatgcagcttaccaagagctcagggctgcgggagttgattttccacctcgtgaggaaaattcggtcccgttatttacacctcctcaaacccagccattgagacatccacatctatatccaccagcaggtcaaagctatgaggatgc

SEQ ID NO: 39614 - protein, 173 aa, Panicum virgatum
  misc_feature: Ceres CLONE 1998939
  misc_feature (2)..(136): Pfam Name: VHS Pfam Description: VHS domain
MSAAVACAERATNDMLIGPDWAVNIELCDIINMDPGQAKDTLKLLKKRLGTKNSKVQILTLYVLETLSKNCGDVVHQLIVERDILSEMVKIVKKKPDLNVREKILSLIDTWQVAFGGPSGRYPQYHAAYQELRAAGVDFPPREENSVPLFTPPQTQPLRHPHLYPPAGQSYED

SEQ ID NO: 39615 - DNA, 634 bp, Panicum virgatum
  misc_feature: Ceres CLONE 1998951
  misc_feature: Encodes the peptide sequence at SEQ ID NO. 39616
acggccgcacccgcaccgcaaatcctctcctgctagccctcgccacccccgcctcactcgaaccgcgccgcgccccaaaccctagcgcagccgcggtgggagccgcaccgctccaatccaaccccaatagcttcggccccgattctcctgccaccccccccccccccccccctcaaaccccggccgcccttctccgcctccgccgtcctctgtaatttttggaattctgtattgggaatatttgtggtgctttttttggttgtttgtttcaggagcgcgtgtcctcggaggattcgcggcggctgggctagggttttggcgtctcggtcaagggtgcgccatctgctccgtgggatctcccggaaccaggattgctgtcagcagtcaccatgtcatcatatcctgtgctaaacaaccgaccaattgatcagtggagagttactgatctgaaggatgaactccgtaaaagaaggcttcctgtcaagggtttgaaagaggaacttgtgaggcgactttttgaatccattcagagtgaaaaagcagctgatgaagctgatgaagacgcgggagcgaatgcagatgatcagcagcctgatgccaatgctagtgaacaaactacagttaccatcacaaa

SEQ ID NO: 39616 - protein, 81 aa, Panicum virgatum
  misc_feature: Ceres CLONE 1998951
  misc_feature (12)..(46): Pfam Name: SAP Pfam Description: SAP domain
MSSYPVLNNRPIDQWRVTDLKDELRKRRLPVKGLKEELVRRLFESIQSEKAADEADEDAGANADDQQPDANASEQTTVTIT

SEQ ID NO: 39617 - DNA, 2013 bp, Panicum virgatum
  misc_feature: Ceres CLONE 1998961
  misc_feature: Encodes the peptide sequence at SEQ ID NO. 39618
ggcgacacaaacctctcccatcgctcgcttcgaacccatcgccctcctctcgcccctccgcgacgcccgaatcgagcccctgccggcatctgatccggccacggccggaccctgctccgccctcctctcgcccctcctgctccgcctcccagcctcgctccagttccgccccgccctcctctcgcccctcagcgacgtcgaatcgagcccctgctgacagctgatcttggggaccacccgccctggccacggtcggaccccgctccccctccagccgcgctcccgctccgcctcccaaccttgctccagctccgccccgccctcctctcgcccctcagcgacgccgaaccgagcccctgccggcagctaatcttggggaccaccggccccggccacggtcggcctcgcggtcgcagagagagaaagagtatgcggacctcgagtcacggagcacttcatccagaataggtgctgcgggagggtttaattgcaaaattggagggaaccgttggatcgagattagatggtgtagatggcttgattgcacgcttgcaccaaatagatgattgcataggatatgtctcctcgccaccgcggccagcctacgcccccacaccaccacgaggccgcgaaatccggcgcccccgattccgccggccgcgaaatccggcgccctctcgcgcggccgctgcgtccaccggtatgggttggtcgcggtgggagcggcgacccgcgcggctcggtctccgtggtgcggtgccgcgccgaggcggcgccgccggtgggcacggcggctagggcgccggtggggccgtacaccgggagggaccccgaggtgaagaagcccgcgtggctgcggcagcgggcggcgcagggggagaagtacgcgcgcctgcgggagtccatcggcgagctcaagctcaacaccgtctgcgtcgaggcgcagtgccccaacattggcgagtgttggaacggaggcggaggggccggcggggaaggggatggcatcgcgacggccacgatcatggtgctcggcgacacttgcacgcgcggctgccggttctgcgctgtgaagaccagcaacaagccgccaccccctgatcccctggagcctctgaacacggctttggctgttgcaagctggggagtagattatgttgtgctaaccagcgtcgatagagatgatttacctgacggtggaagtagccattttgctcagacagtgaaagctttaaaggaactcaaacctgggatactggtggagtgcttaacctctggtttccgaggtgacctggaagctgtctcatctttggcaaactccggtctagatgtctatgcgcacaacattgaaacagtgaggagtctacagcgaattgtgagggatcctcgagcaggatatgatcagagcatggcagttctcaagcatgcaaaaaattgcagggagggcatgattacaaagtcttcaatcatgcttggtcttggagagactgatgaggaggtgagacaaaccatgatggacttacgggccatatgtgttgatattcttactttgggccagtatttacagccaacagaaagacatttaacagtaagggagtatgtgactcctgagaagttccagttttggaaggagtatggagagtcggtgggtttccgttatgttgccagcggacccttggttcggtcttcataccgtgcaggagagctctttgtccaaaatttggtcagaaatagcaaaacggcatcgtcctcgtcttaaccaaatatcttctgctgaagcaatccatgggatccatacatactgtacgttaagagcaacaaaacaagagtaggacggcaaaatcattcgattctcatgaaagctgaggccggcttctgttttcttttctttcgggatgttgcatgcacacttttgctctctgctgtagttgcccctgttgaatagagaaaaacgaggataccaaatcttttctgtatcatttactttgacaccatatacggaaagctgttcgg

SEQ ID NO: 39618 - protein, 393 aa, Panicum virgatum
  misc_feature: Ceres CLONE 1998961
  misc_feature (150)..(315): Pfam Name: Radical_SAM Pfam Description: Radical SAM superfamily
  misc_feature: SWISSPROT Homolog: EC 2.8.1.8 Lipoyl synthase
MSPRHRGQPTPPHHHEAAKSGAPDSAGREIRRPLARPLRPPVWVGRGGSGDPRGSVSVVRCRAEAAPPVGTAARAPVGPYTGRDPEVKKPAWLRQRAAQGEKYARLRESIGELKLNTVCVEAQCPNIGECWNGGGGAGGEGDGIATATIMVLGDTCTRGCRFCAVKTSNKPPPPDPLEPLNTALAVASWGVDYVVLTSVDRDDLPDGGSSHFAQTVKALKELKPGILVECLTSGFRGDLEAVSSLANSGLDVYAHNIETVRSLQRIVRDPRAGYDQSMAVLKHAKNCREGMITKSSIMLGLGETDEEVRQTMMDLRAICVDILTLGQYLQPTERHLTVREYVTPEKFQFWKEYGESVGFRYVASGPLVRSSYRAGELFVQNLVRNSKTASSSS

SEQ ID NO: 39619 - DNA, 657 bp, Panicum virgatum
  misc_feature: Ceres CLONE 1998966
  misc_feature: Encodes the peptide sequence at SEQ ID NO. 39620
atccaccgcccccttctgacctccctcgcttcaaacctagcgctaggcggcggcggcggcgcgcaccaggtgttcgacggaagtccccgcccggcgggtggcccaaaggcggcggcaagatgtacgtggtgaagcgggacgggcggcaggaggcggtgcacttcgacaagatcacggcgcgcctgaagaagctcagctacggcctcagccaggaccactgcgaccccgtgctcgtcgcgcagaaggtctgcgcgggggtctacaagggcgtcaccaccagccagctcgacgagctcgcagccgagaccgccgcggccatgaccgcctcccacccggactatgcctcgctggcggcgaggattgctgtgtcgaacctgcacaagaacaccaagaagtccttctcggagacgattaaggacatgtacatgcacttcaacgagagatctgggctgatggcccctctggtcgctgacgatgtttatgaaatcatcatgaagaatgctgctcgcttggacagtgagataatttatgatagggactttgattatgactactttggcttcaagactcttgagaggtcttacctcttgaagcttgcggggaaggttgttgaaaggccacaacacatgctaatgagggtttctgtggggatacaca

SEQ ID NO: 39620 - protein, 179 aa, Panicum virgatum
  misc_feature: Ceres CLONE 1998966
  misc_feature (1)..(91): Pfam Name: ATP-cone Pfam Description: ATP cone domain
  misc_feature (141)..(179): Pfam Name: Ribonuc_red_lgN Pfam Description: Ribonucleotide reductase, all-alpha domain
  misc_feature: SWISSPROT Homolog: EC 1.17.4.1 Ribonucleoside-diphosphate reductase
MYVVKRDGRQEAVHFDKITARLKKLSYGLSQDHCDPVLVAQKVCAGVYKGVTTSQLDELAAETAAAMTASHPDYASLAARIAVSNLHKNTKKSFSETIKDMYMHFNERSGLMAPLVADDVYEIIMKNAARLDSEIIYDRDFDYDYFGFKTLERSYLLKLAGKVVERPQHMLMRVSVGIH

SEQ ID NO: 39621 - DNA, 2087 bp, Panicum virgatum
  misc_feature: Ceres CLONE 1998974
  misc_feature: Encodes the peptide sequence at SEQ ID NO. 39622
ggcaccgggagcgtgaccgtcacgagggggcgaagccccggggaagagccggagaggagatcgagagcggcccatcgcccccacaccacgccccacctccggctgcccgcctcccccgccgccgtggtccgcggctgcgggcggggccacgcgcccggctgggggtgaacagcgcgggacggggtcaccgtcgggcggtggggtgggcgaatcgatcctgcgtgcggggttgggctggccgataaaagggggcgcctttggactggcgaggcttgccgccgagacattgaagacacagtaatagaacacaaaaaatgggtaaaaagggaaagtggtttagtgctgtcaagaaagtcttcggctcctctgatccagatggaaaggaagcaaaggttgagaaggcggataagtcaaaatccaggaggagatggccatttggaaagtcgaggcactctgatccttctacctcaatggtgtcagggactgctccagtagctccgttgcctccgccaccaccaatacaacttactcagccacactcccaggagattaaagatgtcaagccagttgaaacagacagtgagcagaacaagcatgcatactctgttgcccttgcatccgctgttgctgctgaagctgctgcagttgctgcccaggccgctgctgaggttgtgcgcctcacagcagttaccacggcagcaccaaaaatgcctgttacttcaagggaagaacttgccgccatcaagattcagactgccttcaggggttatctggcaaggagagcattgcgggcactaagagggctagttagattgaagtcacttgtcgatggaaatgctgtcaagcgccaaacttctcacactttgcattgcacacaaacgatgacaagagttcaaactcaaatctactctagaagggtgaagttggaggaggaaaaacaagctcttcaaaggcagctccaattgaaacatcaaagggaacttgagaaaatgaagattgaagaagactgggatcacagccatcaatccaaagaacaaattgaggccagcctagttatgaaacaagaagctgcactaaaacgagaaagagcacttgcatatgcattttctcaccagtggagaaattctggtcgaactataaccccaactttcacagaacctgggaatcctaactggggctggagctggatggaacgctggatgacagcaagaccttgggagagccgattggcagcatcagacaaggataataaagagcgttctctgacaaagaattccagcagcagtgctgttcgaatgtctgtaccccgtgccatctcaatccagaggccagcaacaccaaacaagtcaagccgtccaccaagccggcagtcaccttcaacaccgccatcgaaggcaccatctacctcaggaaagaccaggccggcaagtccaaggggcagctggctgtacaaggaagatgacctgaggagcatcacaagcatacgctctgaacgcccaaggaggcaaagcataggcggaggctcggtccgggatgatgcaagcctgactagcacaccacctctccccagttatatgcagtcgacagagtctgcgagggcaaagtctcgataccgcagcttgttgactgaaaagcttgaggtttcagagagggcacctctggcccattcggttgttaagaagcgcctctccttccctgtcatcgacaaaccgagcagtccaccggcagataagacaaaggaaagagcgaggcgccattcagaccctccgaaggttgatcctgcaatgatgaaggatgcccctgttgcctgatcaggcccttgtgattgttaggtttcgtgctgttttaactccatgatgtattttctaagttagattgttttctctgcgtaatgtctaatctgtccgggttgatttgagaattgaggcaattctaactgtatttgctgtcatggttttctccctgtagattgatacgtgtgattctaatagtgtatgcccttggctttcaatgtacgatataacggtttttgacagactttcttaacgtgcgaaattgcaatatatatatatatatatatccattcc

SEQ ID NO: 39622 - protein, 498 aa, Panicum virgatum
  misc_feature: Ceres CLONE 1998974
  misc_feature (139)..(159): Pfam Name: IQ Pfam Description: IQ calmodulin-binding motif
  misc_feature: Useful for making plants with modulated oxidative stress sensitivity
  misc_feature: Useful for making plants with modulated salt sensitivity
MGKKGKWFSAVKKVFGSSDPDGKEAKVEKADKSKSRRRWPFGKSRHSDPSTSMVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGNAVKRQTSHTLHCTQTMTRVQTQIYSRRVKLEEEKQALQRQLQLKHQRELEKMKIEEDWDHSHQSKEQIEASLVMKQEAALKRERALAYAFSHQWRNSGRTITPTFTEPGNPNWGWSWMERWMTARPWESRLAASDKDNKERSLTKNSSSSAVRMSVPRAISIQRPATPNKSSRPPSRQSPSTPPSKAPSTSGKTRPASPRGSWLYKEDDLRSITSIRSERPRRQSIGGGSVRDDASLTSTPPLPSYMQSTESARAKSRYRSLLTEKLEVSERAPLAHSVVKKRLSFPVIDKPSSPPADKTKERARRHSDPPKVDPAMMKDAPVA

SEQ ID NO: 39623 - DNA, 1345 bp, Panicum virgatum
  misc_feature: Ceres CLONE 1998980
  misc_feature: Encodes the peptide sequence at SEQ ID NO. 39624
aacacgcaggcgggcgctgcagatcaaaaggaggcccgaactccaaagtccatcttgccatcttcctcctgcccccgccccgattcagcaccgcactgcagagaggctctccgccggtcgagcgcgcctcgatccagatccaggtaacctccttggctcctcctcccgccgcgactgcgcctctctctatcttgctcctcctcctcccacgcggaggggaatcggttggttggttcccggttctgctcgtcagggatgccccacctcgcctggacgggttcggtgtgacgttccgcgcgctccgtccggcggaacttttgtttgttgggtagccgttcaatcaggatcttcctttctggaagtggaacggatactcctacttctatccgaatctgatacgaattgacgttagtcgttaccgatggactttcgatgcgaaacttctgtagattcgactactttctcgtcgtttcaaacagtccgttgggttactagacacggaaatgcccgctcttgctcacctggccggcgagttacctctcaaatcttaacatgctgcgcgcttgtgtgcctgtcacccttccatcctttccgccaaaattggcttttgtagtgtgcatccttgtagtagccaccagtcagcactcagcactcggtcactgtctttgatttatctgtcttttgttcacaacaaaccagcagtaattaggatgatgcatcttcgttcatctgattcgcatcggttgtacaaattgtatcaccctacaggatgggtttgttcctcatacctaacacccgtaaaggtccaaagcacacatcctctgttacatttggattgagatctatcgtctatgtgaagttgcatttcgatccataaacggataaacctgatgtgtttgctgcttgtgtggccaggtaggagatggctctcacgagaattggtctcgctggcctcgcggtcatggggcagaaccttgccctcaatattgcggagaaagggttccccatctctgtctacaacaggacaacctccaaggttgatgagacagtgcagcgcgccaagctggaaggaaacctccctgtgtatggtttccatgaccctgcatccttcgtgagctccattcagaagcctcgtgtcgtcatcatgcttgtcaaggctggggcgccggtcgaccagaccattgccacccttgcggcacacctggagcagggcgattgtatcattgatggaggaaatgagtggtatgagaacacggagaggagggagaaggcaatggaggagcgtggactcctataccttggcatgggtgtctccggagggagaggagggtgcccgcaatggccc

SEQ ID NO: 39624 - protein, 140 aa, Panicum virgatum
  misc_feature: Ceres CLONE 1998980
  misc_feature (3)..(140): Pfam Name: NAD_binding_2 Pfam Description: NAD binding domain of 6-phosphogluconate dehydrogenase
  misc_feature: SWISSPROT Homolog: EC 1.1.1.44 Phosphogluconate dehydrogenase (decarboxylating)
MALTRIGLAGLAVMGQNLALNIAEKGFPISVYNRTTSKVDETVQRAKLEGNLPVYGFHDPASFVSSIQKPRVVIMLVKAGAPVDQTIATLAAHLEQGDCIIDGGNEWYENTERREKAMEERGLLYLGMGVSGGRGGCPQW

SEQ ID NO: 39625 - DNA, 570 bp, Panicum virgatum
  misc_feature: Ceres CLONE 1998980-R
  misc_feature: Encodes the peptide sequence at SEQ ID NO. 39626
tcaagaaggcctatgataggaaccccaaccttgccaacctccttgtggaccctgagttcgcccaggagatcatggacaggcaagctgcctggcgcagggtcgtctgcctagccatcaacaatggcgttagcaccccgggcatgtctgcgagtctggcctactttgactcctaccgcagggacaggctgcccgccaacctggtccaggcacagagggactacttcggggctcacacctacgagagggtcgacatgcctggttctttccacaccgagtggttcaagattgcgcgcaactccaagatctgaactgctgctgcacaaacggcatgccaaaacacgataagactgccggatgttgagtaatcagtcatatatcgcttgcaggggaggaaccgtggttgaattttattttccatgcacattgcttaagttgggtcagaagttcagagttccctcttgtaagcactaagcagtcccggatggagaacatttaaatttgctggaactttgcaatttgtgtttgtaagttttattacatgaataaaagcattttggcatgcttgtttcc

SEQ ID NO: 39626 - protein, 101 aa, Panicum virgatum
  misc_feature: Ceres CLONE 1998980-R
  misc_feature (1)..(93): Pfam Name: 6PGD Pfam Description: 6-phosphogluconate dehydrogenase, C-terminal domain
  misc_feature: SWISSPROT Homolog: EC 1.1.1.44 Phosphogluconate dehydrogenase (decarboxylating)
KKAYDRNPNLANLLVDPEFAQEIMDRQAAWRRVVCLAINNGVSTPGMSASLAYFDSYRRDRLPANLVQAQRDYFGAHTYERVDMPGSFHTEWFKIARNSKI

SEQ ID NO: 39627 - DNA, 741 bp, Panicum virgatum
  misc_feature: Ceres CLONE 1998991
  misc_feature: Encodes the peptide sequence at SEQ ID NO. 39628
attcagtgaatcagcgcatggtggtggccattgttggatttggaggcctaggcaagactactcttgctaaacaggttttcgacaaaattgcagggaacttccgctgcacagctttcgtgcctgtgtcaagaaaccctgatatcaataaggttctgagagatatattgttggatttcaattgtggcgactcggccgaagctctacgacagcttgatcaacggcaactcataaataagctcaggaaatacatcgaagggaagaggtacctggttgctgttgacgacatatggagcaaagatgcatggatgattctaggtagtgcactgttcagtaataatcatggcagcagaataattgtcacgacacgccagaatgacgttgctgaagaatgctgcccttctagcatcgatcacgtctacaaaatggatcctcttggcaagaatgactcagaaaacttgttcgtagaaaaagcctttggccgcaaaggatgccctcctaatctgagaggtgtttgtggtaaaatcttgaaaagatgtgctgggtctccactagccatcataaccttgtccggtttgttgcgtaataaggtgacagtatctcagtgcgaggaggtgctatattctctgagtaatgcagttccggaggactctgatgttgatgcgatgagaaagatactatctttcagctatttcgatcttcctcatcatctaagaacatgtctattatattttagcatgtttt

SEQ ID NO: 39628 - protein, 246 aa, Panicum virgatum
  misc_feature: Ceres CLONE 1998991
  misc_feature (1)..(246): Pfam Name: NB-ARC Pfam Description: NB-ARC domain
SVNQRMVVAIVGFGGLGKTTLAKQVFDKIAGNFRCTAFVPVSRNPDINKVLRDILLDFNCGDSAEALRQLDQRQLINKLRKYIEGKRYLVAVDDIWSKDAWMILGSALFSNNHGSRIIVTTRQNDVAEECCPSSIDHVYKMDPLGKNDSENLFVEKAFGRKGCPPNLRGVCGKILKRCAGSPLAIITLSGLLRNKVTVSQCEEVLYSLSNAVPEDSDVDAMRKILSFSYFDLPHHLRTCLLYFSMF

SEQ ID NO: 39629 - DNA, 670 bp, Panicum virgatum
  misc_feature: Ceres CLONE 1998993
  misc_feature: Encodes the peptide sequence at SEQ ID NO. 39630
cttcgcataaacccccccgcggcgccgtcctcgcctcgccgcgaccccgcctccgccgctaggtttcaactgccagcctcccggcatccgcgtctcccggggaaaggaaggggaggggaggtagaggatggctgcgccgataccgcgcgagtggaccgggctgcagcagttcccggcggccacccagaccaagctgcacgagctcctcggcaagatgaaggaggagaatgtgagcacattaacaattctggtgatggggaaaggtggagtgggcaagtcatccactgtaaactccatcgttggggagagggtcgccactgtcagcgctttccagtccgagggtctgaggccaacgatgtgctcccgcacaagggtgggattcaccttgaacattatcgacactcctgggctcattgatggtggatacatcaatgagcaggctgtcgagatcataaagaggtttcttctgggcaagactattgatgttctcctgtatgtggatcgcttggatgcataccgaatggatacactggatgaacaggttataaaaaccatcaccaattcatttggaaaggacatctggcgaagagcactggttgtgttgacccatgctcagctctcaccgcctgatggaatcgactataatgagttctttacaaaaagatcagag

SEQ ID NO: 39630 - protein, 180 aa, Panicum virgatum
  misc_feature: Ceres CLONE 1998993
  misc_feature (38)..(179): Pfam Name: AIG1 Pfam Description: AIG1 family
MAAPIPREWTGLQQFPAATQTKLHELLGKMKEENVSTLTILVMGKGGVGKSSTVNSIVGERVATVSAFQSEGLRPTMCSRTRVGFTLNIIDTPGLIDGGYINEQAVEIIKRFLLGKTIDVLLYVDRLDAYRMDTLDEQVIKTITNSFGKDIWRRALVVLTHAQLSPPDGIDYNEFFTKRS

SEQ ID NO: 39631 - DNA, 705 bp, Panicum virgatum
  misc_feature: Ceres CLONE 1998995
  misc_feature: Encodes the peptide sequence at SEQ ID NO. 39632
gatccccacgcttacccccccgcaccggatcccctccaccacctcgccgcggcgcgccggcgccccccacctccccgccgccgcgccgcgccccccgagcgtcccgaacgagccgccggggccgatctgcaccccccgtcagatgcgccgccccaatacccgcggcgagcacaaggaacaaaccctagctcccgccccctcccccgccgcccggatcaggatgggcgccacgcggcggcagcccggctcccgccgccgcgtcgccaccgccctcgcgctcctcgccgcgtccgcgctcgccctgctgctcctcctcgcgtcccgctcggcgcccccgaggtacggcgtcatcatcgacgccggcagcacggggagccgcgtccacgtcatcgcctaccgcgccggccccggccggggcgcgcccccgcagctggactgggcgcgcacggcctcgctgaaggccaacccggggctgtcgtccttcgcggcggatccccgcggcgcggggctgtcgctggccccgctggtggaatttgctcggcgccgcgtgccgcgggagaggtgggcggacaccgaggtgcggctcatggccacggcggggctccggcttctcgacgccgcggtggcagagtccgttctggagtcatgcagggatgtgcttcgccaatcgggcttcctgttccaggacaaatgggccaccgtgat

SEQ ID NO: 39632 - protein, 187 aa, Panicum virgatum
  misc_feature: Ceres CLONE 1998995
  misc_feature: SWISSPROT Homolog: EC 3.6.1.5 Apyrase
MRRPNTRGEHKEQTLAPAPSPAARIRMGATRRQPGSRRRVATALALLAASALALLLLLASRSAPPRYGVIIDAGSTGSRVHVIAYRAGPGRGAPPQLDWARTASLKANPGLSSFAADPRGAGLSLAPLVEFARRRVPRERWADTEVRLMATAGLRLLDAAVAESVLESCRDVLRQSGFLFQDKWATV

SEQ ID NO: 39633 - DNA, 1301 bp, Panicum virgatum
  misc_feature: Ceres CLONE 1999001
  misc_feature: Encodes the peptide sequence at SEQ ID NO. 39634
acaatctcgcaaatccattcccattctccccaacacgcccaagaaatcctccgagccgaaggaccgccatgaaagggcgcgcggtgaagctccgtgaggcgcacaaatcgggctcgccggctctctgctccgccgcgtggggcccctgcgggcaacatgtcgtcaccgcgtccgccgccgacaccgccgtcctggtccacgacgccgccgccctggtccacgacgccgccgcgttgctcgccggccgccgtgtctcgggtttgacgccgttggccacgatacggctccacaaggacggcgtcactgctctcgcagtcgcgccgggccccggaggctctctggcgtccggatccattgaccactccgtcaagttctacaccttcccagggggagaattcctgagcaatgtcgcccgattcacccttccgatccggtcacttgcgttcaacaagaagggaaccctgctggcggccgcaggcgacggcgatggcatcaagctgattgcaacaatcgacaacaccatctcgaaggtgctcaaaggccataagggctccgtcaccgggctggattttgatcccaggaacgattacctggcttctgttgacagcttcggaactgtcatctattgggatctttgcaccagcagtgaggcccgtaccttaacccgcgttgctcccacattcggttcggataattcggtcaggaatgtcctgtgttggagccctgatgggcaaacccttgctgttcccgggttgaggaacaatgtggtgctgtatgatagggacacaggcgaggaggtgtctacattgaaaggagatcatgagcagccagtgtgcagcctgtgctggtctcctaatgggagatacctggccagtgctggcctggataggcaggtgctcatctgggatgtgaagtcaaagcaggacattgagagacagaagtttgatgagaggatatgctgcttggcttggaaaccagatggaaattctttacttatgattgatgtcatgggcagatttggcatttgggaatcagtcataccttcaactatcaagtcacctactgagggtataccagatctcaagtccactaagattcctttgtttgatgatggcgatgacattgatgatgatgagatgccgtgtacctctggtggcttggatgatgatattgatgaaagtctttgtgattcaactcctttcagccacaagagactgaagaggaagtccgcatttaatggagacagtgaagatgaaggatttaattcatcaattggaatcatccaaaagaatgaaagataa

SEQ ID NO: 39634 - protein, 410 aa, Panicum virgatum
  misc_feature: Ceres CLONE 1999001
  misc_feature (241)..(280): Pfam Name: WD40 Pfam Description: WD domain, G-beta repeat
  misc_feature (65)..(104): Pfam Name: WD40 Pfam Description: WD domain, G-beta repeat
  misc_feature (150)..(188): Pfam Name: WD40 Pfam Description: WD domain, G-beta repeat
  misc_feature: SWISSPROT Homolog: EC 2.3.1.48 Histone acetyltransferase
MKGRAVKLREAHKSGSPALCSAAWGPCGQHVVTASAADTAVLVHDAAALVHDAAALLAGRRVSGLTPLATIRLHKDGVTALAVAPGPGGSLASGSIDHSVKFYTFPGGEFLSNVARFTLPIRSLAFNKKGTLLAAAGDGDGIKLIATIDNTISKVLKGHKGSVTGLDFDPRNDYLASVDSFGTVIYWDLCTSSEARTLTRVAPTFGSDNSVRNVLCWSPDGQTLAVPGLRNNVVLYDRDTGEEVSTLKGDHEQPVCSLCWSPNGRYLASAGLDRQVLIWDVKSKQDIERQKFDERICCLAWKPDGNSLLMIDVMGRFGIWESVIPSTIKSPTEGIPDLKSTKIPLFDDGDDIDDDEMPCTSGGLDDDIDESLCDSTPFSHKRLKRKSAFNGDSEDEGFNSSIGIIQKNER

SEQ ID NO: 39635 - DNA, 1424 bp, Panicum virgatum
  misc_feature: Ceres CLONE 1999011
  misc_feature: Encodes the peptide sequence at SEQ ID NO. 39636
ctccctcgccctatcctgcccgtgggatcaaacattttgcaccaccaaaccctagccgtcgggtcggcgccatctccatcttccatccgattcaccgggcggggcgcagcaacaagtctgtccgtacccacatgtacaattcgttccgccctaggcaacgcaacttgcgcgtcgccgcagaaaataaaaggttgcccgactccgtctcgtcgttctccagttcctgcaacgaaagaaccaggccgcctccgatctccatctcacatggtttgaaactctcttcaatctaatctgatcttattcacatcttgtgtgatttttctgttaacctcacatctaatctgtaagttttgattcttttagattcccccccgcataataattttgttgctttgcgggtacttttttttttgagcaaaacgggtactttgttgcagagttaggataagagatttctatgcccacctgtaatgttttgccatatggtggttgtggaattgggaaatatgattcattatttggaccattgaatcaatatatgattctacattgaactttcctggttgtcatttgagtcggacctgctggagggtttttcccattctgtgggttgaagctgcaggggatcatagcaataaaaagtgccttctggctctggcagctatatatggctgatgggtccaagaagaaggtcggacccaaggctctgcggcttcaccatctacatcctgatatcctacaggacatactgtcacggctagagttcaaagaagctgcgcgaatgagcatactgtccagcaaatggcgacgcctttggaggtgctaccagaacctggtcttcactagggagacaatgtttagcagtggcagcaatgccatcataaaccggcgtagattcatcatcaatgtcaatagtgtcctgcgtcagttaagctctaccactgtgaaaaagttcatggttagattcaagctccgcaagccacattcccaccatgttgatagatgagttcgctttgctgctgggtcaaaagcaaggtacattatctttgatttatctccaggttcatggggtgatgaccatgacagcaggtacatctttccgttgcatcatttcagcggttccaatggtgctcctattagatccttgcgcctcatgtttgtctgtttgaagccacggcctgatttctgtggtttcacaaatctcaagaagctcaagcttgatgcagtgtcgatttctggacatctccagtgcttgctgccagactgtgccgttcttgagtggctaagcattgtacgctgcaccctgcatggcttgcaaacatcccagccattgcatcgattgaggtacctgcatgtgaaaacctgcagtgggatgcaaaagattgagttacaagccccaacccttgctacattcaaagttcacg

SEQ ID NO: 39636 - protein, 112 aa, Panicum virgatum
  misc_feature: Ceres CLONE 1999011
  misc_feature (14)..(61): Pfam Name: F-box Pfam Description: F-box domain
MADGSKKKVGPKALRLHHLHPDILQDILSRLEFKEAARMSILSSKWRRLWRCYQNLVFTRETMFSSGSNAIINRRRFIINVNSVLRQLSSTTVKKFMVRFKLRKPHSHHVDR

SEQ ID NO: 39637 - DNA, 456 bp, Panicum virgatum
  misc_feature: Ceres CLONE 1999011-R
tttccctagtagctggaatgaactcagcaaatggctgtggaatactcagcatctataagataatatgatggagtggcacggcaagggagaaatagggccgcacaatcatctgaaggcgcttcacattacaggagcgtacagctaccagagtctgcttgatctagcactgtatattgctcgtaatgcaacagcactggagtgcatggtcattgatccaatggtgaaaaataactatgttctcagccatcatgaggaagaacagcatgcagtcaattggggccggcagatggctaaacaacacctgaagtgacgggggtttgatggcatccttactatattgtaataataatgatgatgcaaaatttcagaataataagtgttcttttagcaaatttcagacacatcatgagaaatgataatgttaccgttcaatatagtgcttgtggttgaaaggtg

SEQ ID NO: 39638 - DNA, 702 bp, Panicum virgatum
  misc_feature: Ceres CLONE 1999024
  misc_feature: Encodes the peptide sequence at SEQ ID NO. 39639
atccttatctgaagatctgataactgagatgtgccggtttgggggtgcagagattcatacagtggctgcttttattggtggcgttgcttcccaagaagtaataaagctggtgaccaagcagtctgtgcccttgcggggaacatttatattcaacggaatcgacctcaaatctcaagttttggaactataatgtggctgtggaggctccatttgagatgccccagtttttttgtgccgtgacctcgcgcttcaatggaatcagtttgcccgtgtacttggccaagatcaggtctgaactggatcattgtaccgacgaggagcctaattcgcatgatatttagatgagtggcattctcgccatgtaggttcatataatctgctgctctgtttccaccttttgggacacggaaaatgaatccgagaaaagtggtcaatatttaagaatgcatctgaaaaaaaaaaaaaaaaaaactccttgttccgcctccgctccgccgctttattcctcgccggagtggagggggcggtcaaactgtcgaagcgaacaaaaacccccagaccacaccgcgagaagagagcgcagccacctcgcctccgctcctcagccatggcagccgccggcgtcgtcgctgagcccaagaccaagtacgatcgccagctcaggatatggggtgatccaggacaagcggcactgggagaagc

SEQ ID NO: 39639 - protein, 62 aa, Panicum virgatum
  misc_feature: Ceres CLONE 1999024
  misc_feature: Useful for making plants with modulated biomass
SLSEDLITEMCRFGGAEIHTVAAFIGGVASQEVIKLVTKQSVPLRGTFIFNGIDLKSQVLEL

SEQ ID NO: 39640 - DNA, 586 bp, Panicum virgatum
  misc_feature: Ceres CLONE 1999029
  misc_feature: Encodes the peptide sequence at SEQ ID NO. 39641
ccagagctgatcgatcgagagcttaacacttagccgggtagcgtaattatatactcgtgaccgaccggccaatataatcgattgaagaatttcgatacgcatcacatttacatatatgcacttgcgtatcgacgaggcagctgagctagagctagagctagagctagagctagagccagagccagagcttgagcttgagatggagaacggcgacgtgaagcctgctcgcagctcggtggcggcgagcgccatggcggcctcgtacaacgaccagattcggccgctgctggacgccgttgaccggctgcggcagctgaacgtgagccaggagggcatccagctcccgaccatcgtcgtggtgggcgaccagtccagcggcaagtcgagcgtgctggagtcgctggccggcatcagcctcccgcgcgggctgggcatctgcacccgcgtgccgctcgtcatgcggctgcaggacggcgacgacccccggctgcaggtggagtacggcaacggcaccgtggtgcccgtcgcctccgaggcggaggtcgccgacgcaatcgaagccgccacggccgagatcgccggctcc

SEQ ID NO: 39641 - protein, 156 aa, Panicum virgatum
  misc_feature: Ceres CLONE 1999029
  misc_feature (79)..(155): Pfam Name: Dynamin_N Pfam Description: Dynamin family
  misc_feature: SWISSPROT Homolog: EC 3.6.5.5 Dynamin GTPase
MHLRIDEAAELELELELELEPEPELELEMENGDVKPARSSVAASAMAASYNDQIRPLLDAVDRLRQLNVSQEGIQLPTIVVVGDQSSGKSSVLESLAGISLPRGLGICTRVPLVMRLQDGDDPRLQVEYGNGTVVPVASEAEVADAIEAATAEIAG

SEQ ID NO: 39642 - DNA, 1072 bp, Panicum virgatum
  misc_feature: Ceres CLONE 1999038
  misc_feature: Encodes the peptide sequence at SEQ ID NO. 39643
atcgtctcctctcgtttagcagctagcctagccataggccgccagcgcacggccccgccgccccctccgctccgccctcccctccgctccgcccgggcccacccggcattcctgaactccccccgcatcaaatcccccacccgtgccgtgggagcgcccgcccccgcgtgcccgaattcccgccgcaatccggctggtgtttcccgtgcgcagcagcggggccgtaatggcgctgtccgcgtcggcggcgtcggccggccgcgggtcgcgggtggagaaggtgaggaggatcttcgagcgcttcgacgccaacggggacggcgggctggaccgggacgagatggcccagctcgtcgtcgccgtcaacccgcgggtcaagttcagtgaggaccagatctccgccatcctcgacgaggtcttccgcacctacgccgagttcatcctccccgacgggaagggcctctccctgccggggctgctccgcacatacgacgacggcgcgggcgacgtcgaccgcgacttcctcgcgctctccctgcccgcgctggactccgacgcatcctccccggagatcgccccgggggacgccgccacaccctcctccccgccccccggcgcggccgtcgccgcgtcgctgctcgacgaccacgtcaagccgctcggcgccggcgggggtgccccgccgtcgttcagctcgcgctccgcggccgcggccgcggcgccagcgtgggcgacctcgccgaaccacggcatcgccttcgactcctcgtgggggctcctcgacgacctggagatactcgtcaagcgcctccgctcgaagcagcagcggaagggctccatcgacgggagcgttggcggcggcgctggcaacagcaacttcgactccttctccgaggccgggtggtccagggagatctccggcgcggcggattcggcatccagcgccgcgccgtgggacgagacgagccgggactacctcaccttcgtcaaggaactcgccgtgctccgcacgcgcgcggacgcctctcgctcgcgagaggaggccttcgacaaccacatggtcataggccgg

SEQ ID NO: 39643 - protein, 281 aa, Panicum virgatum
  misc_feature: Ceres CLONE 1999038
  misc_feature (18)..(46): Pfam Name: efhand Pfam Description: EF hand
MALSASAASAGRGSRVEKVRRIFERFDANGDGGLDRDEMAQLVVAVNPRVKFSEDQISAILDEVFRTYAEFILPDGKGLSLPGLLRTYDDGAGDVDRDFLALSLPALDSDASSPEIAPGDAATPSSPPPGAAVAASLLDDHVKPLGAGGGAPPSFSSRSAAAAAAPAWATSPNHGIAFDSSWGLLDDLEILVKRLRSKQQRKGSIDGSVGGGAGNSNFDSFSEAGWSREISGAADSASSAAPWDETSRDYLTFVKELAVLRTRADASRSREEAFDNHMVIG

SEQ ID NO: 39644 - DNA, 1452 bp, Panicum virgatum
  misc_feature: Ceres CLONE 1999060
  misc_feature: Encodes the peptide sequence at SEQ ID NO. 39645
acctgggcccactcatcagccttgttcactgacgtgtgggtcccaccgacgcgtcgtcttctccttccttccgccagcttcgaaacctccgccccggcgcagaaacccctcctcgcctcctccgccgcccacgctccctccctcagcttatacgcctccctcgcagccccaacgcgcgggaagccccaccctcttgtcgcattccgtcgcgatgcagtccaccgcggccgcgtccgtctccgcctcggcgatcgcctccggcggcggcgccagatccgaggcggcgcggcggcccgccgggctccgggtccgcgggctccgcggcgaggccctcgcgtgcccctcgctgcggatctcgcaggcgccagcgaggctggcggtggcgagggcggcggcggccacgaacggctcggtggcggggagcggtgggttcgactacgacctcgttatcatcggagcgggcgtcgggggccacggcgccgcgctgcacgctgtcgaggagggtttgaaaactgccataattgagggagatgttgttggtgggacgtgtgtaaacagaggttgcgtcccatcgaaagcactccttgctgtcagtggtcggatgcgggagcttcatgatgaacatcatatgaaatctttgggtctacaggtttcctctactggatatgatagacaagctgttgccgatcatgcaaacaatcttgcctccaaaatccgtagcaacttgacgaattcaatgaaagctctgggcgtggatatattgacaggtgttggcactattgtgggaaagcaaaaggtacgatatggaaaagttggtttccctgataaagaaattactgccaggaacatcataattgccactggatcaactccttttgtccccaaagggattgaaattgatgggaaaactgtatttactagtgatcacgcccttaagcttgagtcagttccagactggatagctattgttggaagtggttacattggacttgagttcagtgatgtatacacagctctaggaagtgaggtcacttttgttgaagctcttgaccagctgatgccgggatttgatcctgaaattgcaaaattagcacagagagttcttattaatcctcggaaaatcgactatcacactggtgtttttgcaagcaagattactccagcaaaggatggaaaacctgtgctcatagagctcattgatgccaagacaaaggagcacaaagaaacccttgaggtggatgctgcccttattgccacaggaagggcgccattcaccaaagggcttggcttggaaaatatcaatgttgttacgcagtgtggttttgtacctgttgatgaacggatgcgagtcatggatgcagatggcaatgtggtacccaatttatattgcattggagatgccaatggcaagctcttgcttggccatgctgccagtgcacaaggaatttcagt

SEQ ID NO: 39645 - protein, 413 aa, Panicum virgatum
  misc_feature: Ceres CLONE 1999060
  misc_feature (77)..(401): Pfam Name: Pyr_redox_2 Pfam Description: Pyridine nucleotide-disulphide oxidoreductase
  misc_feature (249)..(350): Pfam Name: Pyr_redox Pfam Description: Pyridine nucleotide-disulphide oxidoreductase
  misc_feature: SWISSPROT Homolog: EC 1.8.1.4 Dihydrolipoyl dehydrogenase
MQSTAAASVSASAIASGGGARSEAARRPAGLRVRGLRGEALACPSLRISQAPARLAVARAAAATNGSVAGSGGFDYDLVIIGAGVGGHGAALHAVEEGLKTAIIEGDVVGGTCVNRGCVPSKALLAVSGRMRELHDEHHMKSLGLQVSSTGYDRQAVADHANNLASKIRSNLTNSMKALGVDILTGVGTIVGKQKVRYGKVGFPDKEITARNIIIATGSTPFVPKGIEIDGKTVFTSDHALKLESVPDWIAIVGSGYIGLEFSDVYTALGSEVTFVEALDQLMPGFDPEIAKLAQRVLINPRKIDYHTGVFASKITPAKDGKPVLIELIDAKTKEHKETLEVDAALIATGRAPFTKGLGLENINVVTQCGFVPVDERMRVMDADGNVVPNLYCIGDANGKLLLGHAASAQGIS

SEQ ID NO: 39646 - DNA, 609 bp, Panicum virgatum
  misc_feature: Ceres CLONE 1999060-R
  misc_feature: Encodes the peptide sequence at SEQ ID NO. 39647
gagggtgatgggattgccaagtttgatttaccgatctgacacgggcgaaattcttggggttcacattttgggtttgcacgctgctgatctcatccatgaggcgtcaaacgccatcgccctaggaactcgtgtccaagacatcaagtttgctgttcatgcgcaccccacgttgtccgaggtcctggatgaacttttcaaagctgccaaggttaattcaggtgtttctcattctgtaaatgaaccagttgcagcctagagaagtgccggacagcaagccgagccagccaccccaaccactgctgaaggtcctcagcttcatctcggctctgctatcttccccgaaacgagatgaaaaacggtagttcgttcaacaagtggtgttgtaccttaacatctgctggctatagattcgaggaaagaaactccatcttcatcaggatctgaaatgcgtgagcatatttttggcagtccgatatatgtgaagggtttgtgctagttagcaatggggtggctttttgttggcttcattctttgttggttatcctgtaagctgcaagtgccgagactaatcagcttgtttgaaataatcgatttccagtctggtgtgct

SEQ ID NO: 39647 - protein, 84 aa, Panicum virgatum
  misc_feature: Ceres CLONE 1999060-R
  misc_feature (1)..(65): Pfam Name: Pyr_redox_dim Pfam Description: Pyridine nucleotide-disulphide oxidoreductase, dimerisation domain
  misc_feature: SWISSPROT Homolog: EC 1.8.1.4 Dihydrolipoyl dehydrogenase
RVMGLPSLIYRSDTGEILGVHILGLHAADLIHEASNAIALGTRVQDIKFAVHAHPTLSEVLDELFKAAKVNSGVSHSVNEPVAA

SEQ ID NO: 39648 - DNA, 667 bp, Panicum virgatum
  misc_feature: Ceres CLONE 1999080
  misc_feature: Encodes the peptide sequence at SEQ ID NO. 39649
acaccgatccactcctacagcctccggtctccccggcgtcccgactccgagccccgccgcgaagcctcaccggcatggcgacagccagtggcgccccgccgccggcaatggacgagaaggcccggcgcacgcgcgacctcctcgccagcttctacaacaccgacccctctgcggccgctggcgccggggtcgcgtcccccgcgtccctggcgcggccctcccccaccgcggctcctgcgtcgcccctggactccatcaactccacctccttcgatcccgagaactacatgaatgttctggtgcaacaatccaatctggaaggtcttctacagaggcatgtgaagatggctgctgagatcaagaatctagacacagacttacagatgctagtgtatgagaattataacaagtttattagtgcaactgacactataaaaaggatgaagactaacattgttggaatggaggcaaatatggagcaactcctttcaaagataacatcagtgcagtcaaaaagtgacacagtgaatacatctcttttcgacaaaagggaaaacatagagaaattacaccgtacacgcaatttgctccgaaaagttcaatttatatatgaccttcccagtcggctttataaatgcatcaagaccgaagcatatgctgatgctgt

SEQ ID NO: 39649 - protein, 197 aa, Panicum virgatum
  misc_feature: Ceres CLONE 1999080
  misc_feature (61)..(147): Pfam Name: Vps51 Pfam Description: Vps51/Vps67
MATASGAPPPAMDEKARRTRDLLASFYNTDPSAAAGAGVASPASLARPSPTAAPASPLDSINSTSFDPENYMNVLVQQSNLEGLLQRHVKMAAEIKNLDTDLQMLVYENYNKFISATDTIKRMKTNIVGMEANMEQLLSKITSVQSKSDTVNTSLFDKRENIEKLHRTRNLLRKVQFIYDLPSRLYKCIKTEAYADA

SEQ ID NO: 39650 - DNA, 1374 bp, Panicum virgatum
  misc_feature: Ceres CLONE 1999081
  misc_feature: Encodes the peptide sequence at SEQ ID NO. 39651
tctcatccagtcttgctcgcgcgcactcttgttgtcgctgaggtcaaatagccatccatccatccatacgcctctttccctttctctttcctctttacctccttttcttgattttccaagctgctacaagctctccggtttccgggtgctgctgcttctcatggtcatggcttccgcagcggctcctgccagccaccaaaccgagcaaaggcaccgccaaatctgcctctgaactctccaccaaatacccaaccagcacccacccacccacccatcttcttcttcttctagcaacgagtagctcaactcagtcagctcagcttattagccagttagcagcagcttcaagcccagctgcatatgcgcgagtataatggagagcagatggcgaaaggcaaagatgtcgctagggctcaatctctgcgtctacgtgccccggacgctggaaggcgacgacgacagctcgcccaacaccggctcctccacggcggcgctcgtgtcgccagtggcgtcctcgtcgtccgccgcgaccagcgctaacaccacaccgacggcggagcagagcaacgacaaggtgaacggcggcgccggcgcgatgatgccgaccaccccgacgcccacctccgccggactccgcctctccaaatccggcagcaaatccttcaagaaaacatgtgccatatgcttgaccacgatgaagcctggtcagggtcatgctctcttcacagcagaatgctcgcataccttccacttccactgtatttctgcaaatgttaagcacggaagcagcagctgcccagtttgccgtatcaaatggaaggagcttccatttcgaggaccattgccagctgaattaccccaagtaaatgcaaggattaatccagttaatgggtatcaaaatggaggccatatgactgtattgcgaccacttccgcgtgcccgttcttctggtaggcttcatcatctgtccgcgttgctgcctgacactgaccctagtactttcaacgatgatgaacccttggaattgtcgtgtgaagcaaccgaagaccctcagcagggcagtttgagaacagtggagataaaaacacatcctgagttcactgaagtacctgaaaattcgtcagaaagaaacttcactgttctaattcatcttaaggcaccccttgctcaacatttgcagacacccagcaatctcggagatggcaatggaccaagcactgctcgtgcccctgttgatctcatcacagttcttgatgttagtggaagcatggctggtaccaaacttgcattgttaaagagggctatgggatttgtcattcaaaaccttggctcttcagatcggctttccgtcatcgccttctcatcatccgcacg

SEQ ID NO: 39651 - protein, 333 aa, Panicum virgatum
  misc_feature: Ceres CLONE 1999081
  misc_feature (101)..(144): Pfam Name: zf-C3HC4 Pfam Description: Zinc finger, C3HC4 type (RING finger)
MESRWRKAKMSLGLNLCVYVPRTLEGDDDSSPNTGSSTAALVSPVASSSSAATSANTTPTAEQSNDKVNGGAGAMMPTTPTPTSAGLRLSKSGSKSFKKTCAICLTTMKPGQGHALFTAECSHTFHFHCISANVKHGSSSCPVCRIKWKELPFRGPLPAELPQVNARINPVNGYQNGGHMTVLRPLPRARSSGRLHHLSALLPDTDPSTFNDDEPLELSCEATEDPQQGSLRTVEIKTHPEFTEVPENSSERNFTVLIHLKAPLAQHLQTPSNLGDGNGPSTARAPVDLITVLDVSGSMAGTKLALLKRAMGFVIQNLGSSDRLSVIAFSSSA

SEQ ID NO: 39652 - DNA, 674 bp, Panicum virgatum
  misc_feature: Ceres CLONE 1999081-R
ccaaaggtacgaggcatctggtcgggcatatgtactctcagggttgagctcccactcatggcagagggcaactgcacgcggtgactccacagacagtgacagcctaatccaggcatatcagacttcttccatggtcgacatgctgctgcgctcacagacaatgagccgctcgtcagcccctcgacaaactccacagatgagtcatgcaaaatcattcccagcgcgcccgcagccaaggtaactgcattctggtgacgccaagaaggatttgcctgaagcctaattgcttgttagtggacgtagtcgtttaagttcttagttttgtggcaggaggatgggatgggggtatagtttgtgtggtataaggagatgtaatggtgtaaattcaatttggggtggtggggtgggtaaatggtgagagtaaggtgttttgtaattggggtaggggatggtatacgtcctggcgtggaatgggcaagagggtgggctattttttcccttggtggtgacttggtatactccagtattgtactagctcctttgtgtggtgatgtacataagagatgggtatacatttgtgtattccttgaggaggatgggatacttgatcctgatccttgcaaggtttgttccctacttccctcttcctggaaatggaaaagggttgttgcatc

SEQ ID NO: 39653 - DNA, 707 bp, Panicum virgatum
  misc_feature: Ceres CLONE 1999084
  misc_feature: Encodes the peptide sequence at SEQ ID NO. 39654
gttcttttcctgaaaatatcggtttccaggaggcgcacgggaaccgcaaggatccgctcgtgccattgtaccttctccgcgacctatttcctcgtctttctcgcgcgtgatcgcgtacagctgttactggatttgagctgtggagtcgccacagtccagggttcaccagagatggacttcttcagtgaatatggtgatgctaacagatacaaaatccaagaggtcattggcaaaggaagttatggtgttgtttgctcagctgttgaccagcatacaggcgacaaggtggcaatcaagaaaatacataatatctttgagcacttatccgatgctgcccggatcctccgtgagatcaaactacttcggctattgcgacatcctgatatagttgagatcaagcatataatgctgcctccatcaaggagggacttcaaagatatctatgttgtgtttgagctgatggatacagacctgcaccaagtcatcaaggcaaatgatgacttaaccaaagagcatcatcagttctttctatatcagatgctccgtgcactcaaatacattcatactgctaatgtttatcatcgtgatttgaagccaaagaatatattggctaatgctaactgtaaacttaaaatatgtgattttggattggcaagagtggcattcaatgatactcctacaacagtattctggacggattatgttgc

SEQ ID NO: 39654 - protein, 178 aa, Panicum virgatum
  misc_feature: Ceres CLONE 1999084
  misc_feature (13)..(178): Pfam Name: Pkinase Pfam Description: Protein kinase domain
  misc_feature: SWISSPROT Homolog: EC 2.7.11.24 Mitogen-activated protein kinase
  misc_feature: Useful for making plants with altered cell wall content and/or composition
MDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYV

SEQ ID NO: 39655 - DNA, 711 bp, Panicum virgatum
  misc_feature: Ceres CLONE 1999087
  misc_feature: Encodes the peptide sequence at SEQ ID NO. 39656
aacataagaacaataagaactcgaattcttatcgatactggaactcagagcataggagggaaagtcgatttatggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggttattctattccacttctagatagagaaacgaactaaaggagaatacttaataatatggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatacta

SEQ ID NO: 39656 - protein, 113 aa, Panicum virgatum
  misc_feature: Ceres CLONE 1999087
  misc_feature (40)..(113): Pfam Name: Ribosomal_L2 Pfam Description: Ribosomal Proteins L2, RNA binding domain
MAKHLYKTPIPSTRKGTVDRQVKSNPRNKLIHGRHRCGKGRNARGIITARHRGGGHKRLYRKIDFRRNQKDISGRIVTIEYDPNRNAYICLIHYGDGEKRYILHPRGAIIGDT

SEQ ID NO: 39657 - DNA, 634 bp, Panicum virgatum
  misc_feature: Ceres CLONE 1999092
  misc_feature: Encodes the peptide sequence at SEQ ID NO. 39658
aacttttgactcccccgctttttaccgtgaaccccctataaacctccggattcccacgcctccacacacactcccaccagcgccactgcgacagtgtcagtccccgctccgccatggcgtccaggcgctcgctcccccggctgctcctccacctcccgctcctgctcctctccgccgccgccgccgccgccgcggaggcgtcgtccgcgcgcagcgcggaggtggacgcgctcatggagctcaaggcggcgctggacccctcgggccgcgcgctcgcctcgtgggcgcgcggcggcgacccctgcggccgcggggactacttcgagggcgtctcctgcgacgcgcgcggcagggtcgccgccatcgcgctgcaggggaaggggctcgccggcaccgtcccgcccgcgctcgccatgctcccgggcctcaccggcctctacctccactacaacgacctccgcggggacatcccgcgggagctcggcggcctcccggacctcgccgagctctacctcggcgtcaacaacctgtccgggcccatccccgtcgagctcggccggctccgcagcctccaagtactgcagctcggctacaatcagttgtcagggagcatcccaactcagctgggtcagct

SEQ ID NO: 39658 - protein, 173 aa, Panicum virgatum
  misc_feature: Ceres CLONE 1999092
  misc_feature (33)..(76): Pfam Name: LRRNT_2 Pfam Description: Leucine rich repeat N-terminal domain
  misc_feature: SWISSPROT Homolog: EC 2.7.11.1 Non-specific serine/threonine protein kinase
MASRRSLPRLLLHLPLLLLSAAAAAAAEASSARSAEVDALMELKAALDPSGRALASWARGGDPCGRGDYFEGVSCDARGRVAAIALQGKGLAGTVPPALAMLPGLTGLYLHYNDLRGDIPRELGGLPDLAELYLGVNNLSGPIPVELGRLRSLQVLQLGYNQLSGSIPTQLGQ

SEQ ID NO: 39659 - DNA, 688 bp, Panicum virgatum
  misc_feature: Ceres CLONE 1999106
  misc_feature: Encodes the peptide sequence at SEQ ID NO. 39660
gttttcgcccgccgctgccgccgccgccgcttccgtcttcgcccgccgccgccatgccgtcccacaagaccttccggatcaagaagaagctggccaagaagcagcgccagaaccgccccatcccctactggatccgcatgcgcactgacaacactatcaggtacaacgcgaagcgcaggcactggcgccgcaccaagctcggattctgagcgggggaagagatgccgggcaccgatgcttggggaaactggggcttacgagccagcctctggacgcttccatgtttccgcatgctatgaagctcttgtttagattttgcttgtgttaaatttatcttatccgttgttcctgtagcactgagaatgccatgttttgctgatggttgaagaacatcttttataattatgcagaagctatcttgatccgcagtgcggtaatcagttggtccagattgcttttttgcatttcagtatttcgatttacatgtcttgtgtagatgcttgttcatgttcattgatggcttaattgctatgattttagcagttgtttacaatctaggttggtttgctcatgatcttgtagtgcatttgatctgctagttactgtcatctagatttttatagttagtggcatgctgtagcatgtggattagtattcagagcaactgttgccttttgctctcgaaccc

SEQ ID NO: 39660 - protein, 51 aa, Panicum virgatum; identical to SEQ ID NO: 9830
  misc_feature: Ceres CLONE 1999106
  misc_feature (9)..(51): Pfam Name: Ribosomal_L39 Pfam Description: Ribosomal L39 protein

SEQ ID NO: 39661 - DNA, 1359 bp, Panicum virgatum
  misc_feature: Ceres CLONE 1999118
  misc_feature: Encodes the peptide sequence at SEQ ID NO. 39662
aaatggggatcaatcatgccagcgcccctcctcccctgcctaccctgcgtgacgtaacctagccgcgccgcgcctcctccggtcggacgcctcgcgccgcgcctccgccggtcggacgcctcgcgccgccgatcgaatccatggacgccgaggctgccgtcgtcggcgccgaccagctgccgcggaggcagtactacatgaatttattactattagcttaccagagctttggtgttgtttatggggacctcagcacatcacctctctacgtttataaaagtacattctctggaaagctccgtcaataccaagatgaggagacagtgttcggtgtgctttccctcatcttttggacgttcactcttattcctttgctgaagtatgtcactattgtcttgagtgctgatgataatggcgaaggtggaccatttgcattgtattcgcttctttgcaggcatgcaaaacttagcttgcttccaaatcaacaagcagctgatgaggaactatcgacatactacagaaatgggtttgctcctcgcaatggatctgcaccttggctaagaaggtttctagagaagcacaaaaaaatgcgaaccgtgcttcttctcatagttctatgtggcgctagcatggtgattggtgatggtatccttaccccagcaatctcagttctgtcatctatgtctggattgcaagttcgagctactggtttagagcatcgttctgtagttctcctttcgtgcattttattggttggtctatttgccttgcaacaccgaggtactcagaaggttgcattcttatttgcaccaattgtcatcatctggctgttttccattggtggaattggtttatacaacatacttcattggaacccaaatatatatcaagctctctctccgtactatatggttaagttctttaggaagacaggtaaagatggctggattgctttaggagggattcttctttcaatgacaggcagtgaagcaatgtttgctgaccttggtcactttacaagtgcctctgtcagggtggcttttgttactgtcatatatccatgtcttatactacaatatatgggtcatgctgcatttctatccaagaacactttccacatgacgacaggtttttatgatactatcccagaacctgtgttttggcctgtattcgtggtggccacactcgctgcagttgttggtagccaagctgtaatttcagcaacgttctccattgtgaaacagtgccatgctttgggatgtttcccacgagtgaaggttgtccacacatcgaggtggatctatggacagatatatatcccagaaataaattggatccttatggtgctttgcgtagctg

SEQ ID NO: 39662 - protein, 406 aa, Panicum virgatum
  misc_feature: Ceres CLONE 1999118
  misc_feature (24)..(406): Pfam Name: K_trans Pfam Description: K+ potassium transporter
  misc_feature: Useful for making plants with modulated biomass
MDAEAAVVGADQLPRRQYYMNLLLLAYQSFGVVYGDLSTSPLYVYKSTFSGKLRQYQDEETVFGVLSLIFWTFTLIPLLKYVTIVLSADDNGEGGPFALYSLLCRHAKLSLLPNQQAADEELSTYYRNGFAPRNGSAPWLRRFLEKHKKMRTVLLLIVLCGASMVIGDGILTPAISVLSSMSGLQVRATGLEHRSVVLLSCILLVGLFALQHRGTQKVAFLFAPIVIIWLFSIGGIGLYNILHWNPNIYQALSPYYMVKFFRKTGKDGWIALGGILLSMTGSEAMFADLGHFTSASVRVAFVTVIYPCLILQYMGHAAFLSKNTFHMTTGFYDTIPEPVFWPVFVVATLAAVVGSQAVISATFSIVKQCHALGCFPRVKVVHTSRWIYGQIYIPEINWILMVLCVA

SEQ ID NO: 39663 - DNA, 529 bp, Panicum virgatum
  misc_feature: Ceres CLONE 1999118-R
  misc_feature: Encodes the peptide sequence at SEQ ID NO. 39664
gatgatgatatgggtcagcaagtgaaagatgagctcatggcacttgtggaagcgagacatgctggggtggcatacatcatgggccattcttatatcaaagctaggaggagttcgagtttcctgaagaagtttgctattgatgttggctactctttcctccggaagaactgcagaggtccatcggtcacactgcacattccgcacattagcctgatagaagtgggcatgatatactatgtttagccgtatgcccattgccaagttcatgtggatacctggttgctatgaagcatgtgctacctgcggctttgttctggagttaaaaggctcgtggagaagagatgatgcatcctaaggtgcttctggtttcagcttgtagagatgactttccttgttaatattatttttagcctaaataaacaatcagaacggggcgagttacgctaagttttccgtttggtgtatttacatgcatgctctgtaatttttctgagagctatgtaatggaaatatgcattatcttgttctt

SEQ ID NO: 39664 - protein, 80 aa, Panicum virgatum
  misc_feature: Ceres CLONE 1999118-R
  misc_feature: Useful for making plants with modulated biomass
DDDMGQQVKDELMALVEARHAGVAYIMGHSYIKARRSSSFLKKFAIDVGYSFLRKNCRGPSVTLHIPHISLIEVGMIYYV

SEQ ID NO: 39665 - DNA, 683 bp, Panicum virgatum
  misc_feature: Ceres CLONE 1999134
  misc_feature: Encodes the peptide sequence at SEQ ID NO. 39666
atctccttcccatcccctcccttgcgggcctcggcgccttgccctcgcgctctcgcggcagatcccgaggtggctcgcatttccagacacagcgccccgacgacacgcgatcccaacgccaagggtcaactcgaatccaccaccacccccgctcccgcgcccgccttaaacgccgccgcgtcgcgtcgcgtcgtccaccacgacgcagtcgcagccgcagccggagcagcagcagatccaccaccgacgcgcacgcgcacgcaggcgcggagccctggatcccgcggagcaggaggcggtcaagccgtcgcccacgccccccgggcgcatccgctaccgcacgccctcctccccggacctcctcctccccaccgacgccaagatgcgcccgcgctactccgcgctgcccaacggccgccaggacacgctcgccgaccgcctccaccgctaccgcggcgtcctgctcctcctcctcgccccgctcgccctcgtctccctcgtgctcctcctcatgccgcgcccgcccgccgcctcctcctcctcctcctccaggaggacggggcccttggatgccgccgcgggtgctaagaggtacgccgtcatcttcgacgccgggagctccggcagccgcgtccacgtcttctgcttcgacgccaacctggatctggtcaacattgggcagc

SEQ ID NO: 39666 - protein, 100 aa, Panicum virgatum
  misc_feature: Ceres CLONE 1999134
  misc_feature (71)..(100): SWISSPROT Homolog: EC 3.6.1.15 Nucleoside-triphosphatase
  misc_feature (68)..(99): SWISSPROT Homolog: EC 3.6.1.5 Apyrase
MRPRYSALPNGRQDTLADRLHRYRGVLLLLLAPLALVSLVLLLMPRPPAASSSSSSRRTGPLDAAAGAKRYAVIFDAGSSGSRVHVFCFDANLDLVNIGQ

SEQ ID NO: 39667 - DNA, 596 bp, Panicum virgatum
  misc_feature: Ceres CLONE 1999136
  misc_feature: Encodes the peptide sequence at SEQ ID NO. 39668
agcctccacttgctccccaacgcctcccgccgccgggcgggacgccgcgcgtcggctccccgtcgccctacgcccgcgggcgtgccgcgcgggccccgctcgccaggcggccaggcgcgacattcgcgcccgcttcctcccgcgttggccgccgcggcagtggcagagggagggaggaccacgtcgggcgccagaagagcagcgaggagtctagtgcgcggcgaggtcgctgtggtggtggtggtcgtgcgtcggcggtaggcggtggttctcggctgccgacatggagagcacgctcaaggggatacggggctgcgacgcgcccggcgtgctggacatggacgacgcggccaccgtgggcggcggcgccggggacacctacggcgaggactgcgccaccgaggaccatctcgtcactccctgcaccgtctccgtctccagtggttacaatttgatgagggacccccgctacaacaagggcctcgccttcacagagagggagagcgagacacactacctccgtggccttctgccaccagctatagtatcccaagagctacaggagacaaagatcatgaataatatcagacaatatc

SEQ ID NO: 39668 - protein, 104 aa, Panicum virgatum
  misc_feature: Ceres CLONE 1999136
  misc_feature: SWISSPROT Homolog: EC 1.1.1.40 Malate dehydrogenase (oxaloacetate-decarboxylating) (NADP(+))
MESTLKGIRGCDAPGVLDMDDAATVGGGAGDTYGEDCATEDHLVTPCTVSVSSGYNLMRDPRYNKGLAFTERESETHYLRGLLPPAIVSQELQETKIMNNIRQY

SEQ ID NO: 39669 - DNA, 713 bp, Panicum virgatum
  misc_feature: Ceres CLONE 1999139
  misc_feature: Encodes the peptide sequence at SEQ ID NO. 39670
ctgcgcgccttgttgttttgttggtcttggacgagccctaatcccttgttggttttccccagcaagcttcctgtcgattccttttgttgctgtttcagatcaatttgcagccacacacacatatgagatagatagggaggaaagggaagatcgacgacagctctgctagtccaatccagaaataaactaaggctaccaaaagggaaaagattcccttgttcttgagcggtaagtttgtcaaggacaaatctggagggcgcgatggcatccaattcatcggcggcggctgttgcagcgctgtttggaattagggatggcgaccaccaggagcagattaagccgctgcttgcgcagccgcaccagcagctgcctcctgcgccactgctcagcgcggccgcctcgtcgtcggctccagggtccgcccaggcggcggcggcgtcaccgccagtgaagaagaagagaaccctaccagaccctgacgctgaggtgatcgccctgtcgcccaagacgctgctggcgacgaaccggttcgtgtgcgaggtgtgcaacaaggggttccagcgggagcagaacctgcagctgcaccggcgcgggcacaacctgccgtggaagctgaagcagaaggacccgctgcaggcgcagcggcggcgcgtgtacctgtgcccggagccgacgtgcgcgcaccacgacccgtcccgcgccctgggcgacct

SEQ ID NO: 39670 - protein, 150 aa, Panicum virgatum
  misc_feature: Ceres CLONE 1999139
  misc_feature (90)..(112): Pfam Name: zf-C2H2 Pfam Description: Zinc finger, C2H2 type
  misc_feature: The sequence is a functional homolog of SEQ ID NO 1086 in the 10/666,642 US patent application
  misc_feature: Useful for making plants with modulated biomass
  misc_feature: The sequence is a functional homolog of SEQ ID NO 1719 in the 11/479,226 US patent application
  misc_feature: The sequence is a functional homolog of SEQ ID NO 214 in the 10/225,066 US patent application
  misc_feature: The sequence is a functional homolog of SEQ ID NO 2450 in the 10/374,780 US patent application
  misc_feature: The sequence is a functional homolog of SEQ ID NO 604 in the 10/412,699 US patent application
  misc_feature: The sequence is a functional homolog of SEQ ID NO 960 in the 11/435,388 US patent application
MASNSSAAAVAALFGIRDGDHQEQIKPLLAQPHQQLPPAPLLSAAASSSAPGSAQAAAASPPVKKKRTLPDPDAEVIALSPKTLLATNRFVCEVCNKGFQREQNLQLHRRGHNLPWKLKQKDPLQAQRRRVYLCPEPTCAHHDPSRALGD

SEQ ID NO: 39671 - DNA, 1435 bp, Panicum virgatum
  misc_feature: Ceres CLONE 1999147
  misc_feature: Encodes the peptide sequence at SEQ ID NO. 39672
gcgctagtcctaaaaccctctcctccctccacctctcgcgccgccaccgccgccgccgccgcaaaaccctagctccgacgatccgccgccgccgcaaaaccctagctccgacgacacgccgccgccgttgccgcggccgccgaaactagctatggcgtcgactcaggcgcttaagaagaactaccgctgcgaccgctcgctgcagcagttctacacgggcgggccgttcgcggtcgggcgcggccccgccggcgaggccgaggccgaggccgagccgttcctcgcgtgcgcatgcggcggggaggtgcgcgtggtgtccgcagcggacgcttccgcgataggcgagcccgtcgagtgcgactcggaggccatcaccgcgctgaccctgtccccggactcccgcctcctttttgctgcggggcacagcaggctcatcagggtctgggacctcgcgacccgcacttgcatacgcagctggaagggacatgatggtcctattatggccatggcatgccatgcttctggtgggttgcttgcaactgccggagcagacaagaaggtctgcgtgtgggatgtggatggtggattctgcacgcatttcttaagaggtcatacaggtgttgtgacgaccattatgttccacaaagatccaaagcgccttctgttattttcaggaagcgaagatggcaccgtgcgagtatggaaccttgaaaccaaaaaatgtgttgctgtgctgaaagagcatttttcaacagtcacttcattgtcattgtctgatgatggacaaacattgctcagttctgggagggataaggttgttactgcgtgggatgttcgtaagtacagctcaaggaagacaataccaacgtatgaaatgatagaagctatttccttcattggatcaggaagtgaggtactggcttgtttgggcatagaactggcaaatatgaaaggaaaaatggatggttattttcttacagtaggtgaacgtggggttgtgcgcatctggtgcttggagagtggtcattgcatattcgagcagcaatcatctgatgtaactgtaaactcagagaatgaggaaaccagaaggggttttacatctgctgttatattgccaaatgatcaagggttgctatgtgttactgctgatcagcagtttttgttctattgtcccaaaaaaactgatgaagggatcttccaactgtccctatatagacgtctagtgggttataatgatgagattcttgacttgaagtttgttggagatgacgaacaataccttgctgtagctactaacttggagcaggtccgtgtttatgatgttgcttcgatgtcatgttcttatgtactggctggccacacggaaattgttgtttgcatcgacacctgtgtctcttcttctgggaagacgcttattgtaactgggagcaaggac

SEQ ID NO: 39672 - protein, 427 aa, Panicum virgatum
  misc_feature: Ceres CLONE 1999147
  misc_feature (103)..(141): Pfam Name: WD40 Pfam Description: WD domain, G-beta repeat
  misc_feature (145)..(185): Pfam Name: WD40 Pfam Description: WD domain, G-beta repeat
  misc_feature (189)..(227): Pfam Name: WD40 Pfam Description: WD domain, G-beta repeat
  misc_feature: SWISSPROT Homolog: EC 2.7.11.7 [Myosin heavy-chain] kinase
MASTQALKKNYRCDRSLQQFYTGGPFAVGRGPAGEAEAEAEPFLACACGGEVRVVSAADASAIGEPVECDSEAITALTLSPDSRLLFAAGHSRLIRVWDLATRTCIRSWKGHDGPIMAMACHASGGLLATAGADKKVCVWDVDGGFCTHFLRGHTGVVTTIMFHKDPKRLLLFSGSEDGTVRVWNLETKKCVAVLKEHFSTVTSLSLSDDGQTLLSSGRDKVVTAWDVRKYSSRKTIPTYEMIEAISFIGSGSEVLACLGIELANMKGKMDGYFLTVGERGVVRIWCLESGHCIFEQQSSDVTVNSENEETRRGFTSAVILPNDQGLLCVTADQQFLFYCPKKTDEGIFQLSLYRRLVGYNDEILDLKFVGDDEQYLAVATNLEQVRVYDVASMSCSYVLAGHTEIVVCIDTCVSSSGKTLIVTGSK

SEQ ID NO: 39673 - DNA, 590 bp, Panicum virgatum
  misc_feature: Ceres CLONE 1999147-R
  misc_feature: Encodes the peptide sequence at SEQ ID NO. 39674
gattcagaggatccaatagaaaaggctctttttggacttccaaaggatggccttcgtgtgcttcttgagtacatccgtgaatggaatacgaagcccaagttttgtcatgttgcacagtttgtgctttttcgggtattgaggtgtttgcctcccactgatatcctggagataaagggcatcagcgagctccttgagggtcttattccgtattcgcagaggcatttcagcagagttgatagactagtgcgaagcacatttctgttggactatacattgatgcgaatgtccgtggtagatccagatgtagatgcaggcacagccaaagatgacatgaatggttcatcagtggagaacgatgaaaccgcagaggcttggcctgcttcgcctgtaacagagaaatcgggcaagaagagaaaacagggcaaatcaagcaaaaagggcaaggagaagaagatgaaggttctttcaaaggatgtttcagttgaggcctgaatagatagctaagaaaatagcttatgggcaccgcccattttgtagccgttgtaatcgtaattgaccttctcccccaacacgcacagcttccggcgcac

SEQ ID NO: 39674 - protein, 163 aa, Panicum virgatum
  misc_feature: Ceres CLONE 1999147-R
  misc_feature (1)..(96): Pfam Name: Utp13 Pfam Description: Utp13 specific WD40 associated domain
DSEDPIEKALFGLPKDGLRVLLEYIREWNTKPKFCHVAQFVLFRVLRCLPPTDILEIKGISELLEGLIPYSQRHFSRVDRLVRSTFLLDYTLMRMSVVDPDVDAGTAKDDMNGSSVENDETAEAWPASPVTEKSGKKRKQGKSSKKGKEKKMKVLSKDVSVEA

SEQ ID NO: 39675 - DNA, 1378 bp, Panicum virgatum
  misc_feature: Ceres CLONE 1999168
  misc_feature: Encodes the peptide sequence at SEQ ID NO. 39676
gtctgcctctcctctccctccgcgcgctgccaggggcctgtccgctccgccccccagccccccctcctgggctccgcggcgaacagcgccgccgccggtgcacccggcctaccccctcatccttcctccctctcggccgcgcgccaccctcgttcctcgtcacctcggattcgtcacctcgccaagcgcaccgccatcgggttctcgtcgtgcctgggctggaccggccgccgccgggggggcctcgccgtccgtggaccggcaggcgccgcgggagccgggaggcctcgccgtccctggaccagcaggcgccgcgggggccctcggcgcccctggaccggcaggcgccgcgggagccctcgccgccccctcgactggccgccgccacggggggctcgcagttcctggatccgccgccgccttgagggccctgcagccgccgcgacgggactctgcgggtacgggcatacccgcgggcacgtgatatccgcggatagggattttacccgttgccatctgtaagagatcgacattagttggcacacaggacttgttgctgctcaataaaggtgcggggtgcagcttgtgttccacaaattttggggggttcgagcgaacccccgtgccgcaagccgaccacgcccccgccatggcgtctgcggcttgcagtataaggggccctctcaaactcgctgcaacgtgcggcaccgccgctgtgtattattcgtgcaactgctacaggacttgggtgtcttaccccgttgctcaggggtggagcagcaattgctcttcggttgcgacgcggcatgtcgcatcccattgtcaattgagtgttcgggcttcagcaaggtggcaatccaacctgaaagcttcagctaccgatgcagatgagaagataactgtactcgtcatcggtggtggaggcagggagcatgctctttgttacgccttgaaccgctccccgtcttgcactgcagttctatgcgcccctggtaatgcgggtattgctcagtcaggggacgcaacctgtatcccagacttggacatctccagtagtgatgatgttatctcgttctgtcgcaagaggggagtggaaatggttgtagtgggccctgaagccccgcttgttgccggtcttgctaatgaccttgtcagagttgggataccaacctttggcccttcttcagaggctgcagcactagaagggtccaaggacttcatgaagaagttgtgtgataagtacaatatccccacagccaaggtacttcatgtttcgtttatgttgattgttaaccctataggctagtcttggtatgactatgggattttgtctatggaagaagcctgcctataggtgatgatatatagggttaagaca

SEQ ID NO: 39676 - protein, 218 aa, Panicum virgatum
  misc_feature: Ceres CLONE 1999168
  misc_feature (83)..(185): Pfam Name: GARS_N Pfam Description: Phosphoribosylglycinamide synthetase, N domain
  misc_feature: SWISSPROT Homolog: EC 6.3.4.13 Phosphoribosylamine--glycine ligase
MASAACSIRGPLKLAATCGTAAVYYSCNCYRTWVSYPVAQGWSSNCSSVATRHVASHCQLSVRASARWQSNLKASATDADEKITVLVIGGGGREHALCYALNRSPSCTAVLCAPGNAGIAQSGDATCIPDLDISSSDDVISFCRKRGVEMVVVGPEAPLVAGLANDLVRVGIPTFGPSSEAAALEGSKDFMKKLCDKYNIPTAKVLHVSFMLIVNPIG

SEQ ID NO: 39677 - DNA, 607 bp, Panicum virgatum
  misc_feature: Ceres CLONE 1999168-R
  misc_feature: Encodes the peptide sequence at SEQ ID NO. 39678
agaagaaatctgggctgcctaagcttattgagtataatgtgagatttggtgacccagaatgccaggttctgatgatgcgattggaatctgatttagcacaagttctattatccgcttgccagggagaattacagaatgtttcactaagctggtcatctgaaatggcaatggtcgttgtgatggctagccagggatatcctggatcttatattaaggggactgtaataaaaaacctcgacaaggctgagcaggtctctccagctgtcaagatattccatgctgggacagcactagatggagatggcaatcttgtcgctgttggaggccgagttcttggtgtcactgctaagggcaaggacattgaagaagcaagggaaagggcatatgatgcagtagatgctgtcgattggccagaaggatttttcaggcgtgacattggttggagagcactgagacactcatgagattatcatagtggatttattttttaaaaaaggattatcatagtgaaccacaacttggcgagcttgtactgttatgagtaataaaaagggaaacggtgtaatgtcactcctttttggttgtgggaagataaagatttactggt

SEQ ID NO: 39678 - protein, 153 aa, Panicum virgatum
  misc_feature: Ceres CLONE 1999168-R
  misc_feature (54)..(150): Pfam Name: GARS_C Pfam Description: Phosphoribosylglycinamide synthetase, C domain
  misc_feature: SWISSPROT Homolog: EC 6.3.4.13 Phosphoribosylamine--glycine ligase
KKSGLPKLIEYNVRFGDPECQVLMMRLESDLAQVLLSACQGELQNVSLSWSSEMAMVVVMASQGYPGSYIKGTVIKNLDKAEQVSPAVKIFHAGTALDGDGNLVAVGGRVLGVTAKGKDIEEARERAYDAVDAVDWPEGFFRRDIGWRALRHS

SEQ ID NO: 39679 - DNA, 1383 bp, Panicum virgatum
  misc_feature: Ceres CLONE 1999170
  misc_feature: Encodes the peptide sequence at SEQ ID NO. 39680
agagagagagaggaaaggagggagagggaagcgagcaccataggccaccgcagcgggcaggcggcgagcaagacgcctccacacgtctctcccccttccccttcttcctcccccgtccctgtagcggcgcccagcacagccaaaccccgtggaatcctcgcccgatgcggcccgggtaggggtcggggggcggagcggaatggcggagggaggcgagaagcggcgccgggtgggaggtggtggggaccacgaggaggaggaggaggtggtggaccgcatctcggagctgccggacgcgctgcggctgcagattctgagcctgctgccgctcaaatcggccatccgcaccggcgcgctctcctcgcggtggcggggcctctgggagcagcgctggccggagccatcctcgctgcgcatccgcctcccgcccggcgcggcgggggcggcggcgcgggtggagcagttcggggtcatcgaccgccgcgggaggcgccggatggactgcttcgcgctcgccttccacgggggccagctcacgcagccggacctcaggcgctgcctcgactacgcggccgcgtgcgaggtcgaggacctgcacctccgcctcgacggcgccgcggggagggggtcgcgcgggggcggcggcggggccacccgcggccggggcatgctcaccgcgcacttccccgtggggagccgcctgctcgcgcgcctctccgtgcgggggctcaacctcacggcggccgccaacgcgatggtcgccacgctcgaggtgatccacctccactccgtcttcctcaccgacgctgcgctgcgccgggtcgtcgccgcttgcccccgcctacgggagctcgatctccgctactgccgccgcctccgacgtgtcgacttcagcgccgtgggggtgcccaacctcaggagcttcaccatcgtcgactgctcccgcaccaccgagctgcgagtcccagtggcgccacgcctccggtccttccgcttcagcggcaccttcctctccagcaacatcctttctggtgcttcagggtcacttgagcatctctacctctgctccggcgggccagagaccggcttgccgcccaccaacttgcccacctcagtttctcgcctatcgaacctcaccgtcctcaccctctgcagcattgcgctccagtacatctctgcttccacagccaagaccgtagtggagagcaatctgcacagcttgagagagctccatttcctcatgttcggcatggccaactccaaccttgctgacatctatagcttcctcaagacttgttcatgtcctcagctggagcggctctttgtgcagctcccgacgaacattcgtgattcattcacggagaatttcttggcggtggcaaa

SEQ ID NO: 39680 - protein, 394 aa, Panicum virgatum
  misc_feature: Ceres CLONE 1999170
  misc_feature (25)..(72): Pfam Name: F-box Pfam Description: F-box domain
MAEGGEKRRRVGGGGDHEEEEEVVDRISELPDALRLQILSLLPLKSAIRTGALSSRWRGLWEQRWPEPSSLRIRLPPGAAGAAARVEQFGVIDRRGRRRMDCFALAFHGGQLTQPDLRRCLDYAAACEVEDLHLRLDGAAGRGSRGGGGGATRGRGMLTAHFPVGSRLLARLSVRGLNLTAAANAMVATLEVIHLHSVFLTDAALRRVVAACPRLRELDLRYCRRLRRVDFSAVGVPNLRSFTIVDCSRTTELRVPVAPRLRSFRFSGTFLSSNILSGASGSLEHLYLCSGGPETGLPPTNLPTSVSRLSNLTVLTLCSIALQYISASTAKTVVESNLHSLRELHFLMFGMANSNLADIYSFLKTCSCPQLERLFVQLPTNIRDSFTENFLAVA

SEQ ID NO: 39681 - DNA, 574 bp, Panicum virgatum
  misc_feature: Ceres CLONE 1999170-R
  misc_feature: Encodes the peptide sequence at SEQ ID NO. 39682
caaggcatgtcgaagggcctctagacatgaaggtagacgttcgtgaggaagtgaagaagcaaaaggcaaagaagaggaagcggaagcctagatacccgaagggctttgatccagcaaacccggggccgccaccggatcctgagagatggctgcccaggagagagcgatccagttaccgtccaaagaggaaggataagagggctcaggtcagaggttctcaaggagctgtaactagagagacagcggctgccagtggttcttcaaaaggaagccaaaacaccagttcatcaaagactccagcggcaaacaccgatcagccaaaggctagcaacaaatccaggaagaagaagtcgaggtcttaggtgattttttttaagttaaacaaactgacagtgcaaaaggacatgcccatttaccttgttgacttgcaatttttgggttggattgcttgcgtatttgctttgcttttgcagtttgtttaaagtgacttgaaaattttgttgagctcaatcgcgatggaacgctccattagatttctgttctctttataagtttatatacagtacttttgttg

SEQ ID NO: 39682 - protein, 119 aa, Panicum virgatum
  misc_feature: Ceres CLONE 1999170-R
  misc_feature (5)..(60): Pfam Name: SRP72 Pfam Description: SRP72 RNA-binding domain
RHVEGPLDMKVDVREEVKKQKAKKRKRKPRYPKGFDPANPGPPPDPERWLPRRERSSYRPKRKDKRAQVRGSQGAVTRETAAASGSSKGSQNTSSSKTPAANTDQPKASNKSRKKKSRS

SEQ ID NO: 39683 - DNA, 620 bp, Panicum virgatum
  misc_feature: Ceres CLONE 1999172
  misc_feature: Encodes the peptide sequence at SEQ ID NO. 39684
ctcttcttcctttcttccttccccgccactcgcgtagaagcacaagggagaaaagaaaaaacagagaggaagaaaaaaaacaggagggtaaaaaagggggcgggccgccccgcccaccacccacgaaaggaacgcgcccaatctggtcctgctgctgctgctgcggtggtggtggaggtggttcccggcggcctccagggcagggcagccgctacccccgcgccggccccgacccgccgctgccacccgccgacgccatggcgggctccatggtggaccgggccaccagcgacatgctcatcggcccggactgggccaagaacatggagatctgcgacatctgcaaccgcgaccccgggcaatcaaaagatgttgtcaaggcgctaaaaaaacgaattgggcacaaaaatccgaaagtccaactccttgcactgaccctgttggaaactgttatcaagaactgtggtgatatactccacatgcatgttgcagagagagatatattgcatgagatggtgaagatagtgaagaagaagtctgatcctcgtgtcaaagagaaggtattggtgctaatagatacatggcaggaagcttttgggggaccacgtgcaagatatccg

SEQ ID NO: 39684 - protein, 120 aa, Panicum virgatum
  misc_feature: Ceres CLONE 1999172
  misc_feature (1)..(114): Pfam Name: VHS Pfam Description: VHS domain
MAGSMVDRATSDMLIGPDWAKNMEICDICNRDPGQSKDVVKALKKRIGHKNPKVQLLALTLLETVIKNCGDILHMHVAERDILHEMVKIVKKKSDPRVKEKVLVLIDTWQEAFGGPRARY

SEQ ID NO: 39685 - DNA, 1267 bp, Panicum virgatum
  misc_feature: Ceres CLONE 1999179
  misc_feature: Encodes the peptide sequence at SEQ ID NO. 39686
aaaacgaaaagagccgcaccaccaagttaccaacccacgttccagcagcctccacttgctcccccacgcctctcgccgccgggcgggctgccgcgcgtcggctccccgtcgccctccgcccgcggccgcgggcgtgccgcgcgggccccgctcgccaggcggccatgcgcgccaatcgcgcccgcttcctccggcagtggcagtgggagggaggaccacgtcgggcgccggaggagcgaggagtcgaggccgcggcgagatcgctctggtggtggtcgcgcgccggcggtacgcggcggcggttctcgtccgcggagatggagagcacgctcaaggggatacggggctgcggcgcgcccggcgtgctggacgtggacgacgcggccaccgtgggcggcggcgtcggggacacctacggcgaggactgcgccaccgaggaccagctcgtcacgccctggaccgtctccgtcgccagtggttacaatttgatgagggacccccgctacaacaagggcctcgccttcacagagagggagcgcgagacgcactacctccgtggccttctgccaccagcaatagtatcccaagagcttcaggagagaaagatcatgaacaatatcagacaataccaggtgcctttgcagcgttacatggctatgatggacttacaggagaacaatgagaggcttttctacaagctcctcatcgacaatgtcgaggaattacttcctgtagtgtacacaccaactgttggtgaggcttgccagaagtatggttccatatttagtcgtcctcagggtctttttatcagcttgaaggagaagggaaagatccttgaggtactcaagaactggccagagaggagcattcaagttattgtagttactgatggtgaacggattttggggcttggagatcttggatgtcagggaatggggatccctgttggcaagcttgccctttacactgccctgggaggagttcgtccatctgcttgcttacctatcacactggatgttggcacgaataataaggacctgcttaatgacgaattttacattggcctgagacaaagaagggccactggccaggagtatactgattttctgcaagaatttatgaccgctgtgaagcaaaactatggagagaaagtactcattcagtttgaggattttgccaacgataatgcctttgagctccttgcaagatatggcacaactcacccttgtttccatgatgatatcccagggaaaccgcttctgtggtt

SEQ ID NO: 39686 - protein, 316 aa, Panicum virgatum
  misc_feature: Ceres CLONE 1999179
  misc_feature (118)..(307): Pfam Name: malic Pfam Description: Malic enzyme, N-terminal domain
  misc_feature: SWISSPROT Homolog: EC 1.1.1.40 Malate dehydrogenase (oxaloacetate-decarboxylating) (NADP(+))
MESTLKGIRGCGAPGVLDVDDAATVGGGVGDTYGEDCATEDQLVTPWTVSVASGYNLMRDPRYNKGLAFTERERETHYLRGLLPPAIVSQELQERKIMNNIRQYQVPLQRYMAMMDLQENNERLFYKLLIDNVEELLPVVYTPTVGEACQKYGSIFSRPQGLFISLKEKGKILEVLKNWPERSIQVIVVTDGERILGLGDLGCQGMGIPVGKLALYTALGGVRPSACLPITLDVGTNNKDLLNDEFYIGLRQRRATGQEYTDFLQEFMTAVKQNYGEKVLIQFEDFANDNAFELLARYGTTHPCFHDDIPGKPLLW

SEQ ID NO: 39687 - DNA, 522 bp, Panicum virgatum
  misc_feature: Ceres CLONE 1999179-R
  misc_feature: Encodes the peptide sequence at SEQ ID NO. 39688
cacgatgacatgcttctggcagcctcggaggctcttgctcagcaggtctcagaagagaactttgaaaaggggctcatctatcctcccttctcaaacatcaggaagatctccgcgcacattgcagccaacgttgcagcaaaggcatatgaacttggtttggcaagtaggcgccctcggccgaaggacctggtgaaatatgcagaaagctgcatgtacagccccgtttaccgcaactaccgctgaattcgaatcgatttcagttatgtgcaaccatcagccattgcagaatcacaaaatttcctaagaacactactcgattcagatcctccatgctgtaattaggctgtctctagcagagcagctcacgtcctgttctccccctgtgtgttctgcagtgttttttctttgcgatgtgatgtgaaatgcctccggccaggcttttgtatcctagtcattgtgctactgccgtccttccggagaagggtaaatttggaataataaagtcggatcgacagttttctc

SEQ ID NO: 39688 - protein, 80 aa, Panicum virgatum
  misc_feature: Ceres CLONE 1999179-R
  misc_feature: SWISSPROT Homolog: EC 1.1.1.40 Malate dehydrogenase (oxaloacetate-decarboxylating) (NADP(+))
HDDMLLAASEALAQQVSEENFEKGLIYPPFSNIRKISAHIAANVAAKAYELGLASRRPRPKDLVKYAESCMYSPVYRNYR

SEQ ID NO: 39689 - DNA, 1354 bp, Panicum virgatum
  misc_feature: Ceres CLONE 1999190
  misc_feature: Encodes the peptide sequence at SEQ ID NO. 39690
gtcaccttttttccgttcccccgttcccttctctctctctctctcggggttcctggcggcgccggctgggcgagcgggagcgcaatcagccacgccttcgccggcccctttttgccggcgacgagcatccaccaggagctccacccatcttcttctcctcccatcctctcttctccagcagcgggcccgtcccctccggccccgcgcgaggcgaggcaagggtagaccggcgcgaggcggggcgccgtcaggtcgccggcgcggggcgccatcgggtcacaggcgcggggcggaaccagggagccgccgcgctgggggtgtagccggggcgcagggtgcgccgccgccgtcgcggtgggggtgtagcaggggcgctcggccggcggatgaacgacttgcttctcccctacatctaggggagaggagcgtccagatgggttcgaagaaggttccgtaccacaagcatcgggaggctgaggaggcgaggaagaagagggaggaagatgaagcagcacgcgtatatgcggaatttgtcgagtcattcaagggtgacagctcatctggggctaagtttgtccgaggtggtgtgatcgacccaaatgcaaagctgaagattgatcctgaaggtggaaaatccaaagatggggggtctgttccaaagaagggcagtaggtatgttccgtccttcttgccaccatcatttgcaaaagagactgagaagaagaaggaagaagaaaggccaaaggaaaaggaaaaaggaaagccacgtgtaatagataaattcatggaggaacttaagtttgagcaagagcaacgggaaaagcgtagtcaggatcgagaccaccggcgtgatcgacacagtgatagctccatgccctctacccggtttgatgagataccagatgaatttgatccgactggaagatttccaggatcatttgatgatggtgatcctcaaaccacaaacttatatgttggcaatctatctccaaaggttgatgagaattttctgttaaggacctttggtcggtttggacctattgctagtgtcaagattatgtggcctagaacagaagaggaacgcaggaggcaaagaaattgtggttttgttgcctttatgaatagagcagacggacaggcagcaaaggatgaaatgcaaggtgttattgtgtatgactatgaactgaagattggatggggaaaatctgttgctcttccatcacaagcattgcccgctcctcctccaggacacatggcaatcagaaataaagagggtggcacagtcatactttctggtcctggcggccctgctgttgcatctgttacaccacaaacctcagagctggtccttaca

SEQ ID NO: 39690 - protein, 306 aa, Panicum virgatum
  misc_feature: Ceres CLONE 1999190
  misc_feature (179)..(253): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGSKKVPYHKHREAEEARKKREEDEAARVYAEFVESFKGDSSSGAKFVRGGVIDPNAKLKIDPEGGKSKDGGSVPKKGSRYVPSFLPPSFAKETEKKKEEERPKEKEKGKPRVIDKFMEELKFEQEQREKRSQDRDHRRDRHSDSSMPSTRFDEIPDEFDPTGRFPGSFDDGDPQTTNLYVGNLSPKVDENFLLRTFGRFGPIASVKIMWPRTEEERRRQRNCGFVAFMNRADGQAAKDEMQGVIVYDYELKIGWGKSVALPSQALPAPPPGHMAIRNKEGGTVILSGPGGPAVASVTPQTSELVL

SEQ ID NO: 39691 - DNA, 388 bp, Panicum virgatum
  misc_feature: Ceres CLONE 1999190-R
  misc_feature: Encodes the peptide sequence at SEQ ID NO. 39692
atgttgggagggacagggtgcgtgataaaagcacgggccgtggtcgtgatgaccagtatgacagaagccgagacagggagaaggacaggagaaagggaaggtgacgatacctaaaatccctgtcacaattcatcatttgcttgcttacaagggccctggagcaaggtaatattcgagctacatcagttaacatcggtggctgcaccacggtaggtttcctggccagttccgagccccttgagaacgtgtctgtaatcggagttttgaggactaaggtgatgcttttgtagagatctgtttgtagtaggtaattttgcggattaagatgaagtcgatgtgtagttttatgccaaaagccaatgtttagtgcaccaagaatgatcacccc

SEQ ID NO: 39692 - protein, 33 aa, Panicum virgatum
  misc_feature: Ceres CLONE 1999190-R
  misc_feature: Useful for making plants with altered terpenoid content
VGRDRVRDKSTGRGRDDQYDRSRDREKDRRKGR

SEQ ID NO: 39693 - DNA, 1327 bp, Panicum virgatum
  misc_feature: Ceres CLONE 1999202
  misc_feature: Encodes the peptide sequence at SEQ ID NO. 39694
attcctcttcgtctttcctctgctgtgcacatggttttggtgccatctcatcaactgctatgatagaaggagtctttccaaagggaacagcgggactctaagtagtcccatgcatgacttaacttatcctactaaattgcgtccctccagtcagtagtcataaaagtctccaagtcttcagagagaatccactcagaatggatttgacaacatctgaagaatatgcttcccaatccaagttactgcaagaattcaccaaagtcccaagcattgacattgcttgggttctcaaaaataacaacgatggcatatccacagcaatgttctccattagccagccagacctactggcgaacagaaccagaaaatacagtatgtactgtcatattaagggggctggtaccaactctagggatttccagtggtctcctttccccactgaaatgacaggagtgtctgtcatcgtcccatccccttcggggtcgaagcttcttatagtgcgaaacggagagaaaggttgccctactaagcttgaaattgttgatcaatcacatgtggagaaggagatacatgtaggtcagtctatgcatggtccgctttataccgatgaatggtttcatggtatttcctggaatcaagaagagaccttgatagcatacattgctgaagctccaccccaaccaagaccagttttcagtgattctggatatagaaagggagactcttctgatgaagactgtaatacctggaaaggacaaggggattgggaagaggactggggtgaaagatactccaaaaaagggagaccctcattgtttgttcttgacattgccagtggagaagtgcgagcggctgaaggcattgcaacatcattgagtgttggccaagttgtttgggttcccccttcttcaagtggcagtcaaaagtatttggttttcgttggatggttagagcacaacgggtttcataacactgctagaaaacttggtatcaagtactgttctaacaggccatgtgctctttatgcaattgctagccctttcgaaagaccagagactgaaaataaaccagtttgcgatggtaaatcagactccgctgcatcagcacacaacttaacagcaagcatcagtagtgctttctttccacgtttcagccacgatggaaaaatcctactcttcctttctgcaaaacaggctgtaaatagtggagcacataatgcaacggattctctgcataagatcaactggctttctgattggaaaatggataaacaacttgatgttactgaagtggtgcctattgtaatgtgccctgaagatggttgttt

SEQ ID NO: 39694 - protein, 376 aa, Panicum virgatum
  misc_feature: Ceres CLONE 1999202
  misc_feature: SWISSPROT Homolog: EC 3.4.19.1 Acylaminoacyl-peptidase
MDLTTSEEYASQSKLLQEFTKVPSIDIAWVLKNNNDGISTAMFSISQPDLLANRTRKYSMYCHIKGAGTNSRDFQWSPFPTEMTGVSVIVPSPSGSKLLIVRNGEKGCPTKLEIVDQSHVEKEIHVGQSMHGPLYTDEWFHGISWNQEETLIAYIAEAPPQPRPVFSDSGYRKGDSSDEDCNTWKGQGDWEEDWGERYSKKGRPSLFVLDIASGEVRAAEGIATSLSVGQVVWVPPSSSGSQKYLVFVGWLEHNGFHNTARKLGIKYCSNRPCALYAIASPFERPETENKPVCDGKSDSAASAHNLTASISSAFFPRFSHDGKILLFLSAKQAVNSGAHNATDSLHKINWLSDWKMDKQLDVTEVVPIVMCPEDGC

SEQ ID NO: 39695 - DNA, 533 bp, Panicum virgatum
  misc_feature: Ceres CLONE 1999202-R
  misc_feature: Encodes the peptide sequence at SEQ ID NO. 39696
agaaatcgccgattgctcatgtcttaaaagtgaaagcgccccttcttaagcttcttggaggagctgatcttcgagtacccgtttctaatggcctacagtacgcaagggccctcagagaaaggggtggccaggtcaaaattatgatgttcccagaggacatacacgaaatcatcataccacggtccgattttgaaagtttcctcaacattggagtttggttcaagacacatctaaaataggtgcagatgcggccgcgtgaagcagtgtgtggtgatacatacgatgaagagctaggcttggggaggcctcaaactttctcatgaaacaagcagattcgtacgggcctcgtacgtgaatctggtttccgttttaagagagaataagccgaaagaagagaagccgaacagagtgaaatgaattaaactcctccattaatattgttagctattcagtcatgatgctttaattcatgactcagacatattgtactcagttttcatccagtccttttttataaggattttctttcatcc

SEQ ID NO: 39696 - protein, 78 aa, Panicum virgatum
  misc_feature: Ceres CLONE 1999202-R
  misc_feature: SWISSPROT Homolog: EC 3.4.19.1 Acylaminoacyl-peptidase
KSPIAHVLKVKAPLLKLLGGADLRVPVSNGLQYARALRERGGQVKIMMFPEDIHEIIIPRSDFESFLNIGVWFKTHLK

SEQ ID NO: 39697 - DNA, 1226 bp, Panicum virgatum
  misc_feature: Ceres CLONE 1999203
  misc_feature: Encodes the peptide sequence at SEQ ID NO. 39698
aagggaggaggggaagggagcggaagagaggtgggggaccgccgcgcctccgtatccggggggagtgacgagctaggcaagcagctcgaccccgcctccgagtgcgcctcgcggcgtcagctccagtcgccgccgccgcgccgtgctcagcagcggagaccagcgagtcaacaggcagcagagagggggagggagcaggcggttgctgcggcgcctggtccggaacgccgcccgctcgtggcatacccgacgctgcatccgcctccgttcgccgtcgcccgtggcacgtacggctagggttttgagatagatcccgcctgccggctcgtgtgcacgcgcgccgcggtgcgggggaggaagagagggagtgcctggctcgcgcggtttcggttccttcttctggaagcttcggggcgcgcgatccggcgcgggcgcaatcggcggcaatgtcgggctcgtcggcggcaggggaggatatagtgcagcacctgtcgtccaattccaacccgtcttcgtcgaagctcgccaagctcgaggcccgcatggccgggaaggctctctcccctccatcatcaccaccgcaccatcccgcggstgcctccgccaccaccgttgccttcatggaccaggaggagctgcctgagacctcctcttctgatgacgataatggcgaggaattcttgatacaaaagaataccctgaagcgtccgagatctccagatggggaccacatacttgctcttggaaattttgagggatcggcaaatgaggcagcgaagattttagatgtcatggattcaagaccgtcctcggacaacacaaataggaaaaaacaaggccgcggaaggggtcgtgctggcacaggacgtggccgtggctcaaaggctgatcaaacacgagcgacttcagcttcctcagctgtaacaaatggtcaactagataaattaaccaacaaggaaccccgatcgagtgttcaacctggccatgacgacaaggctgctttacaggaggaattatcaatattacgtggtaaagttgcatttttggaggaggagcttgctaaatcgcatcaagaagcaaccaattatcatcagcttagtgataggttagcaaaggaattgaaggatctcaaagatcacgatcaacaaatgagatcaaagcaaatgaaggtcctgtctgatctgctgatagctgtctcgaaagcagagaggcaagaagcccgaatg

SEQ ID NO: 39698 - protein, 259 aa, Panicum virgatum
  misc_feature: Ceres CLONE 1999203
  misc_feature: SWISSPROT Homolog: EC 2.7.11.1 Non-specific serine/threonine protein kinase
  misc_feature (50)..(50): Xaa is any aa, unknown, or other
MSGSSAAGEDIVQHLSSNSNPSSSKLAKLEARMAGKALSPPSSPPHHPAXASATTVAFMDQEELPETSSSDDDNGEEFLIQKNTLKRPRSPDGDHILALGNFEGSANEAAKILDVMDSRPSSDNTNRKKQGRGRGRAGTGRGRGSKADQTRATSASSAVTNGQLDKLTNKEPRSSVQPGHDDKAALQEELSILRGKVAFLEEELAKSHQEATNYHQLSDRLAKELKDLKDHDQQMRSKQMKVLSDLLIAVSKAERQEAR

SEQ ID NO: 39699 - DNA, 775 bp, Panicum virgatum
  misc_feature: Ceres CLONE 1999203-R
  misc_feature: Encodes the peptide sequence at SEQ ID NO. 39700
gatctaaaacctggcaatgttctcttcgatgaggttggtgtggcaaaagttacagacttcggcctcagcaagatagtggaggatgatgttggttctcagggaatggaacttacttctcagggggctggaacctattggtatcttcctccagaatgctttgacctcagcaaaacaccatttatttcatctaaggtagatgtttggtcagctggtgtgatgttttatcagatgctgtttggaaggcgtccatttgggcatgaccagactcaggagagaatacttcgggaagatacaattatcaacgcacggagggtggaattcccttcaaagccagctgtatcaaatgaggcaaaggatctgatacgccgctgcttgacatacaaccaatcagagaggccagatgtcctaaccatagcccaagatccttatctctcgtatgcaaagcggtagcaactacgcaggagaaatttttggtgcgggtagctgctcgtttaatgagaatatgtatggggatggatactctcgcgaaggagcaaagggttccacaagctcaagaagaccaaaaagggtgtaattgtatatgttgtaaattagtcagccccacaacagcaaatggcatgaaatcctgacggcgtcagttcaaaggccaagcttctttctaacgtagaggaagcaggcattggtttgaacggtccatgtactctgacatttcttgacgctcttgtgctttgctccccatgcgtaacgtgattttttggctggaggccagtggtcc

SEQ ID NO: 39700 - protein, 149 aa, Panicum virgatum
  misc_feature: Ceres CLONE 1999203-R
  misc_feature (1)..(144): Pfam Name: Pkinase Pfam Description: Protein kinase domain
  misc_feature: SWISSPROT Homolog: EC 2.7.11.1 Non-specific serine/threonine protein kinase
DLKPGNVLFDEVGVAKVTDFGLSKIVEDDVGSQGMELTSQGAGTYWYLPPECFDLSKTPFISSKVDVWSAGVMFYQMLFGRRPFGHDQTQERILREDTIINARRVEFPSKPAVSNEAKDLIRRCLTYNQSERPDVLTIAQDPYLSYAKR

SEQ ID NO: 39701 - DNA, 1902 bp, Panicum virgatum
  misc_feature: Ceres CLONE 1999238
  misc_feature: Encodes the peptide sequence at SEQ ID NO. 39702
agacatcactaaccaagtggctcatgcctccctcaccggcagagcaatggcgcggcggccgcctgctacagcaactccgctgaacccttgcccgcctccgaaccctactccggcttccgcctcccctcgcggcggaggcatggcggccaccacccccgccgccttcttctggccgcctcccggtaactacttcagcaccgtcgacactacacccgtgccgatgcgtcacgggctggacccggggacgcttaacggctacggggacatggtgctcggcttcgtctacgcctacctccctccgccgccggtctccaccgctgccaccctctccgccgccgccgccaccaccgaggacggtgaaggaatcgaccgcatcagcggcctccccgacgacctcctccgccgcatcctctcccggctccccgccaaggacggcgcccgcaccgccgccctctccacgcgctggcgcggcctctggcgctcggcgccgctcgtcctcgtcgacacccacttcctcccccgcggcggcgccgagggccggcccccgagccccgacgccgtctcgcgcgccgtgcgccgcgccgtctccgccgccctccgcgcgcaccccgggccgttccccttcgtcagcctctcctgcgggttcatggaagccgtcgacagggaccgcgccgtgctcgcttgctggttccagctcctcgccaccaagggcgtcgaggagctcgtcttcgtcaaccgccccttgcccctccaaggcctgcgcctccccgccgctctcttcagctgcgcctccctccggcgcctgtacctcggcgcatggaggttcgtcgacaccgccaccctcccgcgtggtgcctccttccccaggctgcatgagctcgtcctcggcgccgtcgccctggaggaccgcgacctcgacttcctgctcgccgcgagccccgtgcttgagatcctcgccattgttggaagcgtgctgaaattgaacgcccgtcttgccagccacagcctacgttgcgcacaattctgccttgccctccttgaagaagtggcggtagtggacgccccgtcccttgagcggttcttcatctggcggtgcgtgaagcaacgccacggcgcgagggtcaagattggccacgccccacggttgagcatgctgggttacttggagccaggagtgcacgtgttggagatcggcaacaccgtcatcaagtctggaacgatgccgagtccaaagaccactgttccaagcgtgaagatgttggcactgcatctgcatttcagaatgcgcaatgaggttaaaatgcttccagccttcctcaggtgttttcccaatgttgaaacactgtgtatccagtctgaagaaactcgtgagcccactggcgagttgaacctcaagttttggcaggagaccagtcccatcaaatgcgttcaaacacaactcaagaggctagtgttccgtgagttccatggggaggaaggtgagttagccttccttatgttcatcgcagaaaatgcccggctgttggaggagatgcttcttgtgatggaacttcgaaggccctcagcaccagaagaactttgtgccagaatgaaggcactggagactacaacgtgggcaagcgggagcaacaaagtgggctacatgctttcccgacctggtgtaggaggagggagcgcttggtctctcaaagcgggttctgactttaagcacaatgatccttttctctgcctatttaaaatgcaaacgcagtaaataaacaatcaagttagacactactggtaatttgccactgttaagcaaattcttctcgatgcatatctgactggagatatcgcagctagttatgtaataacttaattactgttgctgtataacgtgccgtatttccatgtggcatcacc

SEQ ID NO: 39702 - protein, 537 aa, Panicum virgatum
  misc_feature: Ceres CLONE 1999238
  misc_feature (420)..(469): Pfam Name: FBD Pfam Description: FBD
  misc_feature (77)..(124): Pfam Name: F-box Pfam Description: F-box domain
MAATTPAAFFWPPPGNYFSTVDTTPVPMRHGLDPGTLNGYGDMVLGFVYAYLPPPPVSTAATLSAAAATTEDGEGIDRISGLPDDLLRRILSRLPAKDGARTAALSTRWRGLWRSAPLVLVDTHFLPRGGAEGRPPSPDAVSRAVRRAVSAALRAHPGPFPFVSLSCGFMEAVDRDRAVLACWFQLLATKGVEELVFVNRPLPLQGLRLPAALFSCASLRRLYLGAWRFVDTATLPRGASFPRLHELVLGAVALEDRDLDFLLAASPVLEILAIVGSVLKLNARLASHSLRCAQFCLALLEEVAVVDAPSLERFFIWRCVKQRHGARVKIGHAPRLSMLGYLEPGVHVLEIGNTVIKSGTMPSPKTTVPSVKMLALHLHFRMRNEVKMLPAFLRCFPNVETLCIQSEETREPTGELNLKFWQETSPIKCVQTQLKRLVFREFHGEEGELAFLMFIAENARLLEEMLLVMELRRPSAPEELCARMKALETTTWASGSNKVGYMLSRPGVGGGSAWSLKAGSDFKHNDPFLCLFKMQTQ

SEQ ID NO: 39703 - DNA, 718 bp, Panicum virgatum
  misc_feature: Ceres CLONE 1999247
  misc_feature: Encodes the peptide sequence at SEQ ID NO. 39704
gaagcatatctgcgagccaacaagatgtttgtggactacaatgagcctcaaacagaacgagtttactcctcttatcttgagctggaccttgatgaggtggagcctagcatttctggcccaaagaggcctcatgaccgtgtccctttgaaggatatgaaatcagattggcatgcttgcctggacaacaaagttggattcaagggttttgcagtgccaaaggatcagcaggataaggttgtcaaatttgacttccatgggcagccagcggaaatcaagcatggtagtgttgttatagcagcaataactagctgcacaaacacctcaaatcctagcgttatgcttggtgctggccttgtagccaagaaagcctgcgagttgggtcttgaggtgaaaccatgggtgaagactagccttgcccccggatcaggagttgtcacgaagtacttgcttcagagtggtcttcaagagtacttgaaccagcaaggatttcatattgttggctatggatgtaccacttgcattggaaactctggtgatcttgatgagtctgtatcagctgctattacagaaaatgatgttgttgctgctgctgttttgtcgggcaaccggaactttgagggtcgtgtgcaccctctgactcgggctaactatcttgcttcaccaccctctgttgttgcttatgcacttgctgggcctgttgacattgattttgagaaag

SEQ ID NO: 39704 - protein, 239 aa, Panicum virgatum
  misc_feature: Ceres CLONE 1999247
  misc_feature (1)..(231): Pfam Name: Aconitase Pfam Description: Aconitase family (aconitate hydratase)
  misc_feature: SWISSPROT Homolog: EC 4.2.1.3 Aconitate hydratase
EAYLRANKMFVDYNEPQTERVYSSYLELDLDEVEPSISGPKRPHDRVPLKDMKSDWHACLDNKVGFKGFAVPKDQQDKVVKFDFHGQPAEIKHGSVVIAAITSCTNTSNPSVMLGAGLVAKKACELGLEVKPWVKTSLAPGSGVVTKYLLQSGLQEYLNQQGFHIVGYGCTTCIGNSGDLDESVSAAITENDVVAAAVLSGNRNFEGRVHPLTRANYLASPPSVVAYALAGPVDIDFEK

SEQ ID NO: 39705 - DNA, 676 bp, Panicum virgatum
  misc_feature: Ceres CLONE 1999257
  misc_feature: Encodes the peptide sequence at SEQ ID NO. 39706
ctccacgaagccttttcaaaatccaaatcaaactccccgcagacgcccccaaagaccaccgccgctgcctgcgcaccacccaggcctcagctcgagcccaacgaccggcgcctagacgcggctgggcggtcggcctcacctcacctccccccgcgcctcccttcttcctccgtctcgatctcgcctccccgccacccggccagatctcgccctcccggcgctgcggccatggagaacctgatctccctcgtcaacaagctgcagcgggcctgcacggccctcggcgaccacggcgaggagagcgccctcccaacgctctgggactcgctgccggccatcgccgtcgttggaggccagagttctggcaaatcttcggtgttggagagcgtggttgggaaggatttcctaccgaggggttcaggcattgtcactcggcgtccactggtgctgcagctccacagaattgacggagacagggaatatgccgagtttatgcaccaacccaggaagagatatacagattttgctgctgtgaggaaggagatagctgatgaaactgacagagaaactggtcgctcaaagcaaatatcacctgtccctatccatttaagcatctattctccatatggtaagatactgactctggtggagtagcagtatagttggtaacatttcg

SEQ ID NO: 39706 - protein, 141 aa, Panicum virgatum
  misc_feature: Ceres CLONE 1999257
  misc_feature (37)..(140): Pfam Name: Dynamin_N Pfam Description: Dynamin family
  misc_feature: SWISSPROT Homolog: EC 3.6.5.5 Dynamin GTPase
MENLISLVNKLQRACTALGDHGEESALPTLWDSLPAIAVVGGQSSGKSSVLESVVGKDFLPRGSGIVTRRPLVLQLHRIDGDREYAEFMHQPRKRYTDFAAVRKEIADETDRETGRSKQISPVPIHLSIYSPYGKILTLVE

SEQ ID NO: 39707 - DNA, 510 bp, Panicum virgatum
  misc_feature: Ceres CLONE 1999270-R
  misc_feature: Encodes the peptide sequence at SEQ ID NO. 39708
cgagaagataaagatttttttgaagagaatagctggaagtatagtctattagaagatggacagcggacaattggacctcaccaatgggatccattcttctcgaaacccaaagaaaaaggtggagatcctaatagctcatctgctgaagctgccaagaattcttggaaaagtgaacaaagaggacagaattaaaccacaaagtatatcatattggagatgtgatcaagggagcacagttagatacactctctgaagatgctctgatgcaaatacattgcacataggtcaagacccagtagttatgatgatcatgaacatcattgatggtctagttcaccctacagttgtaagaagccattccacgaaaaatgctttggggaaatttggcacacagtgtttgcttacccctacaaatatcattttctacactaatttttgtttgatgtttttggtcaataatcctttgtaagcccttacaggatttagaggtatatcaattttgttataggg

SEQ ID NO: 39708 - protein, 63 aa, Panicum virgatum
  misc_feature: Ceres CLONE 1999270-R
  misc_feature: Useful for making plants with altered cell wall content and/or composition
REDKDFFEENSWKYSLLEDGQRTIGPHQWDPFFSKPKEKGGDPNSSSAEAAKNSWKSEQRGQN

SEQ ID NO: 39709 - DNA, 729 bp, Panicum virgatum
  misc_feature: Ceres CLONE 1999270
acgccggacgctaacgaacgaaagcctccgtccggaccccccgtaaagccaaaccaaaacctcccttttcccctccgttccgctcccctcccctcccctcccgttctagcgctcgctcgcgcgatccgccgatccggtttctccgcgcccggtcgcgaaccccgtcccgattccgccgtttgttccgggtaaccggcgtcgttgatgcggcgcggttcgggccccgggctgtgattcggagctgtcggtgcgggggtggcggcggcggtgttggcgcgggcgcggcgggcctccatgaggcggcggtcggtcctgccgtcccaccacgacgacatggagaagggcggcgggaagccggcgtcctcccgcctctgcttcatcgccacgctctgcgccatgttctgggtcctcatcttctacttccacttcgccgtcgtctccaacgagcccgacgcgcaggctggcggggtgcgcattgcccgcgcccgcctccagctccccgaacctgacggcgccgcccgccacgacatgcccctagagccgcccgcccgcgcgtcggagcggccgcctcctgtcacgcgccccaaggaggaggaggaggagaaggaggagaatcctgccgccgcagcccgccaggaggaggcgccgsccaaggtggcagcgtcgtacccgttcgagcgggcgctcaaaacggaaaaaaacaaaaacaccccgggcggccgctaaata

SEQ ID NO: 39710 - DNA, 1157 bp, Panicum virgatum
  misc_feature: Ceres CLONE 1999274
  misc_feature: Encodes the peptide sequence at SEQ ID NO. 39711
aggaggcaactccactaactgagcaagatctgcctccagttccgtggaggatctccttcaggcttcagcacaagagggactgaacaacagctttggtctgtagtaactggaaatgtatggtggagctattagaaacggtggaggtactaaatttgattcatacgagaatgctttggagaatattctgcggtatccagatgcagaaccagtatgtctaccgttccaatttttggaagccatcacagatggtttttctagcgatcaaataatcggcacaggtggttttgcagtggtttacaaggggattctccggagcgggaaagctattgctgtgaagaagattttggacatgaatctggtggatgatggcaaataccaacgtgagctcgagtatcttatggggatcgaacaccaaaatgttgtacaacttgtaggttactgtgtcgagtcaaagtgggaaaggacgcacaacagcgggcggcatatcatggctgaaacgcgctcacggttgctctgcttcgagtatctaggcaacggaagccttgataaatatgtttccagtgatcctatggaacttggttgggacaggagatacagtatcattgagggaatttgcagaggtttatacttccttcatgaggaatgcaatattgttcatttggaccttaagcctcgaaatataatggtagatgataatatggagccaaaaattatggattttggtttgtcaagactcttgggtgaagaaaaatctaaaaccatcactcagaactgcactggaacacttggatacatggcaccagaatacataaatcgtggcgaaatatcccccgaggcagatatattcagtttgggtgtaataatgatagagttaatcgcaggtcataagaactatcctcagacaaatctactacattcccaatattcgaatgtgaaaaatagcccccaaaatacgcaagcgcctgttcaggaattcactgagaaagagattggaagatggacgaaaatatttgaatcatcacggatcgatgcgaaagcacaggaagtatatagccaacagttgaaacagttaatcgacatagccctaaaatgtgtggaacctgaacggaagaaaaggcctaatgcctgggagatacttcaactttttgttcttaatg

SEQ ID NO: 39711 - protein, 348 aa, Panicum virgatum
  misc_feature: Ceres CLONE 1999274
  misc_feature (47)..(345): Pfam Name: Pkinase Pfam Description: Protein kinase domain
  misc_feature: SWISSPROT Homolog: EC 2.7.11.1 Non-specific serine/threonine protein kinase
MYGGAIRNGGGTKFDSYENALENILRYPDAEPVCLPFQFLEAITDGFSSDQIIGTGGFAVVYKGILRSGKAIAVKKILDMNLVDDGKYQRELEYLMGIEHQNVVQLVGYCVESKWERTHNSGRHIMAETRSRLLCFEYLGNGSLDKYVSSDPMELGWDRRYSIIEGICRGLYFLHEECNIVHLDLKPRNIMVDDNMEPKIMDFGLSRLLGEEKSKTITQNCTGTLGYMAPEYINRGEISPEADIFSLGVIMIELIAGHKNYPQTNLLHSQYSNVKNSPQNTQAPVQEFTEKEIGRWTKIFESSRIDAKAQEVYSQQLKQLIDIALKCVEPERKKRPNAWEILQLFVLN

SEQ ID NO: 39712 - DNA, 1237 bp, Panicum virgatum
  misc_feature: Ceres CLONE 1999281
  misc_feature: Encodes the peptide sequence at SEQ ID NO. 39713
gggcagtgcacttgtgaggcgcctgtgctcttctccctgggatctgccgaaagatccaagcgcaaggccaccaaaccaaaaccaaacaacctcctcccgatctccgaagaaacccattcttttccgctcccgtttcttgtactttcctctcgctcgtctttgatccgtctcccacaaggggagggaggaggagatcattgcagtccctgtcactccacaccgccccgtcatggcgtcctatgcgactcgtttgtccccgtcgtctgattgattaatccgagggcatgggcgccggaggtgagctcggaagatcttgtgcaggaactgcggctataaagctctgttcccctcccctccacttcctcctcatgcaagatgagcagctcttgatcgcgtaggggttgaggagcaggcctcttggtggcggctagtccggagattcttccgggtttctctttctctgttctttttcctgcactttcctcgtctgatatttatcagtttcttctctacttgagttgcttgcttgctggaaagtgaaacccccccaccattgctcgcttcaaagcggtcggatttttactgcaaatagccagccagtctctgagccgacctttttccaccccactctgagccagtctcaggcgagaacaacaacgtcagtttgcagcaaaagaaaaggttccccctcccttgtattgaaagcacacaatttcctccccctctctctgtcttcccaattgactctgtggctgcactcgctcccatcactcgtagggtgagcatagtgatacaggcgtctgcttgttgaatccagtgtgcgccacttctcccacaagctctgcgagcttggtgttatcctacaaggaacagcgtgccaaagctccggtaccaatcttggttggattctgcttcaagggcggtggtgcttcttgtagcaagaagcccaaacatttgatctgctgggcaactgctcggatccttgcaagaaagaggaatcaggcgggcggccatggtgtcccgctcctactccaacctcctcgacctggccaccggcgcggcggaccaggcgccggcggcgggcgcgctgggcgcgctccggcggcggctcccgcgcgtggtcaccaactcggggctcatcgacgattccccggcgtcgccgtccgtcccgccgcggtcgcgcaccatcgtggtggccaaccagctccccatccggtcccaccggcccgcgtcgccg

SEQ ID NO: 39713 - protein, 74 aa, Panicum virgatum
  misc_feature: Ceres CLONE 1999281
  misc_feature: Useful for making plants with altered carbohydrate content
MVSRSYSNLLDLATGAADQAPAAGALGALRRRLPRVVTNSGLIDDSPASPSVPPRSRTIVVANQLPIRSHRPAS

SEQ ID NO: 39714 - DNA, 562 bp, Panicum virgatum
  misc_feature: Ceres CLONE 1999281-R
  misc_feature: Encodes the peptide sequence at SEQ ID NO. 39715
cgaagtgaaaccgcagggcgtgagcaagggcctggtggcgcggcgcatgctggcgtcgatgcaggagcggggcgagtgcccggacttcgtgctgtgcatcggtgacgacaagtccgacgaggacatgttccagctgctcgccacggcgccctgcggggcgtcgctggcgtccaaggcggaggtgttcgcgtgcaccgtcggccgcaagcccagcaaggccaagtactacctcgacgacgcggcggaggtggtaaggctcatgctggggctctcctacgtctccgaggagctggccctggccaaccaccgggacgaagacgacgactcttctctggacgtgtgggagtagcaggccactagtagtgatgagcgtcctgcagcagctgggatggcaggtgcagggcgtagtaccatttgccgttggcctactggccacttggaggctggagtagtttagatgtgtaaatgaggtatggttttcaggataatgcactgtcagtgagtgagtctcacgaatgtggtttggatctagtgatgctctagttacttgccctatgatcct

SEQ ID NO: 39715 - protein, 115 aa, Panicum virgatum
  misc_feature: Ceres CLONE 1999281-R
  misc_feature: SWISSPROT Homolog: EC 3.1.3.12 Trehalose-phosphatase
  misc_feature: Useful for making plants with altered carbohydrate content
EVKPQGVSKGLVARRMLASMQERGECPDFVLCIGDDKSDEDMFQLLATAPCGASLASKAEVFACTVGRKPSKAKYYLDDAAEVVRLMLGLSYVSEELALANHRDEDDDSSLDVWE

SEQ ID NO: 39716 - DNA, 621 bp, Panicum virgatum
  misc_feature: Ceres CLONE 1999283-R
  misc_feature: Encodes the peptide sequence at SEQ ID NO. 39717
cgtccgccaccttctacgcggacgaaggaacacccgaggagcccatgggacgggagagtctccaatcactctggcagaagtacaaggtcgacattgccatgtacggccacgtccacggctacgaacgaacctgcccagtgtatgagaacgtgtgcgtggccaaggggtcggaccactacaccggcgccttcacggcgacgacgcacgtcgtggtcgggggcggcggcgctagcctcgccgactacacggccgcccgggcgcggtggagccacgcgcgggaccgcgacttcggcttcgcgaagctgacggcgttcaaccacacgacgctgctgttcgagtacaagaagagccgggacggcagcgtgcacgaccgcttcaccgtctcccgcgactaccgcgacgtcctggcctgcggcgtcgacaactgccccagcaccaccttggcgtcttagagttcattcatgttgattttttcttagaaggaaaggcaaacgcgccctgccccattccattagaatgaagcaacacgtgtttttagactttacagatcaaggtctctccgacctgggttgggcattattttttggaagacagtcttgctggcatcaaacacggcagttc

SEQ ID NO: 39717 - protein, 149 aa, Panicum virgatum
  misc_feature: Ceres CLONE 1999283-R
  misc_feature: SWISSPROT Homolog: EC 3.1.3.2 Acid phosphatase
SATFYADEGTPEEPMGRESLQSLWQKYKVDIAMYGHVHGYERTCPVYENVCVAKGSDHYTGAFTATTHVVVGGGGASLADYTAARARWSHARDRDFGFAKLTAFNHTTLLFEYKKSRDGSVHDRFTVSRDYRDVLACGVDNCPSTTLAS

SEQ ID NO: 39718 - DNA, 719 bp, Panicum virgatum
  misc_feature: Ceres CLONE 1999283
ctgcttggagcaagcgagcatgatgcaatccctacccagaacggcggccgcggtggcggtgtatgcgctggtcgcccttatcgccgccggcgccgtcgcggcaggaggcggcgagcagccgctgtcgagaatcgccatccaccgcgccatcgtcgagccccagccgggcgccttcgtcgacgcgtcgccggctcttctcggcctggaggtgagccttctagaacaattgcttctctaccgtcgtttgagtgcgcatcattccgccgccgccatgacgagttcatggctactaagcttgagatgctccaacctccaagctcttccgagtaggcgtttagcataggttgagatttctgtcacaaaccaggctgaaactttgcaattcattagcaatatacgtcccaagtacttcaatgtccaaattaaaccaagatttgcagaggtctcatattggccctctctgatggtttgctcagctgcaatcagattatggctgccttatttcttgcaggggaaggacagagaatgggtgaccgtcacatacagcaacccaaaaccttcgaaggatgactggattggagtcttctctcctgctaatttcaatgattccatttgtccatcagagaaccaatgggtggaggcccctcttttatgcacagctcctattaagttccaatttgcaaactacacaagtcgtaactaccaacacactggaaagg

SEQ ID NO: 39719 - DNA, 681 bp, Panicum virgatum
  misc_feature: Ceres CLONE 1999287
  misc_feature: Encodes the peptide sequence at SEQ ID NO. 39720
atcctcactcccaacactaatggacacttccaccagcaccagcccgccctttattttctccccgcacgcgcactaagcgcgccgattagcatgcgtgggtgtaccggtggtggcacatgtcgctgcgacgtctctgcttcgtgctgccgatggacgtcgacgaggccgccgtcctggcgccggcggcggaggaggaggcgcgctgcagggtggcggcccgccagacggttcggtcgtgcgtccgcggcgcggtcggccgcgtgctgtcgtgcctccgctgccggtcctgcgccggtgcccgcgactcgccggggatggcggcgttcgaggacatcgccggcgtggatgccggcggagggaggaagcagctcgcggggtccggcggcggcccgaggatcttcagctactcggagctctacatcgggaccaacgggttcagcgacaaggaggtcctcgggagcggagggttcgggcgggtgtaccgcgccgtgctcccaagcgacggcacgacggcggccgtcaagtgcatcgccagccgcggcgagcggttcgagaaatccttcctggcggagcttgcggcggtggcgaggctgcggcaccgcaacctcgtacggctccgcgggtggtgcgtgcacggcggcgaggaggcggcggagctgctgctgctggtgtacgactaca

SEQ ID NO: 39720 - protein, 188 aa, Panicum virgatum
  misc_feature: Ceres CLONE 1999287
  misc_feature: SWISSPROT Homolog: EC 2.7.11.1 Non-specific serine/threonine protein kinase
MSLRRLCFVLPMDVDEAAVLAPAAEEEARCRVAARQTVRSCVRGAVGRVLSCLRCRSCAGARDSPGMAAFEDIAGVDAGGGRKQLAGSGGGPRIFSYSELYIGTNGFSDKEVLGSGGFGRVYRAVLPSDGTTAAVKCIASRGERFEKSFLAELAAVARLRHRNLVRLRGWCVHGGEEAAELLLLVYDY

SEQ ID NO: 39721 - DNA, 699 bp, Panicum virgatum
  misc_feature: Ceres CLONE 1999288
  misc_feature: Encodes the peptide sequence at SEQ ID NO. 39722
actcgcaccactcaagctgagctcggttcggttgtagcctgtagcttagctaggtccccgcgcgcgccatggcgaagaaccaccaccgcattgtggcgctcctgctcttcgcggccacgctggtcgtcgcgcagctcgcgccggccgcggcctgcccgtcctgcccgacgccgaagccgccgccgcccccgcccccgacgcccgtgccgtgcccgccgccaccgtcgtccgcgccgccgtccacgccgaagggcaagtgccccctgaacacgctcaagctgctggcgtgcgtggacgcgctcaacgggctggtgcacgccgtggtcggcgccaaggccagcgagaagtgctgcccgctgctgcaaggcgtggccgacctcgacgccgcgctctgcctctgcaccaccatcaaggccaaggcgctcagcatcaacctcgtgctccccatcgccatcgaagtgctcgtcaacgagtgccacaagaacgtgcccgccagcttccagtgcccgtaatcaaactcaactcatcactatttcgtatgtaccattaattatatatccgcatgcatgcatccatgcatgctgggttaaggttatatggtatttgattgatgataaaccagtcaagcatttacatgcatatataatttgtttttataattgtgtatcaatattgtaacatgaaccagtgtgagagttg

SEQ ID NO: 39722 - protein, 147 aa, Panicum virgatum
  misc_feature: Ceres CLONE 1999288
  misc_feature (64)..(146): Pfam Name: Tryp_alpha_amyl Pfam Description: Protease inhibitor/seed storage/LTP family
  misc_feature: Useful for making plants with modulated salt sensitivity
MAKNHHRIVALLLFAATLVVAQLAPAAACPSCPTPKPPPPPPPTPVPCPPPPSSAPPSTPKGKCPLNTLKLLACVDALNGLVHAVVGAKASEKCCPLLQGVADLDAALCLCTTIKAKALSINLVLPIAIEVLVNECHKNVPASFQCP

SEQ ID NO: 39723 - DNA, 1212 bp, Panicum virgatum
  misc_feature: Ceres CLONE 1999294
  misc_feature: Encodes the peptide sequence at SEQ ID NO. 39724
acaatgcaacaaagcaagccttcaactgtgggttaagtgcttctgctgctatcagctcagcatcactgtttaggcgtatactcctgaaacaccagcaatgccccgagtcgtatctgatggaggagaaagcatagacaccgacgtcgccagccggacgtcatcgcaccgtcgcgtggacagcgtccagcatgggcacggctacgaggtcggcgtcccgccgaagaagagcctttttgccgagttctccgacgcggtgaaggagacgttcttcgccgacgatccgctgcggcagtacaaggacctgcccagatccaagaagatatggctcggcttgcagcaagtcttccccgtgctcggctggggcaggaattactccctcggcaagttcaagggcgacctcatcgccgggctcaccattgccagcctctgcataccacaggacatcggttattcgaagcttgctaacctgccaccacaagtcgggctatacagcagttttgtcccgcctctgatatatgcggcgatgggcagctccagggatatagccatcggcccagtggctgtggtgtcgctgttgctcggtactctcctccagaatgagattgacccgaacacgcacccactggagtacagacggctggcgttcaccgcgacgttcttcgcagggattactcaggctgcgcttggattcttcaggctagggtttatcatagagttcttgtctcatgctgccatcatcggattcatggccggtgctgccatcaccattgctcttcagcaactgaaaggattccttggaattgcacatttcaccaagaaaagcgatattgtatcggtcatggaatcattctggggaaatgttcaccatgggtggaattggcagacaatactgatcggtgcatccttcctggcattccttctggttgccaagtacattgggaagaagaataacaaactcttctgggtctccgcgatcgcaccactcttttcagtgatcatatccaccttttctgtgtacatcactcgtgcagacaagcatggcgtttcaattgtcaagaacataaagaaaggcatcaacccaccttcagctattctcatatacttcagtggcccatacctggggactggattcagaattggggcagtatctggaatggtacgcctaacggaagcaattgcaattggaataacttttgctgcactgaaggacta

SEQ ID NO: 39724 - protein, 371 aa, Panicum virgatum
  misc_feature: Ceres CLONE 1999294
  misc_feature (196)..(371): Pfam Name: Sulfate_transp Pfam Description: Sulfate transporter family
MPRVVSDGGESIDTDVASRTSSHRRVDSVQHGHGYEVGVPPKKSLFAEFSDAVKETFFADDPLRQYKDLPRSKKIWLGLQQVFPVLGWGRNYSLGKFKGDLIAGLTIASLCIPQDIGYSKLANLPPQVGLYSSFVPPLIYAAMGSSRDIAIGPVAVVSLLLGTLLQNEIDPNTHPLEYRRLAFTATFFAGITQAALGFFRLGFIIEFLSHAAIIGFMAGAAITIALQQLKGFLGIAHFTKKSDIVSVMESFWGNVHHGWNWQTILIGASFLAFLLVAKYIGKKNNKLFWVSAIAPLFSVIISTFSVYITRADKHGVSIVKNIKKGINPPSAILIYFSGPYLGTGFRIGAVSGMVRLTEAIAIGITFAALKD

SEQ ID NO: 39725 - DNA, 655 bp, Panicum virgatum
  misc_feature: Ceres CLONE 1999305
  misc_feature: Encodes the peptide sequence at SEQ ID NO. 39726
ggctttacattgcaaagcattctccatctcaaagcaatcaaaccaaaccaaacgagagaagctaataagcttgccaagcagcagcgagaagcaaggagaggaggtagtagctactttggtgagccgcgtgagccgtggtggtggcgtcaactagcaaatggcgacgacggacctggggtatgaggagacggagctccggctcggcctgcccggcggcggcggcgcggagagcgacgtgatcaggagctcctcctccgccgggaagaggggcttcgcggagatcatcgacctcaagctgaagctgcagccggcggccgcggccgtcgaggccaaggaagaggcggctaataacaacaaggaggacgtgaccgcggcagtagccgcagagtcgtcggcgcccgggaaaatgaagaggtcgccgagccagagcagcgtcgtcaccgccgccgaccccgacgagaagccgcgcgcccccaaagctcaggttgttggatggccgccggtgcgttcgttccggaagaacatcatgtccgtgcagcaggccgagaaaagcggcagcaaggatgtcgacggcggagacaagtcgtcgtcggtgaccgccgccgcgttcgtgaaggtgagcttggacggcgcgccgtacctgcgcaaggtggac

SEQ ID NO: 39726 - protein, 165 aa, Panicum virgatum
  misc_feature: Ceres CLONE 1999305
  misc_feature (6)..(165): Pfam Name: AUX_IAA Pfam Description: AUX/IAA family
  misc_feature: The sequence is a functional homolog of SEQ ID NO 737 in the 10/374,780 US patent application
MATTDLGYEETELRLGLPGGGGAESDVIRSSSSAGKRGFAEIIDLKLKLQPAAAAVEAKEEAANNNKEDVTAAVAAESSAPGKMKRSPSQSSVVTAADPDEKPRAPKAQVVGWPPVRSFRKNIMSVQQAEKSGSKDVDGGDKSSSVTAAAFVKVSLDGAPYLRKV

SEQ ID NO: 39727 - DNA, 666 bp, Panicum virgatum
  misc_feature: Ceres CLONE 1999314-R
  misc_feature: Encodes the peptide sequence at SEQ ID NO. 39728
tttcttgcattgatccctcatacttaccatgctaatgtttcttttaatttcctgtgtgtgttcttcttctgtatggatcagaaaatggtgatccagacgaagagtgtggagtacatgcccctgttcctgtcccttgcttctctggtgaacggcatctgctggactgcctacgccctcatcaaattcgacctctacatcaccatccccaacgggctgggcgttctgttcgcggtggcgcaggtggtcctgtacgccatctactacaagtccacccaggagatcatcgaggcgcgcaagcgcaaggcaaaccaggtcgccatgaccgaggtcgtcgtcgacgacggcaagaccaacaacagccacgccagcgccggcctctactgatgaagtcatcgatggtaccgagattaaagaagcggcaatataatcaagtatcaagtcgccgctgggtgtcgtccgtattgtgtgattgtgttctttcaacaagggatggaggccacatgttgtttcttaactgctcagcgctggacggagtcaccgggcctcttattattattaggtgggagtggggcgactaaggtgggggattttagctaatcccacctttccaatagggttttgcttaatctcactgttttgcggcacttattaatggtctcttgtctc

SEQ ID NO: 39728 - protein, 127 aa, Panicum virgatum
  misc_feature: Ceres CLONE 1999314-R
  misc_feature (13)..(92): Pfam Name: MtN3_slv Pfam Description: MtN3/saliva family
FLALIPHTYHANVSFNFLCVFFFCMDQKMVIQTKSVEYMPLFLSLASLVNGICWTAYALIKFDLYITIPNGLGVLFAVAQVVLYAIYYKSTQEIIEARKRKANQVAMTEVVVDDGKTNNSHASAGLY

SEQ ID NO: 39729 - DNA, 1418 bp, Panicum virgatum
  misc_feature: Ceres CLONE 1999314
actcattcactcaccaagaagttgagcacccagagcttcagctcagctctcattcgtttcttccggcttcccatctgggcttaccactagtgatcgctagctagcgaacagctctctgaagttgtcgagctgagcactagctagcatctccctgaacgaagccagcgaccatgatctccccggacaccatccgcacggccattggcgtcatcggtgagtcaccaccaccgcctgcacatgaacgcatatactccgtctgcacagagagcagctgcaaaccctgcaacatgcagcagaagtgctgcatgcggagcctgcctgtgggagatggcactagctggtcatgtggggtgtggggctcttttcatgctactttcttgcttccttccttccttcctgcctccatcctttatttttcatccatctcttttctcttcgtttgtgttttagaaaagctttacacatgtcctcgtcgcatcactagcttttgatccctgccaatgcaaggctcttgttcgttctccgggtttcctggagagctctgaacattttgtttctcatgcttgttcataatttgctacaatccagttggtgatcttctgtatattcacctttggtttctcctttctttctatctcgcaggcaatgggactgctcttgtgctcttcctctccccagtgtaagaatcaattcattcatttcttgatacttgataaaaaaagattttaaaaatagaaaaatgataatatccttaattgtggatataatatttttaggaacagatgacaatattacaaatactcgtataatacgtatacgtacgcactgatacagtatagctacgtgacacgtacaggccgacgttcatccgcatctggaagaaggggtcggtggagcagtactcgccggtgccgtacgtggcgacgctcctcaactgcatgatgtgggtgctgtacgggctgccgctggtgcacccccacagcatgctcgtcatcaccatcaacggcaccggcatggccatcgagctcacctacgtcacgctcttcctcctctactccacgggggccgctcgccgcaaggtcgtcctactcctcgccaccgaggtcgccttcgtcggcgccgtcgccgttcttgtgctcagcctggcgcacacgcacgagcgcaggtccatgatcgtcggcatcctctgcgtcctcttcggcaccggcatgtacgcggcgccgctctccatcatggtatgtgccactggtactactagtatcattgtaggtggctgcaggagattttttttttcttataccacgttgagtgattgctactgcagttggaatgggaagaataagcataggaaaagaagggcccactattttcagctttttttcgagccactttattgggggaataaaatacatgtgcac

SEQ ID NO: 39730 - DNA, 733 bp, Panicum virgatum
  misc_feature: Ceres CLONE 1999318
  misc_feature: Encodes the peptide sequence at SEQ ID NO. 39731
ttgtcgaacatggtttatgctgatgacgatgagtcacttgctgatgctgaggaagacgaatcctttccggacagggaccaggatttgaagccccgcttccatgcctctcgattgcatggatcggaaactggagaagatgatgacgatgctgctgctgtaaatgtctggaacttaaggaagtgtagtgctgctggattggatgtcctgtctaacgtgtttggcgacaacatccttccaactttaatgcctttgattgagcaaaatttagctcgaacagatgatgattcttggaaagaaagagaaaccgctgttttatctcttggtgctatagcagaaggatgcattgctggtttatatccccaccttcctcagattgttgccttcctcataccacttcttgacgataaatttcctcttatacggagtattacatgttggactctctctcggtacagcaaattcattgttcagagccttgatcatccaaatggacgcgaacaattcgataagattctcatgggattgctcagaaggatattggatactaacaaaagagtccaagaggctgcttgttcagcatttgcaactcttgaagaggaagctgcagaagaattagtgccacacttggaagtgattttgcagcacctcatgtgtgcctatggaaaataccagaaacgaaatctccggatactctatgatgctcttggtactcttgctgatgcagttggtgcag

SEQ ID NO: 39731 - protein, 244 aa, Panicum virgatum
  misc_feature: Ceres CLONE 1999318
  misc_feature (119)..(155): Pfam Name: HEAT Pfam Description: HEAT repeat
LSNMVYADDDESLADAEEDESFPDRDQDLKPRFHASRLHGSETGEDDDDAAAVNVWNLRKCSAAGLDVLSNVFGDNILPTLMPLIEQNLARTDDDSWKERETAVLSLGAIAEGCIAGLYPHLPQIVAFLIPLLDDKFPLIRSITCWTLSRYSKFIVQSLDHPNGREQFDKILMGLLRRILDTNKRVQEAACSAFATLEEEAAEELVPHLEVILQHLMCAYGKYQKRNLRILYDALGTLADAVGA

SEQ ID NO: 39732 - DNA, 1223 bp, Panicum virgatum
  misc_feature: Ceres CLONE 1999338
  misc_feature: Encodes the peptide sequence at SEQ ID NO. 39733
gctctccctcctcttccactccacgcatctcccctccgctccatgatgctgcatccgtggtgcctcctcctcctcctctgcctgccgctcgccgccgccgccgcctcctccgacgccgcgctcctcctcgccaaggtcaggcccgcgctccaggggcagggccccaaccccaacgcccagctcgccacctggaacgcctccaccccgctctgcctctggcgcggcctccgctgggcctggcccgacgcccgcccgctccgctgcgacactgccgccgcgcgcgccaatctctccctcgcccgcgaccccgccctcctcctcctctccatccgcctccccgccgccgccctcgccggcaccctcccgcccgacctcggagccttctccgccctcgcctccatctacctcgccgccaaccaactcaccggccccgtcccgctcgacctcggcaacgcgcccgcgctcgacgcgctcgacctctcgtccaaccgcctctccggcccactccccacctccctctggaatctctgcgaccgcctcgccgacctccgcctccacgggaacgctctcgcgggggccgtcccgccgcccgccggccccaacaccacctgcgacagcctccgcgtcctcgacctcggcgccaaccgcttctccggcgggttcccctccttcctcaccgctttccgcggcctccgccgcctcgacctcgccgacaaccgtttccaggggcccatcccggaggccctcgccgggatggaccgcctccaggacctcaacctctccagcaacaacttctccggccagctgccaccgaccttggcccgcttcacggaggccgccttcctgggcaaccacccttcgctgtgcggcccgccgctgcgcacccagtgcgtgtcctcctccggtctcagctcccgcggcgtcgccgccatggtcatcggcctcatggccgctgccgtcgtcctcgcctccgtctccatcggttgggcccaggggaggtggacctcgaggcggcggcgagataatgatgccaacgcgcaaggaggggatgatgaccatgacgccgccgccgacgacgatggcaggctgctcgtcttcgagggcggcgagcacctcacgctggacgaggtgctcaacgccaccggccaggtggtcgacaaggccgcccactgcaccgtgtacaaggccaagctcgccgccggcggcggcaccattgagctgcg

SEQ ID NO: 39733 - protein, 393 aa, Panicum virgatum
  misc_feature: Ceres CLONE 1999338
  misc_feature: SWISSPROT Homolog: EC 2.7.11.1 Non-specific serine/threonine protein kinase
MMLHPWCLLLLLCLPLAAAAASSDAALLLAKVRPALQGQGPNPNAQLATWNASTPLCLWRGLRWAWPDARPLRCDTAAARANLSLARDPALLLLSIRLPAAALAGTLPPDLGAFSALASIYLAANQLTGPVPLDLGNAPALDALDLSSNRLSGPLPTSLWNLCDRLADLRLHGNALAGAVPPPAGPNTTCDSLRVLDLGANRFSGGFPSFLTAFRGLRRLDLADNRFQGPIPEALAGMDRLQDLNLSSNNFSGQLPPTLARFTEAAFLGNHPSLCGPPLRTQCVSSSGLSSRGVAAMVIGLMAAAVVLASVSIGWAQGRWTSRRRRDNDANAQGGDDDHDAAADDDGRLLVFEGGEHLTLDEVLNATGQVVDKAAHCTVYKAKLAAGGGTIEL

SEQ ID NO: 39734 - DNA, 657 bp, Panicum virgatum
  misc_feature: Ceres CLONE 1999342
  misc_feature: Encodes the peptide sequence at SEQ ID NO. 39735
atcgccacccgcattcccctccctctccacgcacctctcgggctcggctcctaagagggaggaggacgccagctgccagggcacccgctcccgcgctacccgccgccaccatgctgtccgcgcatgccgccgccgccatcacctcgccggcttccctgtggaagctggcaggagggagcgagggcgggagcctcatctgctacagatgcaggacctacagggagtccctgccgaggcgggccgcggcggtgcgggtgcgcgccgcggctccggggcgggtggaggccgtcccgatgggctccgccgcggagaccgataatgagctgcatgatgagcagcagcgagagaatgatgtggcggctgccggccgtggggtcaaggacccctacggcgaggacagggccaccgaggagctgcccctcacgccctgtgcctactccgtcacgagcggttacacccttttgagggatccacatcacacctagggtctttccttcactgagaaggagcgggatgcacactacttgcgtggccttctgcctccggcggttgtgtctcaggaactccagattatgattatcctgcacaacctgctgcagtacaagctccctttgcagagctatatcgacatgatggaccttcatgacagaactgaat

SEQ ID NO: 39735 - protein, 124 aa, Panicum virgatum
  misc_feature: Ceres CLONE 1999342
  misc_feature: SWISSPROT Homolog: EC 1.1.1.40 Malate dehydrogenase (oxaloacetate-decarboxylating) (NADP(+))
MLSAHAAAAITSPASLWKLAGGSEGGSLICYRCRTYRESLPRRAAAVRVRAAAPGRVEAVPMGSAAETDNELHDEQQRENDVAAAGRGVKDPYGEDRATEELPLTPCAYSVTSGYTLLRDPHHT

SEQ ID NO: 39736 - DNA, 706 bp, Panicum virgatum
  misc_feature: Ceres CLONE 1999365
  misc_feature: Encodes the peptide sequence at SEQ ID NO. 39737
  misc_feature (641)..(641): n is a, c, t, g, unknown, or other
aaacaaggggacaggaaaggtctcgcctttgctcgacggcggcggcgatgtctcttcctccggctccggcggaaggcggcggcggtggaggttccgccgccgacgactggttcctcgactgcggcatcctcgacgacctcccggccgcggcctgcggggccttcccgtgggacgcgtccccgtcgtcctccaaccccagtgtggaagttggcagctacgtaaacactggtgatgtcttcaaggagcctggcagtaataaacgtttaaggtcaggatcttctggtaggccaacatctaaagcttgtagggaaaaaatgagaagggacaagctcaatgacaggtttcttgaattgggctctaccttggaaccagagaaaccagtaaaagctgacaaagctgctatcctaagtgatgctactcgcatggttattcagcttcgctctgaagcacagcagctcaaggacaccaatggtagtcttgaagaaaagattaaggagctaaaggcagagaaggatgagcttcgtgatgagaagcagaagctgaaactagagaaggagagtttagaacaccagatgaagcttatgacctcaactccagcctacatgcctcatccaaccctgatgccagcgcccttcccacangctccgctagcaccattccatccccaggcgcaagctgcagggcagaagctgatgatgccctttgt

SEQ ID NO: 39737 - protein, 219 aa, Panicum virgatum
  misc_feature: Ceres CLONE 1999365
  misc_feature (80)..(131): Pfam Name: HLH Pfam Description: Helix-loop-helix DNA-binding domain
  misc_feature: The sequence is a functional homolog of SEQ ID NO 1203 in the 11/479,226 US patent application
  misc_feature: The sequence is a functional homolog of SEQ ID NO 2422 in the 10/374,780 US patent application
  misc_feature: The sequence is a functional homolog of SEQ ID NO 542 in the 10/412,699 US patent application
  misc_feature: The sequence is a functional homolog of SEQ ID NO 814 in the 10/225,066 US patent application
  misc_feature (198)..(198): Xaa is any aa, unknown, or other
MSLPPAPAEGGGGGGSAADDWFLDCGILDDLPAAACGAFPWDASPSSSNPSVEVGSYVNTGDVFKEPGSNKRLRSGSSGRPTSKACREKMRRDKLNDRFLELGSTLEPEKPVKADKAAILSDATRMVIQLRSEAQQLKDTNGSLEEKIKELKAEKDELRDEKQKLKLEKESLEHQMKLMTSTPAYMPHPTLMPAPFPXAPLAPFHPQAQAAGQKLMMPF

SEQ ID NO: 39738 - DNA, 1180 bp, Panicum virgatum
  misc_feature: Ceres CLONE 1999366
  misc_feature: Encodes the peptide sequence at SEQ ID NO. 39739
accaaacggctggacccgccgccgccgcgcgcgaagaaaccaatggcggacgccgcggagctcgtgcgcctcctccgcctccgggccgcgcagcggccgtcgcctccgcagcgccccggaccgtccccgcgggcgcagggccttctcagagctctcccccgccgccgccgccctccgttctcgctccgttgccgcgcgctcgacgccagcgggccggcggcggtggagggggagcgtggcgaggaggacgtgttcgaggacgaggaggagtcctacttctcggtcacctcgtcggggctctcgcaggtggattaccttgggcagagcaccaggggggatttgaacgtgcggagggagcgcctcgaggcgcttggtgggaatggcgagtcaacactgcatggtcctattgaagagattgcatggaaagaagcggaagaagctgaaacattacttcatgacttgggaattgcagacccattttcagtaagacactctcctcgtggaattttctgcaccaggacactaaatcttcgatccatcagtgtgattggctatgatatggattacacattaattcattacaacgtgatggcctgggaagggcgtgcatatgattatgggatggacaaccttaagagcatgggtttcccagttgacgaccttaaatttgatcctgatctggtcataagaggtctcattattgacaaagaaaaaggaaacttggtcaaacctgaccgttttggctacattaagagggccatgcatggtacccagatgctttccactccttctgtgagtgaaatatatggaagggaattggtggacctgcgaaaagaaagtcgatgggagtttcttaatacccttttctcggtttcagaagctgtcatgttcatgcagatggtcgacaagttagatcaggggttggtgccagctgaacttggaccactggattataaagggctgtacaatgctgtttccaaagcactttttcgagcacatgtagaaggccaacttaagagagaaataatggctgagcctgagcggtttgtagagcctgatccagaacttcctttagctcttcttgaccaaaaagaggctgggaaaaagttgcttcttattactaattcagattaccattatacaaacaaaatgatgaatcatgcattcaatcgctttcttc

SEQ ID NO: 39739 - protein, 379 aa, Panicum virgatum
  misc_feature: Ceres CLONE 1999366
  misc_feature (228)..(379): Pfam Name: 5_nucleotid Pfam Description: 5' nucleotidase family
  misc_feature: SWISSPROT Homolog: EC 3.1.3.5 5'-nucleotidase
MADAAELVRLLRLRAAQRPSPPQRPGPSPRAQGLLRALPRRRRPPFSLRCRALDASGPAAVEGERGEEDVFEDEEESYFSVTSSGLSQVDYLGQSTRGDLNVRRERLEALGGNGESTLHGPIEEIAWKEAEEAETLLHDLGIADPFSVRHSPRGIFCTRTLNLRSISVIGYDMDYTLIHYNVMAWEGRAYDYGMDNLKSMGFPVDDLKFDPDLVIRGLIIDKEKGNLVKPDRFGYIKRAMHGTQMLSTPSVSEIYGRELVDLRKESRWEFLNTLFSVSEAVMFMQMVDKLDQGLVPAELGPLDYKGLYNAVSKALFRAHVEGQLKREIMAEPERFVEPDPELPLALLDQKEAGKKLLLITNSDYHYTNKMMNHAFNRFL

SEQ ID NO: 39740 - DNA, 1349 bp, Panicum virgatum
  misc_feature: Ceres CLONE 1999374
  misc_feature: Encodes the peptide sequence at SEQ ID NO. 39741
aatcaagctgatactcgtgtccggcgactcgatgggtggatgctgccagtgctaaccctctcacgcgcgtgccgccgccttcgcctccccaccctccaccctgaggctagggttttgcccgccgccgccgcaatccactactacttccccttctcctcctcatccaccaccgccaatccgatggcctcctcgtcgccggattggccggcctggcggacccgtaagacgttcatcgacttcttcgtgtccaagtcgcacacgcggtggccttcgagccccacggtccctgtcgacgaccccacgttgctgttcgccaacgccggaatgaaccagttcaagccggtcttcctcggaacggcggccccggactcgccgctcggccggctgcgccgtgcctgcaatacccagaagtgcatccgcgctggcgggaagcacaacgacctcgatgacgtggggaaggacacctaccaccatacctttttcgagatgctcgggaactggtccttcggggactacttcaaggaggaggccatcggctgggcctgggaactcctcaccgaggtgtacaaactgcctactgacagaatttatgccacatactttggtggtgatgaggaatctggtcttgctgctgataatgagtcgaaaaacatatggttgaaatatctaccagaggaaaaggttctgccttttgggtgcaaggacaacttttgggagatgggtgacactggtccttgtggaccctgtactgaaattcattttgatcgtattggaaaccgtgatgctgcttcattagtgaacaatgatgaccctacatgtattgaaatatggaaccttgtgttcattcagttcaatagggaggcagatggtagtttaagaactttgccagcaaaacatgtggacactgggatgggctttgagcgattaacttctattcttcagaataaaatgagcaactatgacacagatatattcatgccattattcgatgctatccacaagttagctggtgatgggattcaaccatactctggtaaagtaggttctgatgatgttgacaaagttgatatggcttatagagtagtcgcagatcatataagaactctttctttcgctattgctgatggttctcaacctggaaatgagggaagagaatatgttctgaggcgtatactcagacgggctgttcactttggtcatcagaaattgaaaacaaagccaaagttttttagcttccttgttaatttttttgtccaaatgatgggtgatgtgtttcctgagctaaaagacaacgaaaaaaagattcaggatatgattagagatgaagaacaaagctttgagaacactct

SEQ ID NO: 39741 - protein, 389 aa, Panicum virgatum
  misc_feature: Ceres CLONE 1999374
  misc_feature (12)..(389): Pfam Name: tRNA-synt_2c Pfam Description: tRNA synthetases class II (A)
  misc_feature: SWISSPROT Homolog: EC 6.1.1.7 Alanine--tRNA ligase
MASSSPDWPAWRTRKTFIDFFVSKSHTRWPSSPTVPVDDPTLLFANAGMNQFKPVFLGTAAPDSPLGRLRRACNTQKCIRAGGKHNDLDDVGKDTYHHTFFEMLGNWSFGDYFKEEAIGWAWELLTEVYKLPTDRIYATYFGGDEESGLAADNESKNIWLKYLPEEKVLPFGCKDNFWEMGDTGPCGPCTEIHFDRIGNRDAASLVNNDDPTCIEIWNLVFIQFNREADGSLRTLPAKHVDTGMGFERLTSILQNKMSNYDTDIFMPLFDAIHKLAGDGIQPYSGKVGSDDVDKVDMAYRVVADHIRTLSFAIADGSQPGNEGREYVLRRILRRAVHFGHQKLKTKPKFFSFLVNFFVQMMGDVFPELKDNEKKIQDMIRDEEQSFENT

SEQ ID NO: 39742 - DNA, 667 bp, Panicum virgatum
  misc_feature: Ceres CLONE 1999390
  misc_feature: Encodes the peptide sequence at SEQ ID NO. 39743
gccgtcgccggctcgcccccacctccccccctcctactcggcttcgacctcccgtctctcatctctcccatcgagagcggcggctcggctcccccggcccgcacccctcgccggcgccgctgcccccacccgagtcccacccagtctccggatcggctcgcccccgaatcaatctcgtcaggccggcatggagaattcgaccctcaccgacatgacgctcctgcccggcgtcaagacggtcgtgtcggggctggccgccggctcctcctccctgggccaggatggcaaggccaagaagaagcccatgaagtccctctacctcaagttcttcgacacggcgcccgacggcaagtcccgcatctgcaggctctgcaggaagagctactgcatgaccactgccacggggaatttgggaaagcatcttaataaccgccaccctggttatcaccaacttcctgaaggccccagcttcactgctcagagtaccgtacagactaccatggtaactagaagcaagaaacctcacgttccagtgcgagctcgggcccaagcacagcctcaagttcaaagtcaatctcaaattcaagatcaacctcaagctaaagttcattctcaacctaagacgaaacaaactgttgatattgaccatgtcaactggttacttctt

SEQ ID NO: 39743 - protein, 159 aa, Panicum virgatum
  misc_feature: Ceres CLONE 1999390
  misc_feature (42)..(84): Pfam Name: zf-BED Pfam Description: BED zinc finger
MENSTLTDMTLLPGVKTVVSGLAAGSSSLGQDGKAKKKPMKSLYLKFFDTAPDGKSRICRLCRKSYCMTTATGNLGKHLNNRHPGYHQLPEGPSFTAQSTVQTTMVTRSKKPHVPVRARAQAQPQVQSQSQIQDQPQAKVHSQPKTKQTVDIDHVNWLL

SEQ ID NO: 39744 - DNA, 1201 bp, Panicum virgatum
  misc_feature: Ceres CLONE 1999393
  misc_feature: Encodes the peptide sequence at SEQ ID NO. 39745
acaaccacctgtccccgcgcatctcccacctcctcgccgcacgcacgcacgcacgcccgcccccacaccctcccgcgccgccgccgccgccaaaaccccaacccgactacccgaggccccgagccagcccaccaccacctcctcggcttcttcggcgatccgggcggtgaggcgtccagcggcgcgcgcggcgggggtgagagagtgatggcgtcggaggacgtggtgggcaagaccagcggcgacaccgcagtcaccaccatcgtcaacctggcggaggaggctaagcgcgcgcgccaggacgtcaagggacccggccaccaggtcctcaccatctgcaagtcgctcgtcgcggggggcgtcgcggggggagtgtcacggactgctgttgctccgctggagcgattgaaaatcttgctccaggtccaaaatcctcacagcatcaagtacaatggtacagttcaaggtctgcagtatatctggcgaaccgagggtctccgtggtctattcaagggcaatggtaccaattgtgcaaggattgttccaaattctgctgtgaagtttttcagctacgagcaggcatcgaagggaattttgtggttttatcgccgacaaactggggatggtacgcattctgccattgaattagttttctgtgtgcccatttagttcctgtttgcatttgttacaaatgtttataagatcaatgaatttaggatctgtgagtatccctaacacaggaatcgggagttctagaatcttgcatgcattgtacaaagttcctaatttgtggcctttctgtacattcacctttcagtcttgtcatgtcgaacttgtttccttgcctacttttgcctgaaagtgttttgctctttctcgacccacatgtcaatatgtagctttaagtctgagattataacttatttcccagtaatattaatagtgaaaaacatgtagaatattagcagcatctgggtgtcccatgttatagcttgtagcgccacacgtattttgctagttagatcattcacgataccgaaaccatgattatgaatgttcagttcggctataccatttgcaacaccctagaaacacattatttccttgtactggcatttgaagattgtacatcgtttaaaagtttctgctcaaagctgattaatctctagatgatttcaccgtcagcaaattgccttgtgct

SEQ ID NO: 39745 - protein, 153 aa, Panicum virgatum
  misc_feature: Ceres CLONE 1999393
  misc_feature (42)..(133): Pfam Name: Mito_carr Pfam Description: Mitochondrial carrier protein
MASEDVVGKTSGDTAVTTIVNLAEEAKRARQDVKGPGHQVLTICKSLVAGGVAGGVSRTAVAPLERLKILLQVQNPHSIKYNGTVQGLQYIWRTEGLRGLFKGNGTNCARIVPNSAVKFFSYEQASKGILWFYRRQTGDGTHSAIELVFCVPI

SEQ ID NO: 39746 - DNA, 685 bp, Panicum virgatum
  misc_feature: Ceres CLONE 1999406
  misc_feature: Encodes the peptide sequence at SEQ ID NO. 39747
cctccctccctctccttctacctctttctcttttgcttccgtgtgtgttccaagagggagagagaaagagaggggcgcatgctccggttgctagcttcagttcgatccgtgtagctctggtagctccttctcgattgatcacccgactttcgggattcattatcatccgatcgatcggtcgtcggtggtgcagaagaagccggagagtcaggtaggctactgtccaagctaaggagagactacactagcagtcacgctgccgcacagctgcgtgacttggactggccagtcgcagtgtgaccggccggtagctcgccgctttgctagcagcagtggactggtggtggtggtgttgccgtgaccaatccaccaatcaactcgtcagctagctagctgagatcgatcgatacacatggcggccgcccacctgttcggactcggcgacgcgcagatgcagccgccgctgccgcagcaggcggcgcctcctcctccggcagccgcgccggcgctcaagaagaagaggaaccagcccggtaacccaaatccggacgctgaggtgatcgcgctgtcccccaagtcgctgctggcgacgaaccggttcgtgtgcgaggtgtgcaacaaggggttccagcgggagcagaacctgcagctgcaccggcgcgggcacaacctgccgtggaagctc

SEQ ID NO: 39747 - protein, 90 aa, Panicum virgatum
  misc_feature: Ceres CLONE 1999406
  misc_feature (63)..(85): Pfam Name: zf-C2H2 Pfam Description: Zinc finger, C2H2 type
  misc_feature: Useful for making plants with altered lignin content
  misc_feature: The sequence is a functional homolog of SEQ ID NO 1719 in the 11/479,226 US patent application
  misc_feature: The sequence is a functional homolog of SEQ ID NO 312 in the 10/666,642 US patent application
  misc_feature: The sequence is a functional homolog of SEQ ID NO 650 in the 10/666,642 US patent application
  misc_feature: The sequence is a functional homolog of SEQ ID NO 1086 in the 10/666,642 US patent application
  misc_feature: The sequence is a functional homolog of SEQ ID NO 960 in the 11/435,388 US patent application
MAAAHLFGLGDAQMQPPLPQQAAPPPPAAAPALKKKRNQPGNPNPDAEVIALSPKSLLATNRFVCEVCNKGFQREQNLQLHRRGHNLPWK

SEQ ID NO: 39748 - DNA, 741 bp, Panicum virgatum
  misc_feature: Ceres CLONE 1999407
  misc_feature: Encodes the peptide sequence at SEQ ID NO. 39749
cgcttttggagacaatgatgaagaactgtggtgaatatgtccggtttgaagttgctgaacagcatgttctgcaagaaatggtcaaaattattcagaagaagaatgatatgcaagtaagggataaaatattattacttttagactcctggcaagaggcatttggtggacctggaagtaaatacccacaatatcattgggcatatcttgaagtaaagacgacaggtgtggtgttcccaaaacgtcctgtcgatgccccaccaatatttacacctcctgctacacataattctagttcgcccagatatgctgcaggaagtcttagtgacagaatgtcctcagatgttgagaccctgagtttaggggacttgaacaatattcgaaatgtgacagacctactgaacgatatggtgcatgctttaaacccatctgatcgtacggctgttaacgacgaaattatcacagatcttgtgacccagtgtcgctcaaatcaacaaaagcttttgcaatttgtcagttcaacagggaatgagcagttgctaaagcaaggactggagataaatgatttcttacaaagtgtactttcaaagtatgatgctgtggtttctggtgctcctttgggggttgaagcaccagtgacagagacaattgaggctcctagtgaggctcctgcagtaaaaccatctgcaccccctgaaataatgacactgctgatgaagaggaagatgagtttgcccagctagc

SEQ ID NO: 39749 - protein, 245 aa, Panicum virgatum
  misc_feature: Ceres CLONE 1999407
  misc_feature (112)..(209): Pfam Name: GAT Pfam Description: GAT domain
LLETMMKNCGEYVRFEVAEQHVLQEMVKIIQKKNDMQVRDKILLLLDSWQEAFGGPGSKYPQYHWAYLEVKTTGVVFPKRPVDAPPIFTPPATHNSSSPRYAAGSLSDRMSSDVETLSLGDLNNIRNVTDLLNDMVHALNPSDRTAVNDEIITDLVTQCRSNQQKLLQFVSSTGNEQLLKQGLEINDFLQSVLSKYDAVVSGAPLGVEAPVTETIEAPSEAPAVKPSAPPEIMTLLMKRKMSLPS

SEQ ID NO: 39750 - DNA, 1069 bp, Panicum virgatum
  misc_feature: Ceres CLONE 1999414
  misc_feature: Encodes the peptide sequence at SEQ ID NO. 39751
caggcagagagccaagcggaggctgcgtcgcatcgcagcagccctgcccgcgcctcgatcccacgaaccccaccccggggagggagagggagggatcgaggaggaagaatcggaaaggtggttgcaggttggctatctggtttctctgtttgttacttctcgcatcgaggtgttttttcgtggtctcggttctcgggcatccgcgtgatctgaggagggggtgtgggttcttggagggatttgatccatctcgcaaaggattcgactcctttgcggattcggtcctcggtgagaatactcactcgcgaaaaattcgggtattagccctttgtcagttaatttctggggattttctggcggttagaagcgaatccccccgtctcggtttgtcggctgcttctttgatttcttgtggcactgcattgattgcgctgctgctggtgaatcgtcagcagagaatcttcctgcgaggctgcattcatctcgtctcgtatgcttgttattgcaagcccaacatttggtttattgccaaactttaatccgggaattattcttctgcaggacagtgggtacagcagcagttattgtttcatcttatctgctgcagcaggtggaatccaagggtttaccatgcgctgggagagtatgggaaggagctgctatcaagtctgaagcttagttttgcacatcagtgttggaggcatgtataagaaccagctccaggagcttgctcagaggagctgcttcaatctaccgtcctatgcatgcatccgggagggaccagatcatgcgcctcggttcaaggccacagttaatttcaatggagagacgttcgagagcccagtcttttgttctactttgcggcaggcagagcatgcagcggctgaggtagcactcaatgagttatcaaagagggggccttcatcgacacttgccgccaaagttctggatgaaaccgggatatacaagaatctacttcaagaaactgctcatcgagctggtttaaaacttccagtggacactactgttaggtctggaccgggtcacacacctgtgttcacatgcacag

SEQ ID NO: 39751 - protein, 122 aa, Panicum virgatum
  misc_feature: Ceres CLONE 1999414
  misc_feature (2)..(68): Pfam Name: dsrm Pfam Description: Double-stranded RNA binding motif
  misc_feature: SWISSPROT Homolog: EC 3.1.26.3 Ribonuclease III
MYKNQLQELAQRSCFNLPSYACIREGPDHAPRFKATVNFNGETFESPVFCSTLRQAEHAAAEVALNELSKRGPSSTLAAKVLDETGIYKNLLQETAHRAGLKLPVDTTVRSGPGHTPVFTCT

SEQ ID NO: 39752 - DNA, 592 bp, Panicum virgatum
  misc_feature: Ceres CLONE 1999414-R
tcatgtataccagcagcgacctccttggctggctgcccctgttacagtcagaaccgccatcccagtgtgttcagctaggccgaatgccgtgaatacagcttgtggagcagctcgagtaagaccgatggcccagaaccgcttggccctggctagaggtgagccagaaactgccaagaatacgaataatggggaaagagccctgaacagggagcacccaactcaataagctccatgtctgagccacagttttggttctgctgagctataagttaggtctgtgacttggcagaatctcagtttctgttcctcttttttcccttctcagtttctgttcgtgttcccctttgtgttttagttaggtactgaactcttgaaagagttgtgtgggagtcgtgcttgcggtctccacgctgcctttagattctacagataataccacgtccttatgaagaaaaattaacgagagttataatatagatagagaatacagtttttccttgtgtgctgaatgttgattctttttctttttttctttttgccaatgttgacagaatgctgaatttttgcttgggagttcagtttgcatctcggt

SEQ ID NO: 39753 - DNA, 674 bp, Panicum virgatum
  misc_feature: Ceres CLONE 1999416
  misc_feature: Encodes the peptide sequence at SEQ ID NO. 39754
accgacagtatcgtttcctcctcaccggcgcggcgctcgctcgcggaccggcggccgtggacggagctgctagaccgctcggccttcacccgcccggactcgctctccgaggccacctcgcggctgcgccgcaacctcggctacttccgcgtcaactacgccgctgtcgtcgccttcttgctcacggcctagctcctggcgcaccccttcgccctcctcgccctcctcggcgtcctcgccgcttggtgcttcctctacgccttccaaccctccgaccagcccgtcgtgctcttcggccgctccttcaccgaccgcgagacgctgctcggcctcgtcgttgcgtccgtgctagccttcttcctcagcaccgcttcgctcatcatctccgggctgctcgacgggggcgccatcatccccgcgcaccgcgcctgccgcatgccagaggacctcttccttgatgattccagcgctgcgtccagtgggaacaccaccaccaggctgctatccttccttgcgtcgcccggatctagggtttgacgcctccacgaccggtaatatccagtcaaatcaaagtctcaaaatcgggagagctctggccccgtagctgcagcagagagcttgtggttcctatggtacttaactgtgagtagctatggatatgcggatctgatttt

SEQ ID NO: 39754 - protein, 63 aa, Panicum virgatum
  misc_feature: Ceres CLONE 1999416
  misc_feature: The sequence is a functional homolog of SEQ ID NO 2244 in the 10/374,780 US patent application
  misc_feature: The sequence is a functional homolog of SEQ ID NO 82 in the 10/412,699 US patent application
  misc_feature: The sequence is a functional homolog of SEQ ID NO 922 in the 10/225,066 US patent application
TDSIVSSSPARRSLADRRPWTELLDRSAFTRPDSLSEATSRLRRNLGYFRVNYAAVVAFLLTA

SEQ ID NO: 39755 - DNA, 624 bp, Panicum virgatum
  misc_feature: Ceres CLONE 1999419
  misc_feature: Encodes the peptide sequence at SEQ ID NO. 39756
agagcgtgcagagcgagacgcgtcgtccctccccacccaccccacccacccccccgccagcccgtgcgttcccccgcccgcgtagggttagggttcggtcccgccgccatggcgatcctctcggcgctcgcgaccgaggtgctcatccccgtcgccggcgtcatcggcatcgccttcgccgtcatgcagtgggtgctcgtgtcgcaggtgaagctctccccggccgcggccgccgcgggcggcaacaagaacggctacagcgactacctcatcgaggaggaggagggcctcaacgaccacaacgtcgtcttcaagtgcgccaagatccagaacgctatctccgaaggagcaacatcgtttctcttcacagagtaccaatatgttggtattttcatgtctatctttgctgttgtcatctttctcttccttggctctgttgagggattcagtacaaagagccagccctgcacctatagcgagggcaagttctgcaagcctgccctgttcaccgcactcttcaacactgcatccttcttgcttggagccatcacctctttggtctctggattccttggaatgaagatcgccacatatgccaatgccagaaccaccctgtaagctagg

SEQ ID NO: 39756 - protein, 169 aa, Panicum virgatum
  misc_feature: Ceres CLONE 1999419
  misc_feature: SWISSPROT Homolog: EC 3.6.1.1 Inorganic diphosphatase
  misc_feature: Useful for making plants with modulated water use efficiency
MAILSALATEVLIPVAGVIGIAFAVMQWVLVSQVKLSPAAAAAGGNKNGYSDYLIEEEEGLNDHNVVFKCAKIQNAISEGATSFLFTEYQYVGIFMSIFAVVIFLFLGSVEGFSTKSQPCTYSEGKFCKPALFTALFNTASFLLGAITSLVSGFLGMKIATYANARTTL

SEQ ID NO: 39757 - DNA, 720 bp, Panicum virgatum
  misc_feature: Ceres CLONE 1999449
  misc_feature: Encodes the peptide sequence at SEQ ID NO. 39758
acttccttcccactccacctctgctcccataccccttctccttcctttcttcccccttccccttcctcctcgccctcgcccagcatccaagaaagaactcgccactccggctcaccaatcatcgcagatcggtcagtccgaagcgaccagcagtccgcgggtctcgtcttctacccatggcgtcctcctccccgtcatgccgcgccggcggcaagccggacgtggaccggatcaagggcccctggagccccgaggaggacgaggcgctgcagcggctggtggcgcgccacggcgcacgcaactggtccctcatcagccgctccatcccgggccgctccggcaagtcctgccgcctccgctggtgcaaccagctctcgccgcaggtggagcaccgccccttcacgcccgaggaggacgacaccatcctccgcgcgcacgcgcgcttcggcaacaagtgggccaccatcgcgcgcctgctctccggccgcaccgacaacgccatcaagaaccactggaactccacgctcaagcgcaagtactacgccgccgccgccgccgccggggggcatgccgacgcggacgacgagcggccgctcaagcggaccagcagcgacggccacccggggctctgcttcagccccggcagcccgtcggggtccgacctcagcgactccagccaccacagcctgccctccgtcatgccgccggctgctcctgccg

SEQ ID NO: 39758 - protein, 181 aa, Panicum virgatum
  misc_feature: Ceres CLONE 1999449
  misc_feature (20)..(66): Pfam Name: Myb_DNA-binding Pfam Description: Myb-like DNA-binding domain
  misc_feature (72)..(117): Pfam Name: Myb_DNA-binding Pfam Description: Myb-like DNA-binding domain
  misc_feature: The sequence is a functional homolog of SEQ ID NO 128 in the 11/375,241 US patent application
  misc_feature: The sequence is a functional homolog of SEQ ID NO 166 in the 10/412,699 US patent application
  misc_feature: The sequence is a functional homolog of SEQ ID NO 2272 in the 10/374,780 US patent application
  misc_feature: The sequence is a functional homolog of SEQ ID NO 373 in the 11/479,226 US patent application
  misc_feature: The sequence is a functional homolog of SEQ ID NO 914 in the 11/435,388 US patent application
  misc_feature: The sequence is a functional homolog of SEQ ID NO 1054 in the 10/225,066 US patent application
  misc_feature: The sequence is a functional homolog of SEQ ID NO 144 in the 10/412,699 US patent application
  misc_feature: The sequence is a functional homolog of SEQ ID NO 2264 in the 10/374,780 US patent application
  misc_feature: The sequence is a functional homolog of SEQ ID NO 912 in the 11/435,388 US patent application
  misc_feature: The sequence is a functional homolog of SEQ ID NO 150 in the 10/412,699 US patent application
  misc_feature: The sequence is a functional homolog of SEQ ID NO 830 in the 11/435,388 US patent application
  misc_feature: The sequence is a functional homolog of SEQ ID NO 118 in the 10/412,699 US patent application
  misc_feature: The sequence is a functional homolog of SEQ ID NO 188 in the 10/225,068 US patent application
  misc_feature: The sequence is a functional homolog of SEQ ID NO 2256 in the 10/374,780 US patent application
  misc_feature: The sequence is a functional homolog of SEQ ID NO 284 in the 11/479,226 US patent application
  misc_feature: The sequence is a functional homolog of SEQ ID NO 772 in the 10/225,066 US patent application
  misc_feature: The sequence is a functional homolog of SEQ ID NO 910 in the 11/435,388 US patent application
  misc_feature: The sequence is a functional homolog of SEQ ID NO 1942 in the 10/374,780 US patent application
  misc_feature: The sequence is a functional homolog of SEQ ID NO 2262 in the 10/374,780 US patent application
  misc_feature: The sequence is a functional homolog of SEQ ID NO 774 in the 10/225,066 US patent application
  misc_feature: The sequence is a functional homolog of SEQ ID NO 126 in the 10/412,699 US patent application
  misc_feature: Useful for making plants with altered cell wall content and/or composition
MASSSPSCRAGGKPDVDRIKGPWSPEEDEALQRLVARHGARNWSLISRSIPGRSGKSCRLRWCNQLSPQVEHRPFTPEEDDTILRAHARFGNKWATIARLLSGRTDNAIKNHWNSTLKRKYYAAAAAAGGHADADDERPLKRTSSDGHPGLCFSPGSPSGSDLSDSSHHSLPSVMPPAAPA

SEQ ID NO: 39759 - DNA, 1135 bp, Panicum virgatum
  misc_feature: Ceres CLONE 1999454
  misc_feature: Encodes the peptide sequence at SEQ ID NO. 39760
aaaaaacagcaattcataagttatatattcgatatcacagaccagacctctgcaaactacgatagcttgatataaacttcagtacttttcctgaagatgcctgtcgatacgcattcccagccactgcaggcagccccacccccaactttcaaatacaaatccccaccttcggctgccagcatcaatgcctccgaagtcgtttccgactatgttgcccgtctccaaacggccattgcgaagcccacggtattggacttgcaagacgtgatcttccccgaaggtttctggcgagatggcctcttcctgacctgggaccttcgtacttcgcgaggagtcgataagatcagccagtttttgagtaaagatgtgaccgagaagagacttggatctctaaagatcaaacccaccgttgggaactacaagcgacttccggttttacaggtcgaagagtccgcgattagtattctggcttatattgacgtcgaatccgatgaaggactcggagaaggtgttcttcggttgttccttgattctaacaatacatggaaggcattcacgatctatacctgtctcacaagcctcaaaagccacccagaagccagtggcgccaaccgtccccacggcggcctccacggcgaccaatcctcaaaccccacaaactggaaagaacggttggccgaatactcagaattcaccacctcggacccaacagtcctcatcatcggtggtggccaagcaggtctcacagtcgcagcccgcctgacccgtctaggaattccgactttaatcgtcgacaagaaccccaggattggcgataactggcgtaaccgttatcacagccttgtcctgcacgacccggtgtggtatgatcatcttccataccttccattccccaagacgtggccaatcttcactcccaaggataaattgggagactggcttgaattctacgcccgttctttggaaatccccgtttggacgtctacggctccgacctcttcgtcatacgagaacgggaaatggacggtcaaggtttcccgggacgggcaacaacgtattttatctcctaagcatgtaatcctcgccaccggtcattctggtgaacccaacattccaacattcccgggacaagaga

SEQ ID NO: 39760 - protein, 346 aa, Panicum virgatum
  misc_feature: Ceres CLONE 1999454
  misc_feature: SWISSPROT Homolog: EC 1.14.13.84 4-hydroxyacetophenone monooxygenase
MPVDTHSQPLQAAPPPTFKYKSPPSAASINASEVVSDYVARLQTAIAKPTVLDLQDVIFPEGFWRDGLFLTWDLRTSRGVDKISQFLSKDVTEKRLGSLKIKPTVGNYKRLPVLQVEESAISILAYIDVESDEGLGEGVLRLFLDSNNTWKAFTIYTCLTSLKSHPEASGANRPHGGLHGDQSSNPTNWKERLAEYSEFTTSDPTVLIIGGGQAGLTVAARLTRLGIPTLIVDKNPRIGDNWRNRYHSLVLHDPVWYDHLPYLPFPKTWPIFTPKDKLGDWLEFYARSLEIPVWTSTAPTSSSYENGKWTVKVSRDGQQRILSPKHVILATGHSGEPNIPTFPGQE

SEQ ID NO: 39761 - DNA, 511 bp, Panicum virgatum
  misc_feature: Ceres CLONE 1999457-R
  misc_feature: Encodes the peptide sequence at SEQ ID NO. 39762
tgctttgaagatctcccagcttcctctggcttcaggcaagcaaaagaggattgctgtcattactcagggtgctgatccagttgttgttgctgaggatggaaaggtgaaaacattccctgttatcctattgcctaaggagaagcttgttgacaccaacggtgcaggtgacgccttcgttggaggcttcctctctcagttggtccagggcaagagcatcgaagactgcgtgagggccggttgctacgctgccaacgtcatcatccagcgctctggctgcacgtaccctgagaagcctgacttctactagagcaaactcaggcacgccatgagaggggtcgttataggcacacttattcttaaccgctgagtggttcggtgtgttcaacctgtattcttccgaggcttttcttctgatccggccaatatttttgccgtgatatttgttgcacaactataaacgtcgatgttgtctctgtataaggcaggatttgccagcgtggtctgttacttt

SEQ ID NO: 39762 - protein, 101 aa, Panicum virgatum
  misc_feature: Ceres CLONE 1999457-R
  misc_feature: SWISSPROT Homolog: EC 2.7.1.20 Adenosine kinase
ALKISQLPLASGKQKRIAVITQGADPVVVAEDGKVKTFPVILLPKEKLVDTNGAGDAFVGGFLSQLVQGKSIEDCVRAGCYAANVIIQRSGCTYPEKPDFY

SEQ ID NO: 39763 - DNA, 1261 bp, Panicum virgatum
  misc_feature: Ceres CLONE 1999457
aatgcctaacccgagtctaccgtacctcaccttatcctgcctcctcctccatccgtctcctcccgtctcctctgctgcccaggtcgtcgccaccctcccacctctgcttcctccgccgccgcccaggacggcgtcgacgtcacctacctgcccgtccttgcctcctcctctgccgccacctgctctacctcaatctcctccaccgtggtcccgcgcataagcccgataaaggcttcgcggtcagggcggcggcttcctccccatccccacagcgcgacgcgtgcggaaaccctagccgccggggatgtcggaccccctctacccgttctcccgcggcgctctccctggcggcaacggcaagccgccgccgccgcggtactcggattttgaggtcgacctcatcgcggcccgctacgcctcttccccgccgcctccgccctacccctccgccgccgacgccagcgccttcgactcgcacgtcggcgctttcgactcgcacgtcggcgccttcgactcgcacgtcggcgccttcgacttgtacgtcggtgcggggcgatacgcgggaggtgagagcggccatctccctgtttgggttggcgtgaggcattttccgtgtgtgttcatcggcaatgctgctgtatttaccgtggtgtatggacgtatggctgcttgttgatctgaaacttagtagtacgaatgcgatatgttcactgtggcactttgagcatatgttagtgggttatgcaaattatgggtcctgtgaattattgattgggtgttgttacttgttagtgttaagtagcttgtactgatctagtgtatatagatagtacttatgatcagtatattacacttcgcataattgcgagggtccataaaacttgcaaacacagcagagaatagataagggcaataactgcaccatttggtatcgacagtgccattaccttctacttagtatggctgtcccatagccttataacctctcaggtgtttgagttgtttgaaagtatttatgtaaaatgttgtgtagattgcattttcatggagctacagggttcttctgagcaattaagaacaagaggatcaccagcctagttctttgaaggtgttcgagtcatatagcttctaaaagagctttcaagtaggctgacctcggttgtatttgtattgagctttgtttgagttttccttttcaagcatctgagacctttatgtatggaataagcttaaaacaacaatggtataatattccaacagg

SEQ ID NO: 39764 - DNA, 415 bp, Panicum virgatum
  misc_feature: Ceres CLONE 1999459
  misc_feature: Encodes the peptide sequence at SEQ ID NO. 39765
atgcacagacgagagcgagccaagtgtactactcccagtgaagccacactagctagccacaccagcagtttgactagctagctagctagctaggccgcagccatgtcggaggagaagcaccaccacttcttccaccaccacgagaaggactatgaggaggtcggtgctgagtttgacgatggtgaggagggtgacgagggtgatgagtactagacccttcctggtgcatctgtgtcaggcctgcgtgctgctattatccagtgatctgcctgagtggctcgtgctatcgtgttatgtgttgtctgtcggtttgaactatcagtgttcacgtgtggtttacaacacctgatgttgtaagaactctatgttgaatttcctgctatgttactgggttactatgaatgtcgttatgatc

SEQ ID NO: 39765 - protein, 36 aa, Panicum virgatum
  misc_feature: Ceres CLONE 1999459
  misc_feature: Useful for making plants with altered cell wall content and/or composition
MSEEKHHHFFHHHEKDYEEVGAEFDDGEEGDEGDEY

SEQ ID NO: 39766 - DNA, 667 bp, Panicum virgatum
  misc_feature: Ceres CLONE 1999460
  misc_feature: Encodes the peptide sequence at SEQ ID NO. 39767
gatattgatgatactgctcttggctggcgagggtgtgcagggggaagggactgagctgagccatgggggcggcgggcgaggagatggcggcggaggcaaaggaggagaggatactggtgtcagtgcgcctcaggccgctcaacagcagggaggccggggacagctccgactgggagtgcatcagccccaccaccatcatgttccggagcaccgtccccgagcgcgccatgttccccaccgcctacacctacgatagggtgtttggtcccagttgctctacacggcaagtctatgaagaaggagcaaacgaagttgctctgtcagttgtcaggggaattaactcaagcatatttgcctatgggcaaacgagcagcggaaagacttacacaatgacgggaattactgagtatagcatgctggacatctatgattacattgataagcatcctgaaagagagttcattttgaaattctcggccatagagatatacaatgaagctgtgagggaccttctgagccatgacttgacacctcttagacttctagatgatccagagaaagggactactgtagaaagactcactgaggaaactttaagggactacaatcatcttagggatcttctaacagtatgtgaagctcaaaggcagatcggagaaactgcttt

SEQ ID NO: 39767 - protein, 201 aa, Panicum virgatum
  misc_feature: Ceres CLONE 1999460
  misc_feature (22)..(201): Pfam Name: Kinesin Pfam Description: Kinesin motor domain
MGAAGEEMAAEAKEERILVSVRLRPLNSREAGDSSDWECISPTTIMFRSTVPERAMFPTAYTYDRVFGPSCSTRQVYEEGANEVALSVVRGINSSIFAYGQTSSGKTYTMTGITEYSMLDIYDYIDKHPEREFILKFSAIEIYNEAVRDLLSHDLTPLRLLDDPEKGTTVERLTEETLRDYNHLRDLLTVCEAQRQIGETA

SEQ ID NO: 39768 - DNA, 530 bp, Panicum virgatum
  misc_feature: Ceres CLONE 1999470
  misc_feature: Encodes the peptide sequence at SEQ ID NO. 39769
ctccatcaatatgtagtttcggtcatcctctcttctttctttcttctcgttgtgcagtatcaccatgcaccgacccagtgaatacttggatttatgatgtgcagttctatgatcactttgttgatgggggattaaaggatgagattactaaattggcaaccataaggagaaagaatgggatcagtgaagctagcaaggttgatattctagcctctgattctgatctgtatgttgctgcaattgatgagaaaatcattaccaagattgggccaaagatggacctgggcaaccttgtaccttccaactaccagcttgctacctcagggaaagactacgccgtgtgggcaaagaagtgagacggtggacacaactcaatgttcaaatagtgtccctcaacgatgttcaaaaggctcatacttggttaaatttctcaatggctatatctgtatgaatgttactgagaaaataaataaatgaatatatgtttaatagtactactctaatttacttggtgatgattgccttgtcaa

SEQ ID NO: 39769 - protein, 117 aa, Panicum virgatum
  misc_feature: Ceres CLONE 1999470
  misc_feature (56)..(116): Pfam Name: Alpha-amyl_C2 Pfam Description: Alpha-amylase C-terminal beta-sheet domain
  misc_feature: SWISSPROT Homolog: EC 3.2.1.1 Alpha-amylase
PSICSFGHPLFFLSSRCAVSPCTDPVNTWIYDVQFYDHFVDGGLKDEITKLATIRRKNGISEASKVDILASDSDLYVAAIDEKIITKIGPKMDLGNLVPSNYQLATSGKDYAVWAKK

SEQ ID NO: 39770 - DNA, 713 bp, Panicum virgatum
  misc_feature: Ceres CLONE 1999489
  misc_feature: Encodes the peptide sequence at SEQ ID NO. 39771
aaagatgtatcagacaatttgaaagaacatgcagagtttaaaacaatcaagaatgctctgaagaaagtaacatatggatctttgaagatcccagagtttgaagcggactggaagaagattatcgaggagcatggacttggagaaaatgagtgccttagttccttgtatgagcaccgccaactctgggcacctgcatatctcagagacaaattctgggcagggatgtctatttcacagtgtggggagtctatttcctcgtactatgatggttttgtgtacccaaaaacttctttgaagcaatttttcagtaaatatgagatgatattagagaacaaatacaagaaggagtggcaagcagatgaagaatcctcccataggactccattaacagtaacaaagttctacatggaagagcagctggccaaagcctacacaataaacatgttcagaaaatttcaggatgagttgaaagcaacaatgtattgcgatggtatgccaattaaagttgatggtcgacttgtcactttcgaagtaaaagaatgctcgtacatggaagatggaaaggacacagagagcaggacctatgaagtgtacttttgtaaagaagagaaggttgaaattgagtgtgaatgtggttttgttcagttcaccggcgtcctatgtaggcatgcattatctgtgttgaagttgcaggagatatttgaaatcccatc

SEQ ID NO: 39771 - protein, 237 aa, Panicum virgatum
  misc_feature: Ceres CLONE 1999489
  misc_feature (195)..(232): Pfam Name: SWIM Pfam Description: SWIM zinc finger
KDVSDNLKEHAEFKTIKNALKKVTYGSLKIPEFEADWKKIIEEHGLGENECLSSLYEHRQLWAPAYLRDKFWAGMSISQCGESISSYYDGFVYPKTSLKQFFSKYEMILENKYKKEWQADEESSHRTPLTVTKFYMEEQLAKAYTINMFRKFQDELKATMYCDGMPIKVDGRLVTFEVKECSYMEDGKDTESRTYEVYFCKEEKVEIECECGFVQFTGVLCRHALSVLKLQEIFEIP

SEQ ID NO: 39772 - DNA, 1506 bp, Panicum virgatum
  misc_feature: Ceres CLONE 1999503
  misc_feature: Encodes the peptide sequence at SEQ ID NO. 39773
gttgcttgaccatttttcctcttccaaaaccccagacagaccaagcgaggaaaatataaagttggttgcctgtgtcgagtccgtccagccacatccgctggcggcgatgtctccgtcagccgatcccgcagcgccggcgtccacctcggcgcccccgctcgcgcccctcgtcgccgcgcagctcagctacctactctcgcactccaagcttcccatcagggtgggacagatctggtccggctgccgcaacggccgccactccgatcgattcacgctctccatccccttctgcctcgactacgtccactgggatttcgtgtataatgccttgtctcccaaggtggcgcccgacgtggtgttcgggccggaagacgaggggttccagccgctgattgatgacgccgacgctggaaatgacaagagctgcttggcacgctgggattaccgcgatcccaggggactctttgctctcgtgcatgagctccgggaattgtacattgaataccacaagaagcaggttgacaaggtggatgatgcaagggtgacgtttgaattaagtacagttctctctaaggaggggattgaagtctgcatggtaccttccgctgataggccagacgaggtgaaatttgctgtaccacttttggacgtcgactttgacttcaacaaactggtgccaggctgtccttggagattacctcaaaagatccatctacaggtcatttttccaatcagtagaagttcaagttactcttctgttccttctgctccacgactcaaactaatctcaacaccggatttgaaatcacttttctcagttgaggatgtgaaactccctccatggtcaaatgagatgtgtttggcggagtatcttccttccttagaagaaagtcttaacctgctggttgttgaggcatcagcttcaattggtgccagaagacgttttatcgaggcactggctcctacctttgggagaccaatagaggctgatccgatcttttgcaggagggctacagtgctttccatttcaggagttttcacatttctggtacactttgccatcccccttcagttcccaaagcaacaacctatcctcacattgcagagttctcagcactgtaatgccgatggggcacctattacatcacccccaataaatgattatccctggagtcctagatgggatcaagcagaaatggttgaacgaatctatgacttcctggccgatgagtgccaaaatttcaagaagtactgcagcgacgttctcacccagcacaagtagctgtcgtcactcagcagcagaagcattcggggtcattttctcaagaacaagcatccttgcgcttagcaacctgaacgcgtgtctacttgtgcactgcaacagtcagattgacctcggtgctgctatgcgtattcactgctttctttgtcagaacattattttcatgtgatgcgggaagttgaaagaggcaatctcgatgggcggaacccccatagtcagttttc

SEQ ID NO: 39773 - protein, 391 aa, Panicum virgatum
  misc_feature: Ceres CLONE 1999503
  misc_feature (1)..(338): Pfam Name: BRE Pfam Description: Brain and reproductive organ-expressed protein (BRE)
MSPSADPAAPASTSAPPLAPLVAAQLSYLLSHSKLPIRVGQIWSGCRNGRHSDRFTLSIPFCLDYVHWDFVYNALSPKVAPDVVFGPEDEGFQPLIDDADAGNDKSCLARWDYRDPRGLFALVHELRELYIEYHKKQVDKVDDARVTFELSTVLSKEGIEVCMVPSADRPDEVKFAVPLLDVDFDFNKLVPGCPWRLPQKIHLQVIFPISRSSSYSSVPSAPRLKLISTPDLKSLFSVEDVKLPPWSNEMCLAEYLPSLEESLNLLVVEASASIGARRRFIEALAPTFGRPIEADPIFCRRATVLSISGVFTFLVHFAIPLQFPKQQPILTLQSSQHCNADGAPITSPPINDYPWSPRWDQAEMVERIYDFLADECQNFKKYCSDVLTQHK

SEQ ID NO: 39774 - DNA, 746 bp, Panicum virgatum
  misc_feature: Ceres CLONE 1999504
  misc_feature: Encodes the peptide sequence at SEQ ID NO. 39775
aatacgactccccaacaccgccgccgccgtctccgtctccgccgccggccgccatcccactgccttctcctccgtcctccgtttcctgactcagccgccgccctaagtttggctttttggcaaggcgcgacctccctccctccgtttgctgactcgcctacactacaaagtggatttctgagttgttggatgcaacagaggcgctctccaaggcaagcgtaacatgttattcattaactcaagacctgcctcggatcaatcccgccactttcgtctacctcttcgagtccggctgatgggaggtgcccgtcagcaaccgggcgtggacggtccttccctcagagatgccagactgcttgggaacggcgccgtgggtgtggctggaggctatgggctccagcagggggaggacgacttgaggagcagtgacccggatgtcctgctcagcgggccaacatctggtccgcagcagggtgacatggaaaaccaccagcaggtctgctgggagcgcatcctccagaagaagactatcaaagtcttgctcgtggagagtgacgattcaactaggcaggtggtcagtgccctgctacgtcgctgcatgtatgaagttatcccagccgaaaacggccagcaagcatggagttatcttgaagatatgcaaaacagcatagatcttgttttggctgaggttttttatgcctggggtatctggaatatctctgctgagtaggatcatgagccaccat

SEQ ID NO: 39775 - protein, 144 aa, Panicum virgatum
  misc_feature: Ceres CLONE 1999504
  misc_feature: SWISSPROT Homolog: EC 3.1.4.17 3',5'-cyclic-nucleotide phosphodiesterase
MGGARQQPGVDGPSLRDARLLGNGAVGVAGGYGLQQGEDDLRSSDPDVLLSGPTSGPQQGDMENHQQVCWERILQKKTIKVLLVESDDSTRQVVSALLRRCMYEVIPAENGQQAWSYLEDMQNSIDLVLAEVFYAWGIWNISAE

SEQ ID NO: 39776 - DNA, 679 bp, Panicum virgatum
  misc_feature: Ceres CLONE 1999512
  misc_feature: Encodes the peptide sequence at SEQ ID NO. 39777
ctaagccgagcaccgcagagaaaggcgtcttcgtactcgcctctctccgcgactcaaagctttcaccctcctactcccattccccaccgccgccgccgccgccgcctcactcttccgacgacaccatgagggagtgcatctcgatccacatcggccaggccggtatccaggtcggaaacgcgtgctgggagctctactgcctcgagcatggcattcaggctgatggccagatgcccggtgacaagaccattggaggaggtgatgatgctttcaacaccttcttcagtgagactggggctgggaagcatgtcccccgtgctgtgtttgttgaccttgagcccactgtgattgatgaggtgaggactggcacttaccgccagctcttccaccctgagcagctcatcagcggcaaggaggatgctgccaacaactttgcccgtggtcactacacgattggcaaggagattgttgacctgggccttgaccgcatcaggaagcttgccgacaactgtactggtctccagggcttccttgtcttcaatgctgttggtggaggaacggggtctggccttggttccctcctccttgagcgcctgtcggttgactatggcaagaagtccaagcttgggttcactgtatacccatctccccaggtctccacctcagtggttgagccata

SEQ ID NO: 39777 - protein, 184 aa, Panicum virgatum
  misc_feature: Ceres CLONE 1999512
  misc_feature (49)..(184): Pfam Name: Tubulin Pfam Description: Tubulin/FtsZ family, GTPase domain
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLGLDRIRKLADNCTGLQGFLVFNAVGGGTGSGLGSLLLERLSVDYGKKSKLGFTVYPSPQVSTSVVEP

SEQ ID NO: 39778 - DNA, 692 bp, Panicum virgatum
  misc_feature: Ceres CLONE 1999520
  misc_feature: Encodes the peptide sequence at SEQ ID NO. 39779
gcgcgaccttcacctgcgcgaaccccgcgaagccgccaggccacgagcccacggctccccctcgacctcccacccggccaccccccgcctcgctccctccgccgcctagggttttccaccgggcgccgccgcagcggcggcccgggatgcgggtgggcccgcgcaggtagagccctcggacccaccaccgcccgcgccatgtcgctcctgcggcggcggaagcagccgcagcgggagcagccgccgccgtcctcggacggcaacgggtccgaccacgacgacgacgacgacgacaaggggaagagaccgtcctcctccgcgccggcgtccaaggaggcgaccaggcggaccaaggccaggtggtcgtgcgtggacagctgctgctggctggtcgggtgcgtgtgctccgcctggtggctcctgctcttcctctacaacgccatgccggcgtcgttcccgcagtacgtcacggaggccatcacaggcccgctcccggacccgcccggggtcaagctgcacaaggaggggctccgcgtcaagcaccccgtcgttttcgtccccggcatcgtcaccggcgggctcgagctctgggagggccaccactgcgccgaggggctcttccgcaagcggctatggggaggcacatttggcgacgtgtacaagagacctttatgctgggttgaacatatgtc

SEQ ID NO: 39779 - protein, 164 aa, Panicum virgatum
  misc_feature: Ceres CLONE 1999520
  misc_feature: SWISSPROT Homolog: EC 2.3.1.158 Phospholipid:diacylglycerol acyltransferase
MSLLRRRKQPQREQPPPSSDGNGSDHDDDDDDKGKRPSSSAPASKEATRRTKARWSCVDSCCWLVGCVCSAWWLLLFLYNAMPASFPQYVTEAITGPLPDPPGVKLHKEGLRVKHPVVFVPGIVTGGLELWEGHHCAEGLFRKRLWGGTFGDVYKRPLCWVEHM

SEQ ID NO: 39780 - DNA, 1510 bp, Panicum virgatum
  misc_feature: Ceres CLONE 1999524
  misc_feature: Encodes the peptide sequence at SEQ ID NO. 39781
acgatagatttgccggtttctaaggagaaagctcccaaggctaggctctgccgctccctgcagcagagtcgtaggctgcagcagcgccaaaatggcgagcaaggtggtggacctccggtcggacacggtcaccaagccctcggaggccatgcgggccgccatggccgcggccgacgtcgacgacgacgtcgtgggcgtcgacccgaccgcgcagcgcttccaggcggagatggccgcgctcatgggcaaggaggccgcgctcttcgtgccctcgggcaccatgggcaacctcatctccgtcctcgtgcactgcgacgtcaggggcagcgaggccatcctcggcgacaactcgcacatccacgtctacgagaacgggggcatctccaccatcggcggcgtgcaccccaagaccgtgcccaacaaccccgacggcaccatggacatcgacaagatcgtcgcggccatcaggcacccggatctgcattacccgaccaccaggctcatctgcctggagaacacacatgggaagtgagttgcacaaagtaccttcaatgaacataactgttccctatcttaattcgtattattccaactgtttctgcagttctggtggaaatgtttatctgtagaatacactgacaaggtcggtgaaattgcaacgagccatggcctcaagcttcatattgatggagctcgcatttttaacgcctctgtggcgcttggagtccctgtagatagactcgtgaaagctgctgattcagtttcggtatgcctatctaaagggttaggcgcccccgttgggtcggttattgttggttcgaaggacttcattgagaaggccaaaattcttaggaagaccctaggtggtggcatgaggcaggttggagttctctgtgctgctgctcaagttgccgtccgtgacactgtgggaaagcttgcagatgaccataggaaggctagagctttggcagaggggctgaagaaaattaaacatattacagtcgatccagcttccgttgagaccaatatggtattcttcgatatcgtcgatccaagaatatcacctgacaatctatgccaagtcttggaacagcacaatgtgcttacaatgccagcgagttcaaaaagtatcaggttcgtcctccattaccaaatttcagacagcgacgttcaatacgcagtgacatgtgttgagaaagcttttgaagagctactgaagggtggtacaaacttggagctcttgacaaatggtactacaagaagttcgtacgggcactagatcacttccctttggaccgccccaatgtacaagctcggtgaccagcaatgttttctttaaaccagcaggagcgctgcttaattatttaagaaggggaagcacgtgaaggttgacgatagattctgtttagttatgaagaactgttggtgtttgtgacggtgacctttgctgaataactgatggttaatcgtgaccgcaccttggctgaataaactgctcctgttcactctc

SEQ ID NO: 39781 - protein, 146 aa, Panicum virgatum
  misc_feature: Ceres CLONE 1999524
  misc_feature (7)..(146): Pfam Name: Beta_elim_lyase Pfam Description: Beta-eliminating lyase
  misc_feature: SWISSPROT Homolog: EC 4.1.2.5 Threonine aldolase
MASKVVDLRSDTVTKPSEAMRAAMAAADVDDDVVGVDPTAQRFQAEMAALMGKEAALFVPSGTMGNLISVLVHCDVRGSEAILGDNSHIHVYENGGISTIGGVHPKTVPNNPDGTMDIDKIVAAIRHPDLHYPTTRLICLENTHGK

SEQ ID NO: 39782 - DNA, 1423 bp, Panicum virgatum
  misc_feature: Ceres CLONE 1999545
  misc_feature: Encodes the peptide sequence at SEQ ID NO. 39783
agcctcctccgaaagcccctcctcccccccccccccgctttactattcattggaacccagcgattctccccatccccatccacggtgcgcactgttcgcccgtcggtggaggaagaaggggagtgggagccgaactgtaaaagccgccgggtgggggaacccgcactccgcctcctctcaaaatcgcagaaacccacaggccacatcctgaaaaacccctggccaaagcctcagattttgcagccgccgccgaagctggcgttcgcgtaggaggctgcgccctctgtcctggatccatccgggtaagccatggctgtgaaggcgagctccgtcgacaacaggaccaggagcacggtgtccatatgcatagtcattggcatgtgctgcttcttctacatcctcggagcatggcagaagagcgggtttggcaagggagacagcatcgcgctggagatcacaaagcgcacggactgcaccgtcctgccgaacctcagcttcgacacacattctaaagttgacagcagctccagtgatcttgttttgccggtgaagaagttcaagccgtgccctgatcgatacacggattataccccttgtcaagatcagaacagggcgatgaagttccctagggagaacatgaactacagagagaggcactgcccgccacagaaggaaaagctgcactgtttgataccgccgccgaagggatatgtggctccgttcccatggccgaagagtcgggactatgttcctttcgcgaattgcccatataagagcttgacagttgagaaagccatccagaactgggttcaatatgagggcaatgtgttcagattccctggtggagggacacaatttcctcaaggagcagataagtacatagatcagctggcatcagtcattccgatcgccaatggaactgtcaggactgcacttgacactggttgcggggtagccagtttgggagcatatttgttgaagaggaatgtcttggccatgtcgtttgcaccaagagattcgcatgaggcacaagtgcagtttgccctggagagaggtgtccctgctgttattggtgttctgggtacaataaaacttccttatccatggagggcctttgacatggcacattgttccaggtgtttgattccatggggagcaaatgatggaatgtacatgatggaagttgatagggttctaaggcctggtggctactgggttctgtctggacctccaattaattggaaggtgaactataagggttggcagcgcacaaagaaggatcttgaagcagagcagaacagaatagaggaaattgctgaccttctttgttgggaaaaagtctcagagaagggtgagatggcaatatggaggaaaagggtaaacactgagtcttgtccttcttagcaagatgaatccactgtgc

SEQ ID NO: 39783 - protein, 364 aa, Panicum virgatum
  misc_feature: Ceres CLONE 1999545
  misc_feature: Useful for making plants with altered cell wall content and/or composition
  misc_feature: The sequence is a functional homolog of SEQ ID NO 758 in the 10/412,699 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 1593 in the 11/479,226 US patent application
  misc_feature: The sequence is a functional homolog of SEQ ID NO 560 in the 10/412,699 US patent application
  misc_feature: The sequence is a functional homolog of SEQ ID NO 354 in the 10/374,780 US patent application
  misc_feature: The sequence is a functional homolog of SEQ ID NO 72 in the 10/225,068 US patent application
  misc_feature: The sequence is a functional homolog of SEQ ID NO 910 in the 10/225,066 US patent application
MAVKASSVDNRTRSTVSICIVIGMCCFFYILGAWQKSGFGKGDSIALEITKRTDCTVLPNLSFDTHSKVDSSSSDLVLPVKKFKPCPDRYTDYTPCQDQNRAMKFPRENMNYRERHCPPQKEKLHCLIPPPKGYVAPFPWPKSRDYVPFANCPYKSLTVEKAIQNWVQYEGNVFRFPGGGTQFPQGADKYIDQLASVIPIANGTVRTALDTGCGVASLGAYLLKRNVLAMSFAPRDSHEAQVQFALERGVPAVIGVLGTIKLPYPWRAFDMAHCSRCLIPWGANDGMYMMEVDRVLRPGGYWVLSGPPINWKVNYKGWQRTKKDLEAEQNRIEEIADLLCWEKVSEKGEMAIWRKRVNTESCPS

SEQ ID NO: 39784 - DNA, 657 bp, Panicum virgatum
  misc_feature: Ceres CLONE 1999545-R
  misc_feature: Encodes the peptide sequence at SEQ ID NO. 39785
ggggattcgctgccgcgatagagtccccgaaatcttgggtgatgaatgttgtgccaaccattgcgaagatgtctacccttggggctgtgtatgagcgaggattgatcggcatataccatgactggtgtgaggctttctctacttatccaaggacatatgatcttatccatgctagtggtcttttcaccttgtacaagaacaagtgcagcatggaagacattatcttggaaatggaccgcatcttgaggccagaaggtgctgtcataatacgggatgatgtcgatgtcttgattaaggtgaatagccttgctcagggcatgaggtggaacacaaagatggtcgatcatgaggatggccccctcatgcgcgagaagatcttgtatgctgtaaagcagtattgggttggtggaaatcagacggctgtagcttgaaccaaggacgtttccaagcttctaacacgagaaaaatctgcaatccaaccttttctgacgaccaattagcatagggagttatcctgtggaagggaaatggcccactgttggggtagcactgaagcagccaagataccgttgcttgctggagatagctgcagccacataatgttgtaacaattttgtaattttttgaagcccctcgtataaactggttactatgttc

SEQ ID NO: 39785 - protein, 142 aa, Panicum virgatum
  misc_feature: Ceres CLONE 1999545-R
  misc_feature: Useful for making plants with altered cell wall content and/or composition
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 1593 in the 11/479,226 US patent application
  misc_feature: The sequence is a functional homolog of SEQ ID NO 758 in the 10/412,699 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 560 in the 10/412,699 US patent application
  misc_feature: The sequence is a functional homolog of SEQ ID NO 354 in the 10/374,780 US patent application
  misc_feature: The sequence is a functional homolog of SEQ ID NO 72 in the 10/225,068 US patent application
  misc_feature: The sequence is a functional homolog of SEQ ID NO 910 in the 10/225,066 US patent application
  misc_feature: The sequence is a functional homolog of SEQ ID NO 508 in the 11/435,388 US patent application
  misc_feature: The sequence is a functional homolog of SEQ ID NO 562 in the 10/412,699 US patent application
  misc_feature: The sequence is a functional homolog of SEQ ID NO 2546 in the 10/374,780 US patent application
  misc_feature: The sequence is a functional homolog of SEQ ID NO 760 in the 10/412,699 US patent application
  misc_feature: The sequence is a functional homolog of SEQ ID NO 824 in the 10/225,066 US patent application
  misc_feature: The sequence is a functional homolog of SEQ ID NO 626 in the 11/435,388 US patent application
  misc_feature: The sequence is a functional homolog of SEQ ID NO 2738 in the 10/374,780 US patent application
  misc_feature: The sequence is a functional homolog of SEQ ID NO 386 in the 10/225,066 US patent application
GFAAAIESPKSWVMNVVPTIAKMSTLGAVYERGLIGIYHDWCEAFSTYPRTYDLIHASGLFTLYKNKCSMEDIILEMDRILRPEGAVIIRDDVDVLIKVNSLAQGMRWNTKMVDHEDGPLMREKILYAVKQYWVGGNQTAVA

SEQ ID NO: 39786 - DNA, 610 bp, Panicum virgatum
  misc_feature: Ceres CLONE 1999547
  misc_feature: Encodes the peptide sequence at SEQ ID NO. 39787
aaaaatccccatcaaaccccccagacttttccgcgagcgccctcctgacctccggccttcccagccgccaagccttcgagaaccctccggggctcgctcgatccgatcgcaccccgcgcgggctgccgccatggccgacgaggcgaaggccaagggtaatgcggcgttctccgccggccgctacgaggaggcggcgcggcacttctcggacgccatcgcgctcgccccgggcaaccacgtcctctactccaaccgctccgccgcgctcgcctcgctccaccgctactccgacgctctcgccgacgcgcagaagaccgtcgagctcaagcccgactgggccaagggctactcgcggctcggcgccgcgcacctcggcctcggcgccgcgcacctcggcctcggcgacgccgccagcgctgtcgccgcctacgagaaggggctcgcgctcgaccccactaacgagggcctcaaggcggggctcgaggacgccaagaaggccgccgccgccccgccgcgccgcgggccgtccgggcccgacgccatcggccagatgttccagggccccgagctgtggaccaagatcgcggccgaccccaccacacgcgcctac

SEQ ID NO: 39787 - protein, 159 aa, Panicum virgatum
  misc_feature: Ceres CLONE 1999547
  misc_feature (2)..(35): Pfam Name: TPR_2 Pfam Description: Tetratricopeptide repeat
  misc_feature (77)..(110): Pfam Name: TPR_2 Pfam Description: Tetratricopeptide repeat
  misc_feature: SWISSPROT Homolog: EC 3.1.3.16 Phosphoprotein phosphatase
MADEAKAKGNAAFSAGRYEEAARHFSDAIALAPGNHVLYSNRSAALASLHRYSDALADAQKTVELKPDWAKGYSRLGAAHLGLGAAHLGLGDAASAVAAYEKGLALDPTNEGLKAGLEDAKKAAAAPPRRGPSGPDAIGQMFQGPELWTKIAADPTTRA

SEQ ID NO: 39788 - DNA, 634 bp, Panicum virgatum
  misc_feature: Ceres CLONE 1999562
  misc_feature: Encodes the peptide sequence at SEQ ID NO. 39789
gctcggctcggctccccctcgctccccgcccgcctcccccgcagagcgcacgcccgcctgctaggccgcaaggccccgcccacctccgccccgcgcccgctcctcctctcgttccccgggctccgcgctccagccgcgcagcaacgctccgccgagtgccagtttggcgaagatgacggcgaggaggaggaggagtacgggtatgacggcgaggaggatgatgatgaagacgaggtggaggaggagatggacgtggaggccatggaggaggaggcgcgcggcgccgccgccgacctcgccgagcgcctcgcccgggagctccacatcgatgatgatgtccgggagaaacggaaaaacatcagggaatccgtgtctaaacatatcccagatagtcttcttccaaaggtggcaattattgggaggccaaatgttggtaaatctgcattgttcaaccgtcttgttgggggaaacagggctatcgttgttgatgaacctggtgtgacaagagatcgcttgtatggacgatcttattggggtgatcaggagttcatggttattgatactggtggggtaattactttatcaaagtctcaggcgggtgtcatggaagaacttgctgtcaccactactgttg

SEQ ID NO: 39789 - protein, 211 aa, Panicum virgatum
  misc_feature: Ceres CLONE 1999562
  misc_feature (134)..(208): Pfam Name: MMR_HSR1 Pfam Description: GTPase of unknown function
ARLGSPSLPARLPRRAHARLLGRKAPPTSAPRPLLLSFPGLRAPAAQQRSAECQFGEDDGEEEEEYGYDGEEDDDEDEVEEEMDVEAMEEEARGAAADLAERLARELHIDDDVREKRKNIRESVSKHIPDSLLPKVAIIGRPNVGKSALFNRLVGGNRAIVVDEPGVTRDRLYGRSYWGDQEFMVIDTGGVITLSKSQAGVMEELAVTTTV

SEQ ID NO: 39790 - DNA, 1289 bp, Panicum virgatum
  misc_feature: Ceres CLONE 1999568
  misc_feature: Encodes the peptide sequence at SEQ ID NO. 39791
ctctttctctctcccccctctcccacctcgcagccccacctcctctttccctccctccccacacaccatggcgatctccgagctcgggtgagctgaccagaatgcggccgatttgaggaggcggcgggagggtgatggggggttccggccggattcttcgcgagggtactgtagagtaggtttcggttccggtggacgtgggaggaccggaggatgagctcgtcgtcggcggccagcatcggccagacgcagccgccgccgccgctggaggaagagaagaagtgcctcaactcggagctgtggcacgcgtgcgccggcccgctcgtctgcctccccaccgtcggcacgcgcgtcgtctacttcccgcagggccacagcgagcaggtgagctccggtctcgctccgtggtgccggtctaccacctggcgtcgccctgatgagtgcaaggtggcagcgtcgacgaacaaggaggtggacgggcacatccccaactaccccaacctgccgccgcagctcatctgccagctacatgatgtcacaatgcatgcggatgtggagactgatgaagtgtacgctcagatgacgctgcagccgctgaacccacaagagcagaacgatgcatacctgccggcggagatggggatcatgagcaagcagcctacgaattacttctgcaagacgctgacggccagcgacaccagcacgcatggcgggttctctgtgccccgtcgtgcagcggagcgcgtcttcccccctctggatttcacacagcagcctccagcacaggagcttattgcacgggatattcatgatgtggagtggaagttcaggcatatcttccgaggccaacccaagagacacctgctgactactggctggagtgtgtttgtcagtgctaagagactcgttgctggagattctgtgctattcatatggaatgagaagaaccaactttttcttggaatcagacatgccagccggccacagactgtaatgccctcttctgttctttctagtgacagcatgcatatcggcctccttgcagcagcagctcatgctgctgcaacaaacagccgattcacaattttctataatcccagggcaagtccatcagaatttgttatacccctttcaaagtacatcaaggctgttttccacacccggatatcggttgggatgcgattcaggatgttgtttgagaccgaggaatctagtgtccgcaggtacatggggacgataacagaagtaagtgatgcagacccagtgcgctggcctagttcctattggag

SEQ ID NO: 39791 - protein, 358 aa, Panicum virgatum
  misc_feature: Ceres CLONE 1999568
  misc_feature (279)..(358): Pfam Name: Auxin_resp Pfam Description: Auxin response factor
  misc_feature (152)..(257): Pfam Name: B3 Pfam Description: B3 DNA binding domain
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
  misc_feature: Useful for making plants with modulated light quality sensitivity
  misc_feature: The sequence is a functional homolog of SEQ ID NO 100 in the 10/666,642 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
  misc_feature: The sequence is a functional homolog of SEQ ID NO 298 in the 10/412,699 US patent application
  misc_feature: Useful for biocontainment applications
  misc_feature: Useful for making plants with modulated flowering time
  misc_feature: The sequence is a functional homolog of SEQ ID NO 300 in the 10/412,699 US patent application
MSSSSAASIGQTQPPPPLEEEKKCLNSELWHACAGPLVCLPTVGTRVVYFPQGHSEQVSSGLAPWCRSTTWRRPDECKVAASTNKEVDGHIPNYPNLPPQLICQLHDVTMHADVETDEVYAQMTLQPLNPQEQNDAYLPAEMGIMSKQPTNYFCKTLTASDTSTHGGFSVPRRAAERVFPPLDFTQQPPAQELIARDIHDVEWKFRHIFRGQPKRHLLTTGWSVFVSAKRLVAGDSVLFIWNEKNQLFLGIRHASRPQTVMPSSVLSSDSMHIGLLAAAAHAAATNSRFTIFYNPRASPSEFVIPLSKYIKAVFHTRISVGMRFRMLFETEESSVRRYMGTITEVSDADPVRWPSSYW

SEQ ID NO: 39792 - DNA, 580 bp, Panicum virgatum
  misc_feature: Ceres CLONE 1999568-R
  misc_feature: Encodes the peptide sequence at SEQ ID NO. 39793
tcgagaggaactaggtcagatgttcggcattaagggtcagttggacgaccctgatagatcaggctggcagcttgtatttgtcgacagggagaatgatgtgcttctccttggagacgacccgtgggagtcatttgtgaatagtgtatggtacatcaagatactttcacctgaggatgtgcataagatgggaaagcaaggaaacgatccacgctacctatcttaaatggatacacggagccttttctggctcccatgacgattctgcggtacatggtagcattcctgctcgtgacagtctgctccgatgtgcttgcatgttcgcccgtgtcatctcttgcatgtccaccatgcacgtcttcggaactccccgtttatctgtatctggtgcaggccaccgatactctggactgatatcttgtaagttccacttaggaatcagtatcagtattcagtaactctatcctagttggtttgtactttatagctcgcacggcgctcgtgtcgcgtcaaatcttcggactaaatctttagttgaaactgtatcgtgattcgtaagttatgtatttgaggattcctcagc

SEQ ID NO: 39793 - protein, 73 aa, Panicum virgatum
  misc_feature: Ceres CLONE 1999568-R
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: Useful for making plants with modulated light quality sensitivity
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 100 in the 10/666,642 US patent application
REELGQMFGIKGQLDDPDRSGWQLVFVDRENDVLLLGDDPWESFVNSVWYIKILSPEDVHKMGKQGNDPRYLS

SEQ ID NO: 39794 - DNA, 655 bp, Panicum virgatum
  misc_feature: Ceres CLONE 1999584-R
  misc_feature: Encodes the peptide sequence at SEQ ID NO. 39795
tatcagaagtccgggcagagggcctccacatcatcaactcccttcatgggatcagaatcaagacagctccagggcgtggagggtacgtgaagaatgtgttcatagcagatgtgagcatggataacgtttcaatcgccatcaggatcagtgggaactttggtgaacatcctgatgacaaatatgacaggaatgctctccccatgataagcaatattacaatcaaggatgttgttggcatcaacattggtgttgctggtatactagaaggcattcatggggacaaattcagcaacattttcctgtccaatgtttccctcagtgtccactctgcacatccatggaattgttcacttattgaagggtattcaaactctgtgatcccagaatcatgtgaacagctcagaagcaattgtagacagacatctgattgctatgatggcagcagttcttcagcaatacatgggcaggaaccaagagatacgttgagcaccagccggttgctaaatcctttaatgaagtttgctttattttagtgtaggtatagatgtcccttggtattgttgcaaaggggcttgcttcatgggatgagtcctattagtcatgtatatctgattcttgcaattatttgtgcttagagtgtcgcttgcctctttgc

SEQ ID NO: 39795 - protein, 176 aa, Panicum virgatum
  misc_feature: Ceres CLONE 1999584-R
  misc_feature: SWISSPROT Homolog: EC 3.2.1.67 Galacturan 1,4-alpha-galacturonidase
  misc_feature: Useful for making plants with altered carbohydrate content
  misc_feature: Useful for making plants with altered cell wall content and/or composition
SEVRAEGLHIINSLHGIRIKTAPGRGGYVKNVFIADVSMDNVSIAIRISGNFGEHPDDKYDRNALPMISNITIKDVVGINIGVAGILEGIHGDKFSNIFLSNVSLSVHSAHPWNCSLIEGYSNSVIPESCEQLRSNCRQTSDCYDGSSSSAIHGQEPRDTLSTSRLLNPLMKFALF

SEQ ID NO: 39796 - DNA, 1291 bp, Panicum virgatum
  misc_feature: Ceres CLONE 1999584
ggagcaggcactgacgaggggctccgggattccggacgaggagcaaagatctcgccggggaagatgaggagatctgcatctgtgagtgctcattcctactgttaactctcgtgctgattccttcatctctcggggcagaaaggatacatgccggtgcgggagtttcagtgaggctgatggtccaacagcaccattgccatttcttctcttgccaaatgccggtgaccctgtgtggcggtgttcatcatccaagagctatacgcgtctttgttgttcggattttcattttttgtgcattgtcaaatggcctaagggagtggtgtcgtgacagatcgatcctgcattcctgctcgacatctggtggcattggcccattattcatcatagtcatgctgcgttaatctcaacatttggaggcccatgttcctactgttttccctttcacttgattgagatgtgaccatgcaaaaaatacttgattgaaatgttattttgcaaattgggatcatgccctgacccacatgtcattgtgatacgagtatcaaatcttgaaaggctcatgaatagatagttaagccaccgtaaatgaggtggccctgttcagcttcttggagcattctgatgctataaatccaatagacttagaattttgtttttgaatgcataattctggtcaatttgcactactatgagtgttcgcagatgataatttctttgtgttatctgtttgtgctaattattacttgttagcactaggaaatggacgatcgctactgattttttttttgagtttctgctagttatttcaagtccttctggttttgacaaccatggttaagactcaatggtccactgtatccggcatttattgcaaagaaatgtcgccaaatgtatatcgacctcacagtgtcacaataactgaatttggcgctgttggggatggtgtgactctcaatacaaaagcattccagaatgcaatcttctatctcaattcatttgcggacaagggtggcgcacagctcttcgtgcctgcaggaaagtggctgacagggagttttggtcttatcagccacctcactttgtcactggacaaggatgcagtaataattggatcaccggattcatctgattggccagttgttgatcctcttccatcctatgggcgaggtagagagcttcctggaaaaaggcaccagagtttgatttttggatcatatctgacagacgtaattataactggttagtaattactgtagtttcatcacccatcttcttcagatattatttagtt

SEQ ID NO: 39797 - DNA, 694 bp, Panicum virgatum
  misc_feature: Ceres CLONE 1999586
  misc_feature: Encodes the peptide sequence at SEQ ID NO. 39798
ctttgctctctaaggcagacatgggtcctgaagggcagtacagcgctttacaggttcttgtgaatattttggagcatcctgaatgccgcgctgattataacttgacacctcgccaaactattgagccagtcattactctattgaattcatccccaccagctgtgcaacaattagctgcagaactcctatcccatcttcttttagaagatcacctccagaaggatacaataacagagcaagctattactcctcttattcaagttctttcatcaggtttgccaaatctacagcagagagctataaaagctcttgccaacctggcaatagcctggccaaatacaattgcaaaggagggtggtgttttcgagttgtccaaggttttgttacaatctgacccacctttgcctcatgttgtatgggaatctgcagcatccgtcttatctagcattttgcagtacagtactgagtttttccttgaggttcctgttgcagtactagtgcagttgctcaggtcaggaactgaaagcactgttgttggtgctttgaatgccctgcttgtattggagagtgatgattcaacaagtgcagaagcaatggctgaaagtggtgctgtggaagcattgctagatctcctgaggagtcatcaatgtgaggaaactgctgccagactcattgaggctttgcttaacaacgt

SEQ ID NO: 39798 - protein, 230 aa, Panicum virgatum
  misc_feature: Ceres CLONE 1999586
  misc_feature (69)..(108): Pfam Name: Arm Pfam Description: Armadillo/beta-catenin-like repeat
LLSKADMGPEGQYSALQVLVNILEHPECRADYNLTPRQTIEPVITLLNSSPPAVQQLAAELLSHLLLEDHLQKDTITEQAITPLIQVLSSGLPNLQQRAIKALANLAIAWPNTIAKEGGVFELSKVLLQSDPPLPHVVWESAASVLSSILQYSTEFFLEVPVAVLVQLLRSGTESTVVGALNALLVLESDDSTSAEAMAESGAVEALLDLLRSHQCEETAARLIEALLNN

SEQ ID NO: 39799 - DNA, 666 bp, Panicum virgatum
  misc_feature: Ceres CLONE 1999589
  misc_feature: Encodes the peptide sequence at SEQ ID NO. 39800
acacacgcggacacgccactagcctcctctcggtctgagcagctcatcaacgccgccggcaagaagtcccctcgagcttgcccccggcagccagccagcccaggcatcagccatgggctcgaccgccgccgacgtggccgcggccgcggccgcggacgaggaggcgtgcatgtacgcgctgcagctggcgtcgtcgtccatcctgccgatgacgctcaagaacgccatcgagctgggcctgctggaggtgctccagaaggaccccgcggcggcgctggcgccggaggaggtggtggcgcggctgcccgtggcgccggccaacccggacgcggcggccatggtcgaccgcatgctgcgcctgctcgcctcctacgacgtcgtcaggtgccggatggaggagggcaaggacggccggtactcgcgccggtacgccgccgcgccggtgtgcaagtggctcacccccaacgaggacggcgtctccatggccgcgctcgcgctcatgaaccaggacaaggtcctcatggagagctggtactacctcaaggacgcggtgctggagggcggcatcccgttcaacaaggcgtacggcatgacggcgttcgagtaccacggcacggacccgcgcttcaaccgcgtgttcaacaagtgcatcctgccggtgaaccc

SEQ ID NO: 39800 - protein, 184 aa, Panicum virgatum
  misc_feature: Ceres CLONE 1999589
  misc_feature (33)..(85): Pfam Name: Dimerisation Pfam Description: Dimerisation domain
  misc_feature: SWISSPROT Homolog: EC 2.1.1.68 Caffeate O-methyltransferase
  misc_feature: Useful for making plants with altered carbohydrate content
  misc_feature: Useful for making plants with altered cell wall content and/or composition
MGSTAADVAAAAAADEEACMYALQLASSSILPMTLKNAIELGLLEVLQKDPAAALAPEEVVARLPVAPANPDAAAMVDRMLRLLASYDVVRCRMEEGKDGRYSRRYAAAPVCKWLTPNEDGVSMAALALMNQDKVLMESWYYLKDAVLEGGIPFNKAYGMTAFEYHGTDPRFNRVFNKCILPVN

SEQ ID NO: 39801 - DNA, 417 bp, Panicum virgatum
  misc_feature: Ceres CLONE 1999596
  misc_feature: Encodes the peptide sequence at SEQ ID NO. 39802
ccccccccccccccccccgctttccccatccttcgccgccgtcgcggtcgcctcgcagtccgaagagccgcccccgactctgatggccagccgctgggtccgacccgaggtgtacccgctgttcgcggcgatgggcgtggccgtcggcatctgcggatttcagctcttccggaacatcaccgggaacccggaagtcagggtaaacaaggctgggagggcagctggtgtgcttgagaaccatgaggaggggaggcgttacgcaatgcacagcctcagaagctttgtgcatgacaagaccccagaaatcatgccggccatcaacaagttcttcactgagccaaagtgaagcgatttgctcgggtgctgctgctggagtcgtttttgtcgagtgtacccatttaaggcattcaatatgtt

SEQ ID NO: 39802 - protein, 87 aa, Panicum virgatum
  misc_feature: Ceres CLONE 1999596
  misc_feature (2)..(87): Pfam Name: B12D Pfam Description: B12D protein
MASRWVRPEVYPLFAAMGVAVGICGFQLFRNITGNPEVRVNKAGRAAGVLENHEEGRRYAMHSLRSFVHDKTPEIMPAINKFFTEPK

SEQ ID NO: 39803 - DNA, 686 bp, Panicum virgatum
  misc_feature: Ceres CLONE 1999600
  misc_feature: Encodes the peptide sequence at SEQ ID NO. 39804
ggactctctcctccctgggatcccctcctccgttgctcttccttccctagcggcggcgactggagagcggcggtgccatttgtcacgtcttcgtccagcccttcgccggcgacgagcatcctccagtttgcagcctgtgcgcgaaactcaggaaaagcaagtccagttatggaaagatctgatacttgattactgtagaagtcaaaagatacatacaatatccctggaagaagatttccccttgttctccaatccaaagatcgagagatctcttagccatgaagcaaaggaagtgttccttgcagctcttgttagtgaaggtcgtgcggagtggatggacaaaggtcacaagaaatgcctcattttttggctaagaatacaggattgggccaatttgatattaaattttgtaaaggataatggattggaagtaatgaccgttgaagaaatacgctctggaatcgatactcgtggaactgaactcgagggaatcaatcgtggtgttctcatgcgggctctgcggcaattggaacagaaaggcaaagcagctatcttcaaaggcacttcggccgatgacgaaggcgtgaagttttctgtgtaaatttctttgtgatcctcaaactggcaggcaaataaaactgaccgatcagtagtgtctttgaacatgacctgaaaaatcacctcgt

SEQ ID NO: 39804 - protein, 199 aa, Panicum virgatum
  misc_feature: Ceres CLONE 1999600
  misc_feature (42)..(198): Pfam Name: ESCRT-II Pfam Description: ESCRT-II complex subunit
DSLLPGIPSSVALPSLAAATGERRCHLSRLRPALRRRRASSSLQPVRETQEKQVQLWKDLILDYCRSQKIHTISLEEDFPLFSNPKIERSLSHEAKEVFLAALVSEGRAEWMDKGHKKCLIFWLRIQDWANLILNFVKDNGLEVMTVEEIRSGIDTRGTELEGINRGVLMRALRQLEQKGKAAIFKGTSADDEGVKFSV

SEQ ID NO: 39805 - DNA, 723 bp, Panicum virgatum
  misc_feature: Ceres CLONE 1999647
  misc_feature: Encodes the peptide sequence at SEQ ID NO. 39806
accaagcatcaccacgcattcgacgcaggcgcgcagggaagcacgggggcaggaaaaagagcacggacgatttgcagcggcagcggctgcgggcgaggaggaagactcccgatctcgccggagtcggcggaacgcacgctcccctttccttcggcgtcgccgtcgtcgagcggccgcgcgtgtagccgccgggatcgctcgctagccggtggcgctcggcgaccgacgcggtaggggcccggggagacagccagcgcgcgggagaagagatcaatggggggagcggggcacggcgtgcatttcttggacgcgtgcttcctctgccggaggccgctcgccggcaaccgcgacatcttcatgtacagaggggacacggcgttctgcagcgacgagtgccggagcgcgcagatggcggcggacgaggcggcggagaggaaggagagggccagcgccaaggcggtggcgcatggggccctgcccgccagggaagcggaaggcccgcaggagcgcagcggcaaggtccgggccgggtccatcctggccctgtaaccagaaacttctctcgaatctaagcacggcattttcttttcttttttgccccccttcctttcctttccatgtaggagtatttctctacctttacgaaacgcaccaccggtgggtcgccaccttcatgtacacggacgggtttgtgttttttgatgatgaaaaccccttgggacc

SEQ ID NO: 39806 - protein, 91 aa, Panicum virgatum; identical to SEQ ID NO: 14357
  misc_feature: Ceres CLONE 1999647
  misc_feature: Useful for making plants with modulated biomass
  misc_feature: Useful for making plants with modulated nitrogen use efficiency

SEQ ID NO: 39807 - DNA, 676 bp, Panicum virgatum
  misc_feature: Ceres CLONE 1999654
  misc_feature: Encodes the peptide sequence at SEQ ID NO. 39808
attccgtgcccaacctctccactgtcccctcgcgcacgggccgccgcctaccaacgccaagcacgagccggaaccaggaagaaacaatttgttcttcgctggctcgctcgccattcttatttctgcccattctccgcccagcgccccggctcccagcagcgaagggagctaggactagaagtctagaacaagtagagacgtagagtacagggagaagccatggccggcaggagcttcttgatccggtctcccaaggaggagtccgacgccgccgtcaaagaggctgtactactgggagcgaagaatgctgcaatagctggtactgtggtagcggttcccacgttggtcggctgccgtgtccttccttgggctaaggctaatctcaactacactgcacaagcactcatcatatctgcagcctgtatcgctggcttcttcatcactgccgataaaaccattctacggaacgcaagacaaaacaccatcgggaagcttgacaagtagatttcggtgcagaactatggctgtaatggctcactgattttggtgtttcgctactcaagccaattgtgctgtaaagacttgcttacctgacggactcaaccggtgcatgcagttttcccctaattttatttggaataaaatatggggctaatgggtatacgcctttgtaatg

SEQ ID NO: 39808 - protein, 94 aa, Panicum virgatum; identical to SEQ ID NO: 12673
  misc_feature: Ceres CLONE 1999654
  misc_feature (10)..(88): Pfam Name: ENOD93 Pfam Description: Early nodulin 93 ENOD93 protein

SEQ ID NO: 39809 - DNA, 661 bp, Panicum virgatum
  misc_feature: Ceres CLONE 1999661
  misc_feature: Encodes the peptide sequence at SEQ ID NO. 39810
acagccgctcggacagcacgcagggccgcagccagccacaggctcccgtcgcattcgctcgctcgctcgctcgcgtcgtcgctcccgcctccgccgatccgcgcacgcagatcgccgaagcccggcggcgcaggggcgaaggggagcgaggggagggagggagctcgcgcggcggcggaggaggaaggcgttcgccaccttctcgaggaagagatggggctctcgttcgggaagctgttcagccgcctcttcgccaagaaggagatgaggatcctcatggtcggccttgatgccgccggtaagaccaccatcctctacaagctcaagctcggcgagatcgtcaccaccatccccaccatcggattcaatgttgaaactgtagagtacaagaacattagcttcactgtttgggatgttggtggccaggacaagatcaggcccctgtggaggcactacttccagaacacgcagggtctcatttttgttgtggacagcaatgacagggagcgtgttgttgaggctagggatgagctccacaggatgctgaatgaggatgagctgcgtgatgctgtgctgcttgtgtttgcaaacaaacaagatcttcctaatgctatgaatgctgctgaaattactgacaagcttgggctgcattccctgcgcc

SEQ ID NO: 39810 - protein, 149 aa, Panicum virgatum
  misc_feature: Ceres CLONE 1999661
  misc_feature (1)..(149): Pfam Name: Arf Pfam Description: ADP-ribosylation factor family
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with altered terpenoid content
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLR

SEQ ID NO: 39811 - DNA, 825 bp, Panicum virgatum
  misc_feature: Ceres CLONE 1999668
  misc_feature: Encodes the peptide sequence at SEQ ID NO. 39812
aaacgcccatcagccatcccctcctgctgcaatcttcctctgaattgtgggtctgcggcaatggcggcgctcgctccatcgaagatcctcggcacccagctcaactttgccggctccttccggtacgccaccactacaccgaccgctggggcgcagaagattgtctccctcttcaaaaagaagcctgcccagaagcccaagcccgccgccgtatcatcctcatccccggacatcagcgatgagctcgctaagtggtatggccctgacaggaggatcttcctgccggatggtctcttggaccgctcggaggtgccggagtacctcacgggagaggtcgctggagactatggctacgatccttttggtctaggcaagaagccaggggacttcgccgagtactaccggatcatcaacggcctggacctggaggacaagctgcaccccggcggcccgttcgaccccttgggcctggccagcgaccccgaccaggctgccatcctcaaggtgaaggagatcaagaacggccggctggccatgttctccatgctcgccttcttcatccaggcgtacgtcaccggcgaaggccccgtcgagaacctcgccaagcacctcagcgaccccttcggcaacaacctcctcaccgtcatctccggcgccgccgagaggacgcccagcctgtgagcaatgctggctgctgctgcgtttgattttaccgggaaacagagtgtgcgtgagggtctgaactctgaagaatgtgccatgcgtgtaaattatcaagatggggaagaaaccatttcgttctgatctctgatgtgactgctgctt

SEQ ID NO: 39812 - protein, 206 aa, Panicum virgatum
  misc_feature: Ceres CLONE 1999668
  misc_feature (83)..(170): Pfam Name: Chloroa_b-bind Pfam Description: Chlorophyll A-B binding protein
MAALAPSKILGTQLNFAGSFRYATTTPTAGAQKIVSLFKKKPAQKPKPAAVSSSSPDISDELAKWYGPDRRIFLPDGLLDRSEVPEYLTGEVAGDYGYDPFGLGKKPGDFAEYYRIINGLDLEDKLHPGGPFDPLGLASDPDQAAILKVKEIKNGRLAMFSMLAFFIQAYVTGEGPVENLAKHLSDPFGNNLLTVISGAAERTPSL

SEQ ID NO: 39813 - DNA, 676 bp, Panicum virgatum
  misc_feature: Ceres CLONE 1999676
  misc_feature: Encodes the peptide sequence at SEQ ID NO. 39814
attcgccgcctgccgcacccgcgcgccgtctcctcctccccgtttcagccgcctcctcggatggaggccacctacaagttcgggccctacaagatcgacgccagggaggtcttccacgccacgcccctctcatacgccatggtcaacctccgccccctcctccctggtcatgttcttgtgtgccccaagtgtgaagtgaaaagatttgccgatctaagttctgatgagacaagtgacctatgggttactgcaaaggaagttggtgtacgtcttgagcagtatcataaagcatcttcacttacctttgctattcaggatggtcctcatgctggccaaacagttccacatgtccacattcatgtcatcccgaggaagaaaggggattttgagaaaaatgatgaaatatatgatgcgattgatgtgaaagagaaagaattgaaggagaagcttgacctggacgttgagaggaaagatagaagcatggaagaaatggctcatgaggccaatgagtaccgtgctcttttctcctagaattaactcttagtatagtggttagtttctaagttgagctgactcttttctataaataagccttgctgcttcttgttctccattgttgcaatccagatatcatttaactgctatggtgttggactgatgttcagtggtctgaaac

SEQ ID NO: 39814 - protein, 156 aa, Panicum virgatum
  misc_feature: Ceres CLONE 1999676
  misc_feature (14)..(107): Pfam Name: HIT Pfam Description: HIT domain
  misc_feature: SWISSPROT Homolog: EC 3.6.1.29 Bis(5'-adenosyl)-triphosphatase
  misc_feature: Useful for making plants with modulated heat sensitivity
MEATYKFGPYKIDAREVFHATPLSYAMVNLRPLLPGHVLVCPKCEVKRFADLSSDETSDLWVTAKEVGVRLEQYHKASSLTFAIQDGPHAGQTVPHVHIHVIPRKKGDFEKNDEIYDAIDVKEKELKEKLDLDVERKDRSMEEMAHEANEYRALFS

SEQ ID NO: 39815 - DNA, 552 bp, Panicum virgatum
  misc_feature: Ceres CLONE 1999691
  misc_feature: Encodes the peptide sequence at SEQ ID NO. 39816
aaaccacactcccactctccgtctcccccacccaggcagacagactcgcacaagagagtagcagaagagttgaggctcccggcctccaactccaagcaagctactgctagatctatggcggattggggccccgtggtggtgggcgtggtgctgttcgtgctgctgtcgccgggcctgctgtgcgagctcccgggctcccaccgccacgtcgacttcggcggcttccacaccaacggcaaggccatcttcgtccacaccctcatcttcttcgccgccttcaccatcctcacgctcgcgctccacgtccacatctacaccggctagtctgctctgggcctcctggctcctcgatctggacacggggatccagtccagatcgggacaagccatggcgccgccgccgctgcttgtctgctcatcctcgactgaacacaagtgaaagtgcgtgtatgctactgctagctatgcgagacatcgtctgtaattcgattctgtaggcggaacacctagctggttgcacttcaatcgacccaatcgaggagctattcaggc

SEQ ID NO: 39816 - protein, 69 aa, Panicum virgatum
  misc_feature: Ceres CLONE 1999691
  misc_feature: Useful for making plants with altered cell wall content and/or composition
MADWGPVVVGVVLFVLLSPGLLCELPGSHRHVDFGGFHTNGKAIFVHTLIFFAAFTILTLALHVHIYTG

SEQ ID NO: 39817 - DNA, 455 bp, Panicum virgatum
  misc_feature: Ceres CLONE 1999706
  misc_feature: Encodes the peptide sequence at SEQ ID NO. 39818
attagaccacaggccagggggaagaaagggatgagcatactccttcctcctcttggtaggttcttcacagcccgccctccgcgccggattcgccccgatccagatccgatgtgggcttcatggactgaaaacgtatccttggtgaattaaaggacttgcgaagggacgctgctacatgatgaattgcacgtcctggtggtgaggatatgatccactggcatgcaaccatcatgggtcgacgggatagtccttactctggaggtgttttcttactgaacatttatttaactccggactacccataaaagcctgcaaatggatcatttaatacgaaggtgttccatcggaatatctgtagatgtgggaacatatgtctagacattcctagtgaacactggaaacctgctttgacaatatctaaagctttggattgtatcagctccctgatcactgat

SEQ ID NO: 39818 - protein, 32 aa, Panicum virgatum
  misc_feature: Ceres CLONE 1999706
  misc_feature: SWISSPROT Homolog: EC 6.3.2.19 Ubiquitin--protein ligase
  misc_feature: Useful for biocontainment applications
  misc_feature: Useful for making plants with modulated light quality sensitivity
  misc_feature: Useful for making plants with modulated low light sensitivity
MIHWHATIMGRRDSPYSGGVFLLNIYLTPDYP

SEQ ID NO: 39819 - DNA, 664 bp, Panicum virgatum
  misc_feature: Ceres CLONE 1999723
  misc_feature: Encodes the peptide sequence at SEQ ID NO. 39820
cttagccgcgcggacgctctccaccacccgagccttcccgctgtcgccgcctcgctccgcgcgaccgatctgccgccgccgccgccgccgccgccgccatgtcgctgatcgcgggtgaggacttccagcacatcctgcgtctgctgaacaccaacgtggatgggaagcagaagatcatgttcgcgatgacctccatcaagggtatcggccgccgcttctctaacatcgtctgcaagaaggccgacatcgacatgaacaagagggccggcgagctgacgcctgacgagctggagaggctgatgacggtggtggcgaaccccaggcagttcaaggtgccggactggttcctcaacaggaagaaggactacaaggacggcaggttctcgcaggtcgtctccaacgccctcgacatgaagctcagggacgacctcgagagactcaagaagatcaggaaccaccgtggtctgcgtcactactggggcctccgtgtccgtggccagcataccaagactactggcaggcgtggaaagaccgttggtgtctctaagaagcgataagctatatatctaccaatcttggccttattactgtgttggttcgtgtccaaacagtcttgatgaagcgtttctgtttagacagttccctgaaatgatgttttgcccta

SEQ ID NO: 39820 - protein, 152 aa, Panicum virgatum; identical to SEQ ID NO: 9992
  misc_feature: Ceres CLONE 1999723
  misc_feature (14)..(142): Pfam Name: Ribosomal_S13 Pfam Description: Ribosomal protein S13/S18

SEQ ID NO: 39821 - DNA, 674 bp, Panicum virgatum
  misc_feature: Ceres CLONE 1999724
  misc_feature: Encodes the peptide sequence at SEQ ID NO. 39822
gcaactcgtcttcgctctctcactactgtcactggctcactgccactcaccctcttccatcagacttgcgttccagttaagaacaactttggtatatatggcgtcccttgaccagaagcttgccctcgccaagcgatgctcgcgagaggcgaccctcgcaggagcaaaggcggcagctgtagcgacaatcgcctccgccatccccaccctggcgagcgtgcggatgctgccatgggcgaaagcgaacatcaaccccaccggacaagccctcatcatctccaccgtcgccgggatggcctacttcatcgccgccgacaagaagatcctgtcgctggcgagaaagcactccttcgaggccgccccggagcacctcaagaacacctccttccagggcgccggccgtccccacccggcgttcttcaggccataaaatgtagggtatacacagctgctgtgcaactaatttagttttaccttcgtatctatacgtgtttcgtgcaataagtaagcacgccgcggcgcactgcagagatctggggtagcttttgcttaccttctgctgcacagtggcgttagtcgtctacctgctgctgcccaccctgaagaatttgtatactctcttgctgtactgttatcacttgcatcgagtaattaatgacaaaattatgtggagc

SEQ ID NO: 39822 - protein, 110 aa, Panicum virgatum
  misc_feature: Ceres CLONE 1999724
  misc_feature (6)..(84): Pfam Name: ENOD93 Pfam Description: Early nodulin 93 ENOD93 protein
MASLDQKLALAKRCSREATLAGAKAAAVATIASAIPTLASVRMLPWAKANINPTGQALIISTVAGMAYFIAADKKILSLARKHSFEAAPEHLKNTSFQGAGRPHPAFFRP

SEQ ID NO: 39823 - DNA, 620 bp, Panicum virgatum
  misc_feature: Ceres CLONE 1999730
  misc_feature: Encodes the peptide sequence at SEQ ID NO. 39824
agggcgattatgtaacttagcaagggttggagtggggaaaccctttttcttaagcaaaaaaacaaggggagaagcatatagctcacgcggaacacgggagcggcggaagcaaacaactgaaattccccagtccggttccttccgtgcgatttgatctcgtcggaggcgcggccgcggttacccccaacccgccatcgaattcgatggcggccaacgccggcaacaagatccgcaacgccaagctggttcttcttggagatgtgggcgctggcaaatctagtttggttcttcggtttgtgaaaggacagtttgttgaattccaggaatcaacgattggagcagctttcttctctcagaccttggcggtcaatgatgagactgttaagtttgaaatctgggatactgctgggcaagagaggtaccatagcttggcacccatgtactataggggtgctgctgccgccatcgttgtctacgacattacgaatccggcctccttcactcgtgcgaagaaatgggtccaagaacttcaagctcaaggaaacccgaatacaatagtggctcttgctggcaaacaaagctgatatgctagatgcaaggcaagtgccagcagaggaagc

SEQ ID NO: 39824 - protein, 126 aa, Panicum virgatum
  misc_feature: Ceres CLONE 1999730
  misc_feature (13)..(126): Pfam Name: Ras Pfam Description: Ras family
  misc_feature: SWISSPROT Homolog: EC 2.7.11.1 Non-specific serine/threonine protein kinase
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNPNTIVALAGKQS

SEQ ID NO: 39825 - DNA, 707 bp, Panicum virgatum
  misc_feature: Ceres CLONE 1999734
  misc_feature: Encodes the peptide sequence at SEQ ID NO. 39826
aacgaaaattccccgaccctcacacgcgcagcccatcccacctcgccgccccgaccctcgcccccgctccgcgaggcgcccagacgccgccgcccgccgcccccgccagaccgggacggcggctgctgcggcggcaggatggggatggactactacaaggtgctgcaggtggagcgcggcgcctccgatgacgagctcaagaaggcgtaccggaagctcgccatgaagtggcacccggacaagaaccccaacaacaagaaggaagccgaggccaagttcaagcagatctcagaggcctacgaggttcgcccgctctctctcctggcccccattgcgcctctgatctgtgccggtgctcgtagctgctcgccgcggaagagaatggtgttcgattgagggttgaggatgcgcttccccatttcctcttaatacggatcggatagctgtagtttatgacggtgtgctcgccattggggcaaccaaggctcttttgtgcgagaaggatctaatttccgcatcccgagtgagctctggcctctcgtgcctttcgatctgatgcaaagattcgcgttttgcgttgtttgtggaatcagacaacagcactctagtttggatacaatgacatcattttgatgctgacattcgtaggccatttccagagcctgtaagttagtgccatttctctagaatgttgccacttattattc

SEQ ID NO: 39826 - protein, 85 aa, Panicum virgatum
  misc_feature: Ceres CLONE 1999734
  misc_feature (4)..(61): Pfam Name: DnaJ Pfam Description: DnaJ domain
MGMDYYKVLQVERGASDDELKKAYRKLAMKWHPDKNPNNKKEAEAKFKQISEAYEVRPLSLLAPIAPLICAGARSCSPRKRMVFD

SEQ ID NO: 39827 - DNA, 815 bp, Panicum virgatum
  misc_feature: Ceres CLONE 1999735
  misc_feature: Encodes the peptide sequence at SEQ ID NO. 39828
agccaagcccccccgagccctatccttttcccctcccctgcgtctccccacccccaactcctatcctctcctcccctcacccgcgccgccgcagcagcgccgccgccgccgcggcttcccttcctcacccgagtcaagatgaatgttgacaagctcaagaagatggcaggtgccgtgcgcaccggtggaaagggtagcatgcgcaggaagaagaaggcagtccacaagactacaaccacagatgacaaaaggcttcagagcaccctgaaaagagtaggagtgaacactatccctggtattgaagaggtcaacatcttcaaggatgatgttgttattcagtttgtgaatcctaaagtgcaagcttctattggtgctaatacatgggtggtcagtggaactccacagacaaagaagctgcaagatctgcttccgtcgattatcaatcagcttggtcctgacaacttggacaacctgcggaggcttgcggagcaatttcagaagcaggttcctggagcttcaagcgctgaggctggtgctagcacaggtgctgctcaggatgacgatgatgacgttcctgagcttgtccctggagagacatttgaggaggctgctgaagagaaaaaggagtcgtcataattttgctgcgtgcctgctgttgtgaagggtttataagtcaagcattgccattagaaaagacatcctgttgagacctctgacctaccttatttgtgcctgtggtccggttctgtcatgtacgagaatctggtcggatgtgttggtgggatttcacatgaagtatgcctctttttgatacc

SEQ ID NO: 39828 - protein, 165 aa, Panicum virgatum
  misc_feature: Ceres CLONE 1999735
  misc_feature (34)..(92): Pfam Name: NAC Pfam Description: NAC domain
  misc_feature: Useful for making plants with modulated biomass
  misc_feature: The sequence is a functional homolog of SEQ ID NO 1617 in the 11/479,226 US patent application
  misc_feature: The sequence is a functional homolog of SEQ ID NO 786 in the 10/412,699 US patent application
  misc_feature: The sequence is a functional homolog of SEQ ID NO 1614 in the 11/479,226 US patent application
  misc_feature: The sequence is a functional homolog of SEQ ID NO 784 in the 10/412,699 US patent application
MNVDKLKKMAGAVRTGGKGSMRRKKKAVHKTTTTDDKRLQSTLKRVGVNTIPGIEEVNIFKDDVVIQFVNPKVQASIGANTWVVSGTPQTKKLQDLLPSIINQLGPDNLDNLRRLAEQFQKQVPGASSAEAGASTGAAQDDDDDVPELVPGETFEEAAEEKKESS

SEQ ID NO: 39829 - DNA, 589 bp, Panicum virgatum
  misc_feature: Ceres CLONE 1999738
  misc_feature: Encodes the peptide sequence at SEQ ID NO. 39830
cttcatcgaccgaaacagagtgtggagggtcagaccgacaggccatggagagctcgccgcccaccatcaccgtccaggtcaagttcgcccggcggaccatccccgtggaggtaccggccgccgcgaccaccgcggagctgaagcgcctcctccagccgctcaccaacgtcctcccccgcggccagaggcttgtctgcaaaggcaaagtgctccaggatgccgcgagcctgagctcgatgcaggtggtagacggatccaaggtcatgctcatcgcctcgctgggtctccatcagggggtacggcatcaaacttctcgatctgaaataatctgatttctgatgcttagagttgaattcgtcggagtagggtgcagtccttaagcatgtgcgaaggttcgattttggtctgtgctcactgctcaggattcctagctgggactgggagcggatctgaagtttttagttgtttttctcgagcatgaagttattagatgttaaacttgtatagtactataatgtgtcacagaccaaagataactgcctttatttcaacattttgatgcctttgctgttaaatgttggggattcat

SEQ ID NO: 39830 - protein, 95 aa, Panicum virgatum
  misc_feature: Ceres CLONE 1999738
  misc_feature (11)..(80): Pfam Name: ubiquitin Pfam Description: Ubiquitin family
  misc_feature: SWISSPROT Homolog: EC 3.1.2.15 Ubiquitin thiolesterase
MESSPPTITVQVKFARRTIPVEVPAAATTAELKRLLQPLTNVLPRGQRLVCKGKVLQDAASLSSMQVVDGSKVMLIASLGLHQGVRHQTSRSEII

SEQ ID NO: 39831 - DNA, 595 bp, Panicum virgatum
  misc_feature: Ceres CLONE 1999749
  misc_feature: Encodes the peptide sequence at SEQ ID NO. 39832
accgcatctcacaccacgtgaacccagctcctgggctccaccgtggcgtgcctcctcctccgcttctcgaccggcggcctcgccaccggcaccttcggcctgaccggcatctccgtgtgggaggccctggtcctggagatcgtgatgaccttcgggctggtgtacacggtgtacgcgacggccgtggacccgaagaagggcagcctgggcaccatcgcccccatcgccatcggcttcatcgtgggcgccaacatcctggtcggcggcgccttcgacggcgcgtcgatgaaccccgccgtgtccttcggccccgccctcgtgagctggtcctggacccaccagtgggtgtactgggtcggccccctcatcggcggcggcctcgccggcgtcatctacgaggtgctcttcatctcccacacccacgagcagctccccaccaccgactactgagctgagggctgaggcttcggtagccgccgccgccgccgccaccgaagacgttcgcgcgcagccgccggttcctccgtccgtttgatcagttccgcctcgccgccgtttgagttagtttttttccctcgcaccgcgtgctgcttgg

SEQ ID NO: 39832 - protein, 101 aa, Panicum virgatum; identical to SEQ ID NO: 35806
  misc_feature: Ceres CLONE 1999749
  misc_feature (1)..(84): Pfam Name: MIP Pfam Description: Major intrinsic protein

SEQ ID NO: 39833 - DNA, 700 bp, Panicum virgatum
  misc_feature: Ceres CLONE 1999762
  misc_feature: Encodes the peptide sequence at SEQ ID NO. 39834
aatcgattggattggattccccagcaaacaagcagcaaaaagcaacaagcaagcaagggaataataagctggaggagctggcggcgtctactaggagtaataagctggaggaggagcccctcggccgcctcggcgccgacccagcagctgcagagacagaggagcagcgcaacaagttcctggtgctccgcctgtacgaggcgctcaacggccgcgaccacgccgccgtgcaggccctcctcgcccccgacctcgagtggtggttccatggcccgcccaagcaccagcaccacatgatgcgcgtgctcaccggcggatcatccaacaacaacaagaagcagaatagtaatttcagcttcgtgccgcgctccgtcgacgccttgggctgcagctcccccgtgatcgccgagggacagggacctgcaggtgtgtactgggtgcacgcctggaccgtgggcccggatgggctcatcacccacctgcgggagtacttcaacaccgacctcaccgtcacccgcctcgccgccgccaccaagtgcaagtgcgtctggcagagccgccgacccgacagggcaacaaactcgctgccaggcctcgtcctcgtcctcgccctctagtctttctttccttcttggcggcttggcccatccctcatcttctagcgtttatttgttattacgcctgccatcatcacctacct

SEQ ID NO: 39834 - protein, 204 aa, Panicum virgatum
  misc_feature: Ceres CLONE 1999762
  misc_feature (99)..(202): Pfam Name: WI12 Pfam Description: Wound-induced protein WI12
SIGLDSPANKQQKATSKQGNNKLEELAASTRSNKLEEEPLGRLGADPAAAETEEQRNKFLVLRLYEALNGRDHAAVQALLAPDLEWWFHGPPKHQHHMMRVLTGGSSNNNKKQNSNFSFVPRSVDALGCSSPVIAEGQGPAGVYWVHAWTVGPDGLITHLREYFNTDLTVTRLAAATKCKCVWQSRRPDRATNSLPGLVLVLAL

SEQ ID NO: 39835 - DNA, 677 bp, Panicum virgatum
  misc_feature: Ceres CLONE 1999786
  misc_feature: Encodes the peptide sequence at SEQ ID NO. 39836
actgtacaaatcctgcgattcctcttcgcatcccgtattcccgtgcgccagagccagcgcctgcgcgacgcagccttgacctccccgacggcctccgcctccgtctcgaagcgcggcgcaggagaattttggcccagggcgtagggttctgctatggccagcgacaaggtgtttgagttcgaggaggtcgctaagcacaacgtcaccaaggactgctggatcgtcatcgacggcaaggtttatgatgtcacaccctttatggatgagcatcctgggggagatgaggttttgctagctgtaactgggaaagatgctactgctgattttgaagatattggccacagcgattcggcaagggagatgatggagaagtaccatatcgggcagattgatgcttcaaccatcccagtaaagcgtacttatgtgaatccccagcaagctcccagccacgtggacaaggataacgacttcctcatcaaaatcttgcagtttctcgttcccattctgatcctgggccttgcgtttggtatccggcagtacaccaaatcggagtagctcagctcgtagaggttcacctatgtgaaatgatttggatgaaaatagtgcaataattgtgtatttgtttggtagaagaatgctagaggttcacctatgtgaaatgatttggatgaaaatag

SEQ ID NO: 39836 - protein, 133 aa, Panicum virgatum; identical to SEQ ID NO: 18789
  misc_feature: Ceres CLONE 1999786
  misc_feature: SWISSPROT Homolog: EC 1.7.1.1 Nitrate reductase (NADH)

SEQ ID NO: 39837 - DNA, 587 bp, Panicum virgatum
  misc_feature: Ceres CLONE 1999806
  misc_feature: Encodes the peptide sequence at SEQ ID NO. 39838
aaaaaaaaaaaaacacctcagtgacctcaccctctctcactcactcactctctccatccagcgcgagagggggcagcaggtcggcagcagagcgagagcgcgcgtgccagcccatggcgagcaccaacatggcgtcggccacctcgcggttcatgctggccgcgggcgtgcccgcggcggcgggcagcggcggccgcgtcggcttcgcgtcgccgcccggcagggtgcagggcaggaggctcgtggcgcgcgccgaggaggaggccgcgcccgcggcggaaggggagggcgccgtggccaccaagcccaaggccgagaagccgccgccgatcgggcccaagaggggcgccaaggtgaagatcctgaggagggagtcctactggtacaacgggattggcaacgtcgtcacagttgatcaggaccccaacacccgctacccggtggtggtgcggttcaacaaggtgaactacgccggcgtgtccaccaacaactacgccttggacgagatccaggaggtgaaaggaaaatgagccaggctgcctcaagggccgccgtgcccccgtgttgtcactgtagcctgtgaaacg

SEQ ID NO: 39838 - protein, 138 aa, Panicum virgatum; identical to SEQ ID NO: 12737
  misc_feature: Ceres CLONE 1999806
  misc_feature (75)..(136): Pfam Name: PSI_PsaE Pfam Description: Photosystem I reaction centre subunit IV / PsaE

SEQ ID NO: 39839 - DNA, 586 bp, Panicum virgatum
  misc_feature: Ceres CLONE 1999819
  misc_feature: Encodes the peptide sequence at SEQ ID NO. 39840
atactctcgaaaacctcacaaaaccctcgctccccaccacccgccgccgcccgcgccgccgcctccacctgccgcgacaaagatgagtcggcaccctgaagtgaagtgggctcagaggattgacaaggtttacatcacagtacagttatctgatgcaaaggatgctaaggtcaatttggagccagatggtgtcttcacattctctggcagtgctggtacaaacttgtatgaattgaaactagatctgaatgacaaagtcaacgtggaggctagcaagataagtgtgggtgacaggtccatattctgtgtcgtagaaaaagctgaagccaaatggtggaagaagcttgttcgggatgatcaaaaggcacctcactttgtgaaagtcgattgggacaaatgggtggatgaagatgatgatggtggtgatgtcaacttggatgggatggacttctcgaattttggtggcatgggcggtatgggtggcatgggtgatatggctgggctgggcgggatgggtggtctgggcggcatgggtggtatgggtggtctgggcggcatgggtggtatgggaatggatgagtttgaa

SEQ ID NO: 39840 - protein, 167 aa, Panicum virgatum
  misc_feature: Ceres CLONE 1999819
  misc_feature (5)..(79): Pfam Name: CS Pfam Description: CS domain
  misc_feature: SWISSPROT Homolog: EC 5.3.99.3 Prostaglandin-E synthase
MSRHPEVKWAQRIDKVYITVQLSDAKDAKVNLEPDGVFTFSGSAGTNLYELKLDLNDKVNVEASKISVGDRSIFCVVEKAEAKWWKKLVRDDQKAPHFVKVDWDKWVDEDDDGGDVNLDGMDFSNFGGMGGMGGMGDMAGLGGMGGLGGMGGMGGLGGMGGMGMDEF

SEQ ID NO: 39841 - DNA, 848 bp, Panicum virgatum
  misc_feature: Ceres CLONE 1999827
  misc_feature: Encodes the peptide sequence at SEQ ID NO. 39842
aaacccaccacacccatgtgccggtgtgcgcttcgccgctggcctgttgccgagatggacgagggagcgaggaggaaggcgatggagtggccgccgccgtcgacgtcgccgtcgctggtggtgcgcagccccaggcagacggtcagcctgatccgcaaccgccgtccccaccgcgactgggacaactccacgaggtccccctccttcgccgcccgcgaccacgggcccaagccgtcggaggtgtacggcttcgtcggatccatcaccaccgccatggccaccgccgtctacctcgcctgggcgtacacgcccgagcccgtcctccgctctctcggcatcacctactaccctagcaagtattgggcattggcggtgccatcgttcgtgatcgtggccgtggcgctgtccatggccatctacatgggtctcaacttcgtcgccactcctcccccgacttccttcagtacaatcttcgatgaaaatagtcgggagcgcatgacgttttctcctgcaatggaagaagagatgccgattgaacctatttcagacatcagtattgaccaaatcaacgatctcatgtttggtggtagatgatttactactacggatggaaaatggatctacctcggagcacaatactggaaacagtagcaacataaagaaagcatcctcatcagattgccttcataaccaattgaggaactccattctttactctttagggtggattttatatgtgtgaatttattgtgaaggaaccttccagcatttctctgtctagaatttcagctgcatacccctcaaaaaaaaattcagctgtatttattttttcaattcgacaagggagt

SEQ ID NO: 39842 - protein, 170 aa, Panicum virgatum
  misc_feature: Ceres CLONE 1999827
  misc_feature (50)..(168): Pfam Name: PIG-P Pfam Description: PIG-P
  misc_feature: SWISSPROT Homolog: EC 2.4.1.198 Phosphatidylinositol N-acetylglucosaminyltransferase
MEWPPPSTSPSLVVRSPRQTVSLIRNRRPHRDWDNSTRSPSFAARDHGPKPSEVYGFVGSITTAMATAVYLAWAYTPEPVLRSLGITYYPSKYWALAVPSFVIVAVALSMAIYMGLNFVATPPPTSFSTIFDENSRERMTFSPAMEEEMPIEPISDISIDQINDLMFGGR

SEQ ID NO: 39843 - DNA, 527 bp, Panicum virgatum
  misc_feature: Ceres CLONE 1999896
  misc_feature: Encodes the peptide sequence at SEQ ID NO. 39844
ggcttccaaagttccaacttccaacacgcctcgatccagatccgggcattcccttccggtctccccccgagactattcatattccattcgcccgcagcggaagaggcgcttgccgccgccgcctcgtcctcgactccctcctcgtcctcgctcgtccgccgcttggagtgcgctcctccgttcccagttaagtatggtagctgaaatttcaaactcccacgaaaacaaagtatgaacttgccttggccacatctgaattctgaagtagtaagagaggaggatggaagggaggaatgacttgtttgattagctagttgctgcttcgtgtcaagcaagtaaattgattgagtgcatacatcaattcagaagcgcagcatggcaaagctcaagccaaaggcgttgctggcacaaagcaaagtgaagaaggcccctagccaaatcagtgtgatcacaatcttcacctacttggtcctcggtgtcatagttgtatcctctgtttatgctgcttacaaatatttggtaggcta

SEQ ID NO: 39844 - protein, 50 aa, Panicum virgatum; identical to SEQ ID NO: 39029
  misc_feature: Ceres CLONE 1999896
  misc_feature: SWISSPROT Homolog: EC 5.2.1.8 Peptidylprolyl isomerase

SEQ ID NO: 39845 - DNA, 744 bp, Panicum virgatum
  misc_feature: Ceres CLONE 1999922
  misc_feature: Encodes the peptide sequence at SEQ ID NO. 39846
gggcccgatcgaccaactgaaccgggcagcccagcgccccagcggtctgaagactccgcgggaggggacgccgtcgccgtccggcagccactacctccgctgctctccggcgaccggctcgctccactccgcggcgaaaacatgatcgtctgcgtcgccgtcgtcggacaccagaacaacccgctgtacctgcagagcttcacggaggcggacgacgccctcaagctccaccacatcgtgcactgctccctcgacgtcatcgacgagcgagtaaacaatcctaaaaggagtgcgcctacattgaatgagacatttttgggtcttctgtacccaactgagaactacaaagtgtatggctatttgacaaacacgaaggtcaaatttatcatggtcgcgactgaccttgatgtcaaagatgcagatgccagaaattttttcaggaagttccatgctgcatatgtggatgctgtctcgaaccccttccatgtcccagggaaaaagattgcttcaagaagctttggcgctagagtaagcaccattgtgaagtccttcggttcaggaacaactggttgagttgaaaggcacttttatcagacttcctgtaatcaaacatggttctgtcccgctgattgacgatttactctacattgtgtactgtttgtatgttgaacgagattctagtgtggtactgatgaaagaaagatggttgctcattcattcaaagattgtgcttttttcttgttc

SEQ ID NO: 39846 - protein, 143 aa, Panicum virgatum
  misc_feature: Ceres CLONE 1999922
  misc_feature (7)..(136): Pfam Name: Sedlin_N Pfam Description: Sedlin, N-terminal conserved region
MIVCVAVVGHQNNPLYLQSFTEADDALKLHHIVHCSLDVIDERVNNPKRSAPTLNETFLGLLYPTENYKVYGYLTNTKVKFIMVATDLDVKDADARNFFRKFHAAYVDAVSNPFHVPGKKIASRSFGARVSTIVKSFGSGTTG

SEQ ID NO: 39847 - DNA, 671 bp, Panicum virgatum
  misc_feature: Ceres CLONE 1999925
  misc_feature: Encodes the peptide sequence at SEQ ID NO. 39848
attgaactcgcccccggttcgttccggcgcttgcccatcggactcaccgccgagacagagccccacgccatccccagacccccagcttctcactcagcgccctccgcttgtcgcgttgcggactcggcacacgccggcccgcccaggcccggatatagagcgaacagagcctctgagacaaccggccagatcgacatccaagcggttgcttggttcggcaagggagaaggatcagtccccagttggttttgtagccggccatggctgccaagaaggtggtgctgaagctggacctgcacgacaacaaggataagcagaaagtgctcaaagcggtctccactctccacggtattgactcgatctccgtggacatgaaggactctaagctgacggtgatcgggctcgtcgaccccgtcgacgtcgtggccaagctgcgcaaggtcggggccgcccacatcctctccgtcggcccggccaaggaggagaacaaggacgacaagaaggacggcgacaggaaggacggcgataagaaggccgtggtgtacccgccgccgtggtacgccgcgcagtacccctactacccccactacggcgtccgcagcgccgaggaggaccccaactcctgcgtcatctgctgatggcgacgccgacgccgatccccggcccggccg

SEQ ID NO: 39848 - protein, 125 aa, Panicum virgatum
  misc_feature: Ceres CLONE 1999925
  misc_feature (6)..(73): Pfam Name: HMA Pfam Description: Heavy-metal-associated domain
MAAKKVVLKLDLHDNKDKQKVLKAVSTLHGIDSISVDMKDSKLTVIGLVDPVDVVAKLRKVGAAHILSVGPAKEENKDDKKDGDRKDGDKKAVVYPPPWYAAQYPYYPHYGVRSAEEDPNSCVIC

SEQ ID NO: 39849 - DNA, 630 bp, Panicum virgatum
  misc_feature: Ceres CLONE 1999933
  misc_feature: Encodes the peptide sequence at SEQ ID NO. 39850
ttcagaacaatgacacaattgtccagacctaccatatcgatggatatgcgttctgggttgtaggaatggactatggtgagtggactgagaatagccgcggaacttacaacaagtgggatggtgtttctcgttgcacaactcaggtgtttcctggagcatggactgctgtgatgctgtcacttgacagcccaggtttctggaatgtgcgcacagaaaatctggacacatggtatctgggtcaggagacttacatcagggtggtggatccagatggaggctataatgttactgagatggtggcaccagataacttgctctactgtggcctcctcaaggataaacagaaggctcagaagcctcatggttcatcgagttcagctgctgcagcgaaactgaacaactatctgctcatggttttggtctctttgttagccttggcgttgggccattgacagaaattgccagcttgtgctcagctgctgtttgcagattaggagtttgacagaattgaagtaggttcgactcgatttgtgtaggctgcattcatgatttgtgtggaaatggaaatggcggatttgtgcatcttgaacgatgagaattgtgtagtagtagcaaaccaattgcatcgca

SEQ ID NO: 39850 - protein, 149 aa, Panicum virgatum
  misc_feature: Ceres CLONE 1999933
  misc_feature (1)..(92): Pfam Name: Cu-oxidase_2 Pfam Description: Multicopper oxidase
  misc_feature: SWISSPROT Homolog: EC 1.10.3.3 L-ascorbate oxidase
QNNDTIVQTYHIDGYAFWVVGMDYGEWTENSRGTYNKWDGVSRCTTQVFPGAWTAVMLSLDSPGFWNVRTENLDTWYLGQETYIRVVDPDGGYNVTEMVAPDNLLYCGLLKDKQKAQKPHGSSSSAAAAKLNNYLLMVLVSLLALALGH

SEQ ID NO: 39851 - DNA, 642 bp, Panicum virgatum
  misc_feature: Ceres CLONE 1999941
  misc_feature: Encodes the peptide sequence at SEQ ID NO. 39852
attttcgcgaccccccagcaagccctctcggccggcctcaccctcgctgcgcaccaccgagttcgaccgctcgctccaggctagggtttccggcggcgatggcgggcaagggaggtaagggtctcctggcggcgaagacgacggcggccaagagcaccgacaaggacaaggacaaggacaagaagaaggctcccgtctcccgctcctcccgcgccgggctccagttcccggtgggccgcatccaccgccagctcaagtcccgcgcctccgcgcacggccgcgtcggcgccaccgccgccgtgtactccgccgccatcctggagtacctcaccgccgaggtcctggagctggccggcaacgccagcaaggacctcaaggtgaagcgcatcaccccgcgccacctccagctcgccatccgcggggacgaggagctcgacaccctgatcaagggcaccatcgccggcgggggcgtcatcccgcacatccacaagtcgctcatcaacaagaccgccaaggagtgaggggggccggtcgaccgcccgcgtgtggatctgtgttcttgccggtccctgagcctgacgatgcagtccatgcggtttaccgtcagttatcgtgtcgtggtaatttaagggcctctgtggt

SEQ ID NO: 39852 - protein, 140 aa, Panicum virgatum; identical to SEQ ID NO: 33818
  misc_feature: Ceres CLONE 1999941
  misc_feature (35)..(109): Pfam Name: Histone Pfam Description: Core histone H2A/H2B/H3/H4
  misc_feature: SWISSPROT Homolog: EC 2.7.7.7 DNA-directed DNA polymerase

SEQ ID NO: 39853 - DNA, 649 bp, Panicum virgatum
  misc_feature: Ceres CLONE 1999952
  misc_feature: Encodes the peptide sequence at SEQ ID NO. 39854
aaccctagccagccggatgcccggatcgctgcgtcgctccgcctcctcctcggcctcccaccctcgcgcggcgccttcctcggttcttcggtccagcttgggagatgtcggactccgaggagcaccatttcgagtcgaaggccgacgccggagcgtccaagacttacccgcagcaggccggcaccatccgcaagaacggctacatcgtcatcaagggccgcccgtgcaaggtggttgaggtctccacttccaagacagggaagcacggtcacgcgaaatgccacttcgtggccattgatattttcaacggaaagaagcttgaggatattgtaccctcttcccataactgtgacgtgccccatgtcaaccgtactgactaccagctgattgacatatctgaagatggatttgtcagccttttgactgaaaatggaggcaccaaggatgatctgaggctccctactgatgaaactctgctttcccagattaaagctggattcgatgatgggaaggacctgattgttagtgtgatgtctgccatgggtgaggagcagatctgcggtctgaaggatatcggcaagaactagagcttcattgccactggtggttatttatctggccgtctatctgggaggtggtgtgttgatga

SEQ ID NO: 39854 - protein, 160 aa, Panicum virgatum; identical to SEQ ID NO: 10137
  misc_feature: Ceres CLONE 1999952
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif

SEQ ID NO: 39855 - DNA, 641 bp, Panicum virgatum
  misc_feature: Ceres CLONE 1999954
  misc_feature: Encodes the peptide sequence at SEQ ID NO. 39856
aaaaagcccaaaccactcgactcttgcacggcggcacaggcgcacagcgcggcgtcagctcctccatcccgggcgagccgagtcaaatccacagcgagaggaaatggcggcggcggcgctccgtccggcgatcctccgccgcatccgcctcaccgcctccccggcgctccccctcgccggcgcggcgtcccacccgcacgccctggcgcggtggctcgcgcggcccatgtcctcccacgacgcgcacctcacccgcgaggaggtcgtcgaccgcgtcctcgacgtcctcaagagccaccccaaggtggatccttccaaggtgactcccgaggcgcacttcgagaaggatctggggctggacagcctggacaccgtcgaggtggtgatggccatcgaggaggagttcaagctcgagatcccggacaaggaggccgacaagatcgactcgctcccgctcgccatcgagtacgtcgccaaccaccccatggccggctgagcctcagctcgccggaggtgaggtctcttggttttttttttttgtttccgagggcaaataattggccggagcggctgaggaaagcgcgtccctggcgctcgcattgcttcgcgggcggaagatgatgtccaaatggaacattaac

SEQ ID NO: 39856 - protein, 130 aa, Panicum virgatum
  misc_feature: Ceres CLONE 1999954
  misc_feature (56)..(123): Pfam Name: PP-binding Pfam Description: Phosphopantetheine attachment site
  misc_feature: SWISSPROT Homolog: EC 6.1.1.13 D-alanine--poly(phosphoribitol) ligase
MAAAALRPAILRRIRLTASPALPLAGAASHPHALARWLARPMSSHDAHLTREEVVDRVLDVLKSHPKVDPSKVTPEAHFEKDLGLDSLDTVEVVMAIEEEFKLEIPDKEADKIDSLPLAIEYVANHPMAG

SEQ ID NO: 39857 - DNA, 741 bp, Panicum virgatum
  misc_feature: Ceres CLONE 1999981
  misc_feature: Encodes the peptide sequence at SEQ ID NO. 39858
acagaagcacctatggatacgccgatggctgagagtcagacatcaggagaggattcacagcctccagctgagacaggaatcaacccttccgatctgccccaagaagaacccaagttcttctgtgcttgccggcggcctgccctgaaacggacctccggcacagctcggaatcctgggaggcgcttcttcacctgctattccgggaaagacatttgcaaagtctgggtctgggaagacctccttcagcagtatgttgagaagatggtggattacaacaaatcaacaacatgtgacatggcgatccaagaattagcaatagtcagggaggaactcaatgcaagagagaagcagatcaatgaattgaaggaaaaatgctggtcctatgaagactacatcgcggtgttggtcactgagctgaagtgtgctaaagaacgtgatgtcgcatttgaagaatcagcaaaagctagggaggaattcaaggcaagagacaagcagactaacgaattggcaaaaatagatgatcatgaagctttagttgcaacatttggtgatatggcaatttccaaagccaagtcaattaccaaggatgatggtggatcatctagctaaatcttggagctatggcatgactgtttgtgagatggctggctgctattgacctggcgactcgaggtgcctttccatggctgtttcgacatcagaactataaagttccattgttgggtcagttagcatgtgctg

SEQ ID NO: 39858 - protein, 198 aa, Panicum virgatum
  misc_feature: Ceres CLONE 1999981
  misc_feature (35)..(77): Pfam Name: zf-GRF Pfam Description: GRF zinc finger
MDTPMAESQTSGEDSQPPAETGINPSDLPQEEPKFFCACRRPALKRTSGTARNPGRRFFTCYSGKDICKVWVWEDLLQQYVEKMVDYNKSTTCDMAIQELAIVREELNAREKQINELKEKCWSYEDYIAVLVTELKCAKERDVAFEESAKAREEFKARDKQTNELAKIDDHEALVATFGDMAISKAKSITKDDGGSSS

SEQ ID NO: 39859 - DNA, 703 bp, Panicum virgatum
  misc_feature: Ceres CLONE 1999996
  misc_feature: Encodes the peptide sequence at SEQ ID NO. 39860
ttgatttgattcttggttgcaacggattcatctgggtaggtgagcatgttgtggtgggtgaaaaaactaaaacgacagaagatcagcagaaatccggtgatgatgcagagagtttcaccccactagaaacgaggaagcatatctgccggcttgccaacgccgtgcgtgtactttcagccctaggattcactttgactgttgagctgataattgagacggcggaagcaagtgtgacagcaaatgttgaggtaaacaacatgctcggggctgaattttatgttcagacggctgagagagaggctaagcgccgagtcgatctgctgagaaagaagaatggagcaaggtaagtaggtaacgccttgctgatccaggctagctgatttgcagagaacagtatttgacatgtagtagtgtctgatctgacaatatcttcaagggaaaaatacataccaagttctatgtacccctaacagagtgtcaaagatgtatggagttccgccccactctggtgcactacatgcatttgatgaggtgccagcaacgtggtgccaggctaggctggaccgctggagtctagctgatctttaatccttttgtcccaatgcgtacacgccgttcttttgatttgcatttgacgcggttatgtaatgttgtcagtaaaatgaattgtgtgtgtaaacatttccatttgaagtcatgtact

SEQ ID NO: 39860 - protein, 114 aa, Panicum virgatum
  misc_feature: Ceres CLONE 1999996
  misc_feature: Useful for making plants with altered lignin content
DLILGCNGFIWVGEHVVVGEKTKTTEDQQKSGDDAESFTPLETRKHICRLANAVRVLSALGFTLTVELIIETAEASVTANVEVNNMLGAEFYVQTAEREAKRRVDLLRKKNGAR

SEQ ID NO: 39861 - DNA, 633 bp, Panicum virgatum
  misc_feature: Ceres CLONE 2000009
  misc_feature: Encodes the peptide sequence at SEQ ID NO. 39862
gcgcatcgatgattgagtggggtggtgaggtggtgaattcagagccggatggcacgcacacgtcgacgcagatgggcagcgggcacttccccgaggaagggttcggcaaggcgagctacttcaagaacattcaggtggtggacagcagcaatcagctgagcgccccaaagggggtgggtaccttcaccgagcagtccaactgctacgacgtgcagaacggtaacaatggtgactggggcacctatttctactacggtggccctggcaagaattcaaattgcccatgactactttctagtgtgtagtagaagtgctgtcaccatggaaaaatgtaaccaagcattcaagtgtgcaatacatctttgatctgcatcttattcagtcctgggtagtgtgtaacatgtgtatgtgccctagagcctagagttttttttttcttccttttttcatctttattttttcatgtgccatgtaaagtttctgaagagaagaagcatggcttgaggtggtggtgctgggctggtgagtgacctctacggatttttgcaagtctgcttattggtcatcttccccaagtattttgaaagtgtgctatagcttattggctgatggtaatggtattaagctcattgt

SEQ ID NO: 39862 - protein, 94 aa, Panicum virgatum
  misc_feature: Ceres CLONE 2000009
  misc_feature: Useful for biocontainment applications
ASMIEWGGEVVNSEPDGTHTSTQMGSGHFPEEGFGKASYFKNIQVVDSSNQLSAPKGVGTFTEQSNCYDVQNGNNGDWGTYFYYGGPGKNSNCP

SEQ ID NO: 39863 - DNA, 716 bp, Panicum virgatum
  misc_feature: Ceres CLONE 2000015
  misc_feature: Encodes the peptide sequence at SEQ ID NO. 39864
aaaaaggaggaggtcccggagcttgccccctttgatccaacaaagaagaagaaaaagaagaaggttgtcatccaagacccttctgatgaagtggacaagctggctgacaagacagaaagcttggcagtcactgaacctgctgaactcaacttcactgggatgaagaagaagaagaagaagcaggtggatcttgattcatctcttgctgaccttggagatggggacgacgcccaagatgatcaagctgacgaggaacaaggggaaggcattgtacttggaggtggcccaagatacccttgggagggaactgatagggattacaaatatgaagagctcctggacagagtgttcagcattcttcgtgagaacaacccagatcttgctggggacaggcgtagaacagttatgaggccacctcaggttcttagggagggaacaaagaagacggtttttgttaattttatggacttgtgtaaaacgatgcataggcaacctgagcatgtgatgaactttttgctcgctgaaatgggaacaagtggatcacttgatgggcagcaaaggttggtgatcaaaggaagatttgctcccaaaaacttcgaagcaatcctgaggagatacattaacgagtatgtcatctgcaatggttgcaagagccctgataccattctatccaaggagaatcgtctattcttccttcgttgcgagcagtgtggatc

SEQ ID NO: 39864 - protein, 238 aa, Panicum virgatum
  misc_feature: Ceres CLONE 2000015
  misc_feature (115)..(238): Pfam Name: eIF-5_eIF-2B Pfam Description: Domain found in IF2B/IF5
KKEEVPELAPFDPTKKKKKKKVVIQDPSDEVDKLADKTESLAVTEPAELNFTGMKKKKKKQVDLDSSLADLGDGDDAQDDQADEEQGEGIVLGGGPRYPWEGTDRDYKYEELLDRVFSILRENNPDLAGDRRRTVMRPPQVLREGTKKTVFVNFMDLCKTMHRQPEHVMNFLLAEMGTSGSLDGQQRLVIKGRFAPKNFEAILRRYINEYVICNGCKSPDTILSKENRLFFLRCEQCG

SEQ ID NO: 39865 - DNA, 993 bp, Panicum virgatum
  misc_feature: Ceres CLONE 2000017
  misc_feature: Encodes the peptide sequence at SEQ ID NO. 39866
gtgctaacctagcatgctgcctttctagctgaaaacttttcctgttcatcttcctcctcctctcttcctcgttgctgcttgccgggagtcccaaaggcgaagcgagccggcggcggtgacgaccgatcagaaggaatgtcggtccagatcgcgccagcggcggatcatgtgtgctatgtgcactgcaacttctgcaacacagttctcgcggtgagtgtcccagggaatagcatgctcaacatcgtgacagtccggtgtggacactgcgcaaatctattgtcagtgaacctgagagcactgatgcactcactcccagagcaacaagatcagctacagttgttcgattcccaggagaacatcaaggcccatggcatcaatggcagtcatttggagtttggctcttcgtcctcgaagttccgactgcctatgatgtactcgccacaaaacgaacacctcctgctgcaggaacagacgctaagtgctcgtcctccggagaagaggcaacgggtcccatcagcgtacaacagattcatcaaggaagagatccgcaggataaaagcaaacaaccctgacattagccacagggaagccttcagcacagcagccaagaactgggcacattatccaaatatccattttgggctaagccccggaagggagggtggcaagaagctggtcgacgaggctgtctcagcgtctccggcgcctaagaagatccaaggtctctactgatagatatccgagtgtccatcaactgcatggatgcaagaatcaataccacaaattaaaatatactgtgagtaaagaattaagaggaagaggggaaaataagttactacttattaatgggtgaaaaaaaacttgtcaagagatacgtaagtacatagtagcgagtgataaagtggtgggatcgaggtgaaatgtacaatcacatgaattgctattaggcgcttcgttgaactaagacgacttaataaatcatttcaccatatt

SEQ ID NO: 39866 - protein, 198 aa, Panicum virgatum
  misc_feature: Ceres CLONE 2000017
  misc_feature (3)..(170): Pfam Name: YABBY Pfam Description: YABBY protein
  misc_feature: The sequence is a functional homolog of SEQ ID NO 1506 in the 10/666,642 US patent application
  misc_feature: The sequence is a functional homolog of SEQ ID NO 420 in the 10/666,642 US patent application
  misc_feature: The sequence is a functional homolog of SEQ ID NO 414 in the 10/666,642 US patent application
  misc_feature: The sequence is a functional homolog of SEQ ID NO 888 in the 11/435,388 US patent application
MSVQIAPAADHVCYVHCNFCNTVLAVSVPGNSMLNIVTVRCGHCANLLSVNLRALMHSLPEQQDQLQLFDSQENIKAHGINGSHLEFGSSSSKFRLPMMYSPQNEHLLLQEQTLSARPPEKRQRVPSAYNRFIKEEIRRIKANNPDISHREAFSTAAKNWAHYPNIHFGLSPGREGGKKLVDEAVSASPAPKKIQGLY

SEQ ID NO: 39867 - DNA, 786 bp, Panicum virgatum
  misc_feature: Ceres CLONE 2000019
  misc_feature: Encodes the peptide sequence at SEQ ID NO. 39868
gagttcgaatcaaaaaaaaaaaaacccgccgccgggagggacagcgcgaggcccgccgtcgggcgcgatggctcgcaccaagcacgcggccgtgaggaaatccaaggagcaggcgaagaagaagctccagttcgggcgctccccgaaccggagggcgacgccgacaggtggagcgagcacatcggcgactccggcaagggctgcagggaccggggagagggcggcggctggaggtacggcagggcggcagcagcagagggtgaagaaaccgcaccgttggaggccagggactgtagcgctgcgggagatcaggaagtaccagaaatccaccgagttgcttatcccctttgcaccatttgcccgtctggtgagggagatcactgacttctactcaagggggaatgtaacacgctggaccccggaagctctccttgcgatacaagaggcagcagaattccacctgatagatctgttcgaagtggcaaatctttgtgccatccacgccaaacgtgttactataatgcaaaaggacatgcagcttgcaaggcgtatcggtggaaggcattggtgaatggtgatagactaatcatatgtgtttttggaccgtactacctacagcttgcaatcatgtgtttgtggaccctactacctgatgtaggacatgaaatatgtgtcgttggccttagcatcttcatgtagatgtatcttaatccagtagtgtcattgaatgttacatatttcaggtagcgttccaagtattcagactgacgtatcgtccatgtgcct

SEQ ID NO: 39868 - protein, 167 aa, Panicum virgatum
  misc_feature: Ceres CLONE 2000019
  misc_feature (87)..(163): Pfam Name: Histone Pfam Description: Core histone H2A/H2B/H3/H4
MARTKHAAVRKSKEQAKKKLQFGRSPNRRATPTGGASTSATPARAAGTGERAAAGGTAGRQQQRVKKPHRWRPGTVALREIRKYQKSTELLIPFAPFARLVREITDFYSRGNVTRWTPEALLAIQEAAEFHLIDLFEVANLCAIHAKRVTIMQKDMQLARRIGGRHW

SEQ ID NO: 39869 - DNA, 723 bp, Panicum virgatum
  misc_feature: Ceres CLONE 2000026
  misc_feature: Encodes the peptide sequence at SEQ ID NO. 39870
aggccgcggcgtcggcggtgggcttcttccagctggtgaaccacggcgtgcccggcgagctcctgtccgagacgctggcgtcggtgaggcggttccacgaggcgcccgcggcggcgaagcggccctactacacacgcgaccccgggcgccggctgcggttcaactccaacttcgacctgttccagtcgccggcggccaactggcgcgacaccctcttctgcgcggcggccccggacccgccgcccccggacgagctgccgcccgccgtccggggcgtgctgctcgagtacggcgccgcggcgcgggcggtggcggcgcgggtgctggcgctgctgtcggaggccctgggcctggagcgcggccgcctcgccgggatcgggtgcgcggaggggatcagcgtcgtgtgcaactactacccgccgtgcccggagccggagctcacgctggggtgcagcgcgcactcggaccccagcttcctgaccgtgctgctgcagggcgcgcacgacggcggcggcctgcaggcgcgcctcggcgggcggtgggtggacgtgccaccggtgcccggcgctctcgtcgtgaacgttggcgacctcctccagctcgtcagcaacggccggttcaggagcgtcgagcaccgggtgctggccaaccggagccgggacacggcgagggtgtccgtggcgtgctttctgcacgccgacatcgcccggtccacgaggctgt

SEQ ID NO: 39870 - protein, 240 aa, Panicum virgatum
  misc_feature: Ceres CLONE 2000026
  misc_feature (129)..(232): Pfam Name: 2OG-FeII_Oxy Pfam Description: 2OG-Fe(II) oxygenase superfamily
  misc_feature: SWISSPROT Homolog: EC 1.14.11.20 Desacetoxyvindoline 4-hydroxylase
AAASAVGFFQLVNHGVPGELLSETLASVRRFHEAPAAAKRPYYTRDPGRRLRFNSNFDLFQSPAANWRDTLFCAAAPDPPPPDELPPAVRGVLLEYGAAARAVAARVLALLSEALGLERGRLAGIGCAEGISVVCNYYPPCPEPELTLGCSAHSDPSFLTVLLQGAHDGGGLQARLGGRWVDVPPVPGALVVNVGDLLQLVSNGRFRSVEHRVLANRSRDTARVSVACFLHADIARSTRL

SEQ ID NO: 39871 - DNA, 744 bp, Panicum virgatum
  misc_feature: Ceres CLONE 2000027
  misc_feature: Encodes the peptide sequence at SEQ ID NO. 39872
acccatcgcatcttctccactgccaccgcctcctccaccaccagtgacgggacaggaaaccgcaaggatccaaacgcctttccgctccgccgctaaccgcccagtcgtagtagcagtcgagggaggaggggaactatgggcgccgtggcggagtgcgaccggatcaggggcccctggagccccgaggaggacgacgcgctgcggcggctcgtggagcggcacggcgcgcgcaactggacggcgatcgggcgcgagatccccggccggtcgggcaagtcgtgccgcctgcggtggtgcaaccagctgtcgccgcaggtggagcgccggcccttcacggcggaggaggacgccgccatcgtccgcgcccacgcgcgcctcggcaaccgctgggccgccatcgcgcgcctgctccccggccgcaccgacaacgccgtcaagaaccactggaactgctccctcaagcgcaagctcgccgccgccgccgctgctggcggcgcgggctccgacggcgccgagctcgaggcgcggcccagcaagcgacagagcctgtcgccggacaccccgtcgtcgggctccggcacggtctccgaccgcagcgatctcagccacggcgccggctccgggtccgggcaggtcttccgccccgtgccgcggtccggcgggttcgagccggttgactgcgcgatgagccgcccggccgaggacgacgacccgctgacctccctctccctctcgctccccggc

SEQ ID NO: 39872 - protein, 202 aa, Panicum virgatum
  misc_feature: Ceres CLONE 2000027
  misc_feature (11)..(57): Pfam Name: Myb_DNA-binding Pfam Description: Myb-like DNA-binding domain
  misc_feature (63)..(108): Pfam Name: Myb_DNA-binding Pfam Description: Myb-like DNA-binding domain
  misc_feature: The sequence is a functional homolog of SEQ ID NO 128 in the 11/375,241 US patent application
  misc_feature: The sequence is a functional homolog of SEQ ID NO 166 in the 10/412,699 US patent application
  misc_feature: The sequence is a functional homolog of SEQ ID NO 2272 in the 10/374,780 US patent application
  misc_feature: The sequence is a functional homolog of SEQ ID NO 373 in the 11/479,226 US patent application
  misc_feature: The sequence is a functional homolog of SEQ ID NO 914 in the 11/435,388 US patent application
  misc_feature: The sequence is a functional homolog of SEQ ID NO 118 in the 10/412,699 US patent application
  misc_feature: The sequence is a functional homolog of SEQ ID NO 188 in the 10/225,068 US patent application
  misc_feature: The sequence is a functional homolog of SEQ ID NO 2256 in the 10/374,780 US patent application
  misc_feature: The sequence is a functional homolog of SEQ ID NO 284 in the 11/479,226 US patent application
  misc_feature: The sequence is a functional homolog of SEQ ID NO 772 in the 10/225,066 US patent application
  misc_feature: The sequence is a functional homolog of SEQ ID NO 910 in the 11/435,388 US patent application
  misc_feature: The sequence is a functional homolog of SEQ ID NO 1054 in the 10/225,066 US patent application
  misc_feature: The sequence is a functional homolog of SEQ ID NO 144 in the 10/412,699 US patent application
  misc_feature: The sequence is a functional homolog of SEQ ID NO 2264 in the 10/374,780 US patent application
  misc_feature: The sequence is a functional homolog of SEQ ID NO 912 in the 11/435,388 US patent application
  misc_feature: The sequence is a functional homolog of SEQ ID NO 150 in the 10/412,699 US patent application
  misc_feature: The sequence is a functional homolog of SEQ ID NO 830 in the 11/435,388 US patent application
  misc_feature: Useful for making plants with altered cell wall content and/or composition
MGAVAECDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAAAAAGGAGSDGAELEARPSKRQSLSPDTPSSGSGTVSDRSDLSHGAGSGSGQVFRPVPRSGGFEPVDCAMSRPAEDDDPLTSLSLSLP

SEQ ID NO: 39873 - DNA, 636 bp, Panicum virgatum
  misc_feature: Ceres CLONE 2000039
  misc_feature: Encodes the peptide sequence at SEQ ID NO. 39874
acgctgcttgaccaaaacccccacgattcttggggtttcgatcgccttcactgtgctgttgcttcgtgtaatcactctgttccccggttccgtcggagcagtcgcggttggatctcagatcgttgatcacattaacaatggtgaaggctgttgctgtgcttggtagcagcgagggtgtcaagggcaccatctacttcacccaagaggaagatggccccaccactgtcaccggaagtgtctctggcctcaagcctggtctccatgggttccatgtgcatgcacttggtgacaccacaaatgggtgcatgtcaactggaccacactacaatcctgcgggcaaggagcatggagcaccagaagatgagaaccgccatgccggtgatcttggaaatgtgactgctggagcagatggtgttgctaacatcaatgtctcggactgccagatcccactgactgggccaaactcaatcattggaagagctgttgtcgttcacgctgatcctgatgatcttggaaagggtgggcacgagctgagcaagagcactggaaacgctggaggccgtgttgcctgtgggatcattgggctccagggctgaaagtgatcaccgggcttgtgtgccgaaagggtcgtctccc

SEQ ID NO: 39874 - protein, 152 aa, Panicum virgatum
  misc_feature: Ceres CLONE 2000039
  misc_feature (1)..(152): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSEGVKGTIYFTQEEDGPTTVTGSVSGLKPGLHGFHVHALGDTTNGCMSTGPHYNPAGKEHGAPEDENRHAGDLGNVTAGADGVANINVSDCQIPLTGPNSIIGRAVVVHADPDDLGKGGHELSKSTGNAGGRVACGIIGLQG

SEQ ID NO: 39875 - DNA, 660 bp, Panicum virgatum
  misc_feature: Ceres CLONE 2000049
  misc_feature: Encodes the peptide sequence at SEQ ID NO. 39876
atcgcaaaccaatcacccgccgcgtctccagctcaaacctccgcgcagcctctccagatttcccagtacccccggcggcgagatggcccgcacgaagcagacggcgcgcaagtccaccggcggcaaggcgccgcggaagcagctggcgacgaaggcggcgcgcaagtcggcaccggcgaccggcggcgtgaagaagccgcaccgcttccgcccgggcaccgtcgcgctccgggagatccgcaagtaccagaagagcacggagctgctcatccgcaagctccccttccagcgcctcgtccgcgagatcgcgcaggacttcaagaccgacctccggttccagtcctcggcggtcgccgcgctgcaggaggccgcggaggcctacctcgttgggctcttcgaggacaccaacctctgcgccatccacgccaagcgcgtcaccatcatgcccaaggacatccagctcgcgcgccgcatccgcggggagcgcgcctaggctggtcgccggtgacggcctagatctggatgctgctagtagctagttctagtgagaggatgctgtagcttgtagtgcctgccagatgaggttaacctctggttgttatcgatgggaaattcctagacttggtgctaattctctctcgcgcacctcccttctgctgg

SEQ ID NO: 39876 - protein, 136 aa, Panicum virgatum; identical to SEQ ID NO: 10238
  misc_feature: Ceres CLONE 2000049
  misc_feature (58)..(132): Pfam Name: Histone Pfam Description: Core histone H2A/H2B/H3/H4

SEQ ID NO: 39877 - DNA, 1052 bp, Panicum virgatum
  misc_feature: Ceres CLONE 2000052
  misc_feature: Encodes the peptide sequence at SEQ ID NO. 39878
atggaaaaaatcggggaaaaggagaaaaaacctcgggcgaaagcgatgcacagttggatgcagcgcctgctgaccgcggcaacaacggccgccgtcctcctcgccgccgtctgcgcagccgcctccgcgctcgacgccttccacgtccccgccgtccaagcgcaagcccatgttacaaagattaatcggttccacaaacagatcaatggcaatgacaaggtgacgttgaccttcaatgtatctgcaaatttggagtcactattcacttggaacacaaaacaggtctttgtctttctgacagctgagtataaaaacgcgaaaaattcactgaaccagatttcgttatgggaccatattataccggacaaggaacatgcaaatctgcaactagaggtgaagagcaagtatcctctaatcgaccaaggaagcagtctgcgcgggaagaaagttcagcttgttctccactggtatgttatgcccaatgctggcaccatgatccaagatcggatggcactctcggagttcaagctgcctgatgcctatacctcttgaaagaaaagcttattgacctgggaagaatcctctaacgaacatccttctaatctgtcatctgcaattggttgccaaacgaatggagatctgattcatattaagcgctgactgttgccttcgatcaagcgttgaagaacaatttggaaattatgatgaccactattttttattcactcatgctcgattgaggatgcacgtaactagatgcaaactgcagcggcttattgatggattgttactcggaatgcaaactgacgccgaggaaggtgtcggtgcactggaactgcttgacggggtacttctcgacgaccttgcagacggggtcgcacttgctgacgatgtcgtcgcaggtgtagagcccggagaaggagaagttgcgcttggtgcagcacccgagtttgccactattggtctccatgttgcccttgttctctactttatcagttccaggtccaactctttggttcagtaacaagttttctagttacccgtttcgttgc

SEQ ID NO: 39878 - protein, 168 aa, Panicum virgatum
  misc_feature: Ceres CLONE 2000052
  misc_feature (5)..(167): Pfam Name: SPC22 Pfam Description: Signal peptidase subunit
MHSWMQRLLTAATTAAVLLAAVCAAASALDAFHVPAVQAQAHVTKINRFHKQINGNDKVTLTFNVSANLESLFTWNTKQVFVFLTAEYKNAKNSLNQISLWDHIIPDKEHANLQLEVKSKYPLIDQGSSLRGKKVQLVLHWYVMPNAGTMIQDRMALSEFKLPDAYTS

SEQ ID NO: 39879 - DNA, 962 bp, Panicum virgatum
  misc_feature: Ceres CLONE 2000054
  misc_feature: Encodes the peptide sequence at SEQ ID NO. 39880
gtcacaactcactcacgcatcaggcatcacaaatcacaacacgatcggcgagcgagccagctttgccaaggccatggccggagcccttgccttcgtcgtggtcctcctcgccgccggcgccggcgcctcgacggcgaccacgctgacgatccacaacctctgcccgcacccggtctggccgctggtcacccccaactcgggcctcccctccatctccgacaacacggcgcgcctcgaccccaacgcgctcctctcactctccttcccttccaccttctgggccggccgcgtcgccgcgcgcacgggctgcgacgccgcggcgtcggggtgctggacgggcgccgcgccgccggccaccgtcgtgcaggtcaccgtccacgacggcggcaacctggaccgggccgcctacagcgtgagcctggtggacggcttcaacgtgcccgcggtggtcaccccgcacgccgccgccggcgggcagtgcccggccctcggctgcgccgcggacctcaactgcgattgcccgcccgcgcagcgcgccgccgagggcgccgcgtgtctcggcccgccgggcttcttcaagagccggtgcccgctcaccaggaccacgcccaccgacgtcgagcccacgccgcagagctgccgcgcgcccggggagatcaaggtcgtcttttgccaggcgaccattgtcgctggcgccgctgccgctgccgccgccgcggacgccgccgaggccatggtcatccgctccgtcgtcgccgacagctagatccgtcgaggcgtcccgctcgattggcctagatggcttcgtgtgtggaatcgttgtcatgaatcctttgaatttgttcatgtttagtgttgagtcggggacttcagctttggcttcgacgcgtgtactcagtactcctcccggtgtcagtagaaatcagccctgagcaaaataataatgcaagttctaaacctgg

SEQ ID NO: 39880 - protein, 230 aa, Panicum virgatum
  misc_feature: Ceres CLONE 2000054
  misc_feature (28)..(201): Pfam Name: Thaumatin Pfam Description: Thaumatin family
MAGALAFVVVLLAAGAGASTATTLTIHNLCPHPVWPLVTPNSGLPSISDNTARLDPNALLSLSFPSTFWAGRVAARTGCDAAASGCWTGAAPPATVVQVTVHDGGNLDRAAYSVSLVDGFNVPAVVTPHAAAGGQCPALGCAADLNCDCPPAQRAAEGAACLGPPGFFKSRCPLTRTTPTDVEPTPQSCRAPGEIKVVFCQATIVAGAAAAAAAADAAEAMVIRSVVADS

SEQ ID NO: 39881 - DNA, 613 bp, Panicum virgatum
  misc_feature: Ceres CLONE 2000061
  misc_feature: Encodes the peptide sequence at SEQ ID NO. 39882
ctcgctcgctcgctcgctcagcaggttcagctcagagccccagacacccacccgccactgcacagccagcagccagcagccatgagcaagggggagaagcaccaccggcacgagcaccacctgcgccgctgctgcggctgcctggcctcggtcctgctggcgctggtcctcgtggtggccttcgtcgcgctggtcgtctacctcgcgctgcgcccctccaagccgtccttctacctgcaggacctgcagctccgccggcccatccacgtcggcgacccctccctctcggcgtccgcgcaggtcacgctcgcctcccgcaaccccaacgaccgcgtcggcgtcctctacaagcgcctcgacgtcttcctcacctaccgcgaccagcccgtcacggcgcccgtctccctcccgccgcagtaccagggccaccgggacgtcatcgtctggtcccccgtgctggccgccgagtccgtgcccgtggctggctacgtcgccgacgccatgaagcaggacgtcgccgccgggttcgtcgcgctgcaggtcaaggtcgacggccgcgtcaagtggaaggtcgggagctgggtctccgggagctaccacctcttcgtcagct

SEQ ID NO: 39882 - protein, 177 aa, Panicum virgatum
  misc_feature: Ceres CLONE 2000061
  misc_feature (40)..(176): Pfam Name: Hin1 Pfam Description: Harpin-induced protein 1 (Hin1)
MSKGEKHHRHEHHLRRCCGCLASVLLALVLVVAFVALVVYLALRPSKPSFYLQDLQLRRPIHVGDPSLSASAQVTLASRNPNDRVGVLYKRLDVFLTYRDQPVTAPVSLPPQYQGHRDVIVWSPVLAAESVPVAGYVADAMKQDVAAGFVALQVKVDGRVKWKVGSWVSGSYHLFVS

SEQ ID NO: 39883 - DNA, 699 bp, Panicum virgatum
  misc_feature: Ceres CLONE 2000097
  misc_feature: Encodes the peptide sequence at SEQ ID NO. 39884
gtctcctcctccctttcccctcccaaggccaggcttgccctcccctctccgcgtcgcctcccgtccaggaatccgccatgaagggggccaaatccaagggcgccgccaaggccgatgccaagttggcggtgaagagtaagggagcggagaagccggccaagggcaggaagggaaaggccggcaaggaccccaacaagcccaagagagcgcccagcgccttcttcgtcttcatggaggaattccgcaaggagttcaaggagaagaaccctaaaaacaagtctgttgctgcggtggggaaagctgccggtgacaggtggaaatccctgaccgatgcggacaaggctccttatgtagccaaggctaataaactcaagcttgagtacaacaaggctattgctgcctacaacaagggcgagagcactgctgccaagaaggctcctgccaaggaggaagaagaggagtctgacaagtcaaagtctgaggtcaacgacgaggatgatgaagagggtagtgaggaggatgaagacgatgacgagtaagctcaggtcaagctgatgctccatggaacaatggagtggcgaatgcaaaggcctagtggcgggatttaaaaggagcctatccagtgtactagaattattcagtttcacttcacatcgtgatgttttacttttctctgtcctataacggatatcgctcctt

SEQ ID NO: 39884 - protein, 153 aa, Panicum virgatum
  misc_feature: Ceres CLONE 2000097
  misc_feature (41)..(110): Pfam Name: HMG_box Pfam Description: HMG (high mobility group) box
  misc_feature: Useful for making plants with altered alkaloid content
  misc_feature: Useful for making plants with altered lignin content
  misc_feature: Useful for making plants with altered terpenoid content
MKGAKSKGAAKADAKLAVKSKGAEKPAKGRKGKAGKDPNKPKRAPSAFFVFMEEFRKEFKEKNPKNKSVAAVGKAAGDRWKSLTDADKAPYVAKANKLKLEYNKAIAAYNKGESTAAKKAPAKEEEEESDKSKSEVNDEDDEEGSEEDEDDDE

SEQ ID NO: 39885 - DNA, 677 bp, Panicum virgatum
  misc_feature: Ceres CLONE 2000104
  misc_feature: Encodes the peptide sequence at SEQ ID NO. 39886
ctcaccgccggcgatcccctcccccttcgccgccgatggatctctccgccgtccaggccgcgctctccgacaagtcctactccggcctcgcccccctctgcgatgacctcctccttcagaccgcgtccaggggagccaccaccgacgaatggccctacgccgtccacctcctcgcccacctctacctcaacgacctgaacagcgcgaggttcttctggaagtcgttgccgcaggaggtgaaggacgcgcggccggaactcgtggctgtctggaggatcgttcagtgtctatggaaccgcgaccatgccggcgtctacacagcggcgcaggggttcgagtggggccctgacctcgctgacttcatcactgccttcctagaaagctacagaaagaggatattccaactgttgacctctgcgtattccacaatcagtgttcctgatgtggctcacttcatggggatgagtgaggaggatgctaccaattatgcagtgggaaatggttggagtttggatgcatcaaccaagatgcttactgtcaagaaaccaaagactcagaccaaccagaaactcgacgcaagcaaactgcagcgtttgactgagtgtgttttccacctggagcactgatgcccactgttagtggtgtgatgtcccttttgctacgcccaatgttaagaa

SEQ ID NO: 39886 - protein, 196 aa, Panicum virgatum
  misc_feature: Ceres CLONE 2000104
  misc_feature: Useful for making plants with modulated low light sensitivity
  misc_feature: Useful for making plants with modulated light quality sensitivity
MDLSAVQAALSDKSYSGLAPLCDDLLLQTASRGATTDEWPYAVHLLAHLYLNDLNSARFFWKSLPQEVKDARPELVAVWRIVQCLWNRDHAGVYTAAQGFEWGPDLADFITAFLESYRKRIFQLLTSAYSTISVPDVAHFMGMSEEDATNYAVGNGWSLDASTKMLTVKKPKTQTNQKLDASKLQRLTECVFHLEH

SEQ ID NO: 39887 - DNA, 728 bp, Panicum virgatum
  misc_feature: Ceres CLONE 2000113
  misc_feature: Encodes the peptide sequence at SEQ ID NO. 39888
tacttgccaaagaaaacctggaatctgattttagattcgatgaacttgctaatgcgactgagggttactctggaagtgatctgaagaatctatgcatagctgcagcatataggccagtccatgaacttctagaacaagaaagcaagggagacactggtagcacgaaaacttcattaaaggcactgaagttggatgactttgtgcaggcaaagtccaaggtaagcccatcagttgctttcgatgcgacgagcatgaacgagctaagaaaatggaatgagcagtatggggaaggtggcagtagaagcaaatcaccgttcgggtttggcagctagcatactcccgtagtaagtttccccacattgttttgggagcgtacgagcccaaatttcatagtaggaaaccagcagcagtggctcaatgtaggcaagtaacatctgctccacgcctcggcccgctccttcaggcttcaactgttcagttacttcagtctggtcactctcttgccgcccaccccccatctttttttacccccgagtcattagaacagtgctgttgtcatgtattgatagcaaaatggcttataaaatgccaagttttcgtgatacaccccatgttgtagagttacgggttcccaaccgataggcctgatcgaactgtaaatagctccaaaagttttgtcccagagctgataatctagctattttctaatcaaattcgatgtcaaatat

SEQ ID NO: 39888 - protein, 109 aa, Panicum virgatum
  misc_feature: Ceres CLONE 2000113
  misc_feature: SWISSPROT Homolog: EC 3.6.4.3 Microtubule-severing ATPase
LAKENLESDFRFDELANATEGYSGSDLKNLCIAAAYRPVHELLEQESKGDTGSTKTSLKALKLDDFVQAKSKVSPSVAFDATSMNELRKWNEQYGEGGSRSKSPFGFGS

SEQ ID NO: 39889 - DNA, 676 bp, Panicum virgatum
  misc_feature: Ceres CLONE 2000118
  misc_feature: Encodes the peptide sequence at SEQ ID NO. 39890
accctaataggagcgcggcggccgcggcgaccaccggcggcgaccggagttccctccccttccccctccgcgcgctcttcctgccccggatcctcacctcccgctcccttttcggcatctcccccctccgcgagccgtgcggtgctgccccaggtcccggatccccctcccacaccttccgcctcgcagatccggcggcggcgagagctcaagtttgtaatgtctgggatggcatctgatgatgcaactgctcaatcgagggtcgaaggagatgttgcagataaaaaagtagaagaagttcaggaccagaatgaagttggtgggatgccctcacgacaggaggaggaggcagtaattaagaaaaagtatggaggaatattacccagaaagactccacttatatctaaggaccatgaacgtgcttactttgattctgccgattgggctctaggaaagcaaggcggtgttcccaacaagcctaaaggccctcttgaagcacttcgaccaaagcttcagcctactcaacagaatgctcgtgcccgtcgaacttcttatgcatctgcagacagtgatgagactttgaacttgtctgctgaggatctgggccagcaaggagaacctggtgaggacaagaacaaggaataagtacgctgggtggctctacgccttttatatg

SEQ ID NO: 39890 - protein, 141 aa, Panicum virgatum
  misc_feature: Ceres CLONE 2000118
  misc_feature (47)..(140): Pfam Name: Lg106 Pfam Description: Lg106-like protein
  misc_feature: Useful for biocontainment applications
MSGMASDDATAQSRVEGDVADKKVEEVQDQNEVGGMPSRQEEEAVIKKKYGGILPRKTPLISKDHERAYFDSADWALGKQGGVPNKPKGPLEALRPKLQPTQQNARARRTSYASADSDETLNLSAEDLGQQGEPGEDKNKE

SEQ ID NO: 39891 - DNA, 612 bp, Panicum virgatum
  misc_feature: Ceres CLONE 2000155
  misc_feature: Encodes the peptide sequence at SEQ ID NO. 39892
gctctccccacgccaccacctcctcctccacagcaggctagccaggctttttctggggtttgcgaggggggcgctccggtccggcgagaggggggagatggcggcggagcgggcgcaggggacggtcaagtggttcaacgggagcaaggggttcggcttcatcagccccgacgacggcagccaggacctcttcgtccaccactcctccgtcaaggccgacggcttccccaacctcaaggacggcgaagccgtcgagttcaccgtcggcgccgacagcgacggccgcgccaaggccatcgacgtctccgcgcccggcggcggcacgctcgccggcggggaacgcccggacagcggctacggcgggcgcggcggcggcggctacggcgggggaggcgaccgcggctacggcggcggcggcgaccgcggctacggcggcggcggcgaccgcggctacgggggaggcgaccgcgggtacgggggaggcggcgaccgcgggtacggctacggcggcgggggcgaccgtggctacggcggcggcgggggaggcggccgcggctgctacaagtgcggcgaggagggccacatcgcacgcgactgctcccagggcggcgg

SEQ ID NO: 39892 - protein, 171 aa, Panicum virgatum
  misc_feature: Ceres CLONE 2000155
  misc_feature (5)..(72): Pfam Name: CSD Pfam Description: 'Cold-shock' DNA-binding domain
  misc_feature (152)..(169): Pfam Name: zf-CCHC Pfam Description: Zinc knuckle
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
MAAERAQGTVKWFNGSKGFGFISPDDGSQDLFVHHSSVKADGFPNLKDGEAVEFTVGADSDGRAKAIDVSAPGGGTLAGGERPDSGYGGRGGGGYGGGGDRGYGGGGDRGYGGGGDRGYGGGDRGYGGGGDRGYGYGGGGDRGYGGGGGGGRGCYKCGEEGHIARDCSQGG

SEQ ID NO: 39893 - DNA, 736 bp, Panicum virgatum
  misc_feature: Ceres CLONE 2000164
  misc_feature: Encodes the peptide sequence at SEQ ID NO. 39894
aactcgctcgccgtctcgccgatggaccggttccggccgctcaggcagatccaggtggagcccgagcccgcgcagccgccggcggcgccggcagcggctgcgggagctggcggggatacggagcgggatgagcctccggcgcccgcggcggggctgctcatgggggccaaggtgaggcgccgcgctgcggtgtaccgcgactgcaagggcgactacatcggcgtccccaacgatccctgcctcgccaagatcctctccaagcaaggggacaacaaagttttgtttgcagacaaggtattgaagttcactcaatcaggaaagatgaaaaggcgcatcctggtgatcacagactttgctctataccttgtcgatcccgatgctgatatattgaagaggagaatagcacttgcagccgtggataagctatacattagcaatctcagtgacaacttctttgcgatcattgttccaactgagtatgattgtttaatagcaagcactagaaagaaagaaattgttaatgtcatagttaaggctatcaagagcacatctgaatatgaacctgaggtggcttcctctaacaggtttgagtatcatgcagctgcggaagtgattaaggttgtcgaatttgaggatgctgatggaggcattaaaatcaggatcacgaacaaggagaagtcatgaatcagaactcatggatagtgggtcccctgtactgtatggctctttcagtttc

SEQ ID NO: 39894 - protein, 220 aa, Panicum virgatum
  misc_feature: Ceres CLONE 2000164
  misc_feature (34)..(217): Pfam Name: Myosin_TH1 Pfam Description: Myosin tail
MDRFRPLRQIQVEPEPAQPPAAPAAAAGAGGDTERDEPPAPAAGLLMGAKVRRRAAVYRDCKGDYIGVPNDPCLAKILSKQGDNKVLFADKVLKFTQSGKMKRRILVITDFALYLVDPDADILKRRIALAAVDKLYISNLSDNFFAIIVPTEYDCLIASTRKKEIVNVIVKAIKSTSEYEPEVASSNRFEYHAAAEVIKVVEFEDADGGIKIRITNKEKS

SEQ ID NO: 39895 - DNA, 667 bp, Panicum virgatum
  misc_feature: Ceres CLONE 2000199
  misc_feature: Encodes the peptide sequence at SEQ ID NO. 39896
actgcctcttcaccatcatcagcttcaattcattctagctccttccacacgcgtcgtagatgaacgcacgatcgagctcacaccgagaagcagctaccgaccaagacgaagacgaagacgaagcggcgctagggtgcatgggtaactaattaacaattcttgttcttcttttgatttcattctcctttcaattccgatttgcgctgatgaacatctatctatatatacgtatacaggactttccttgtgttcccagcagagatctccggccaggccagaaattgcgaccaggggtattcgtgatcgcctgcaacccagcgctgctgctgctattcggaagggccgtggtgagggcgataagatcaatatgctgccgaccaccgtgacggccatccaaagcaaccaagagttgaagaacgtcttgaggcaggccaaggagccaaactccaacctggtggtgctggagttcacggcgccgtggtcggagccgtgcaagttcatgaggccggcgctggagaagatcgcctccgacttcaaggatcacgccgacttctacacgctcgacgtcgagcagttcaagacatttgctcggaacacccgggtggaggcgctgccgacgttcctgctggtgaggaaaactatcttggagcgcgtcatcggcgtcagc

SEQ ID NO: 39896 - protein, 99 aa, Panicum virgatum
  misc_feature: Ceres CLONE 2000199
  misc_feature (6)..(99): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MLPTTVTAIQSNQELKNVLRQAKEPNSNLVVLEFTAPWSEPCKFMRPALEKIASDFKDHADFYTLDVEQFKTFARNTRVEALPTFLLVRKTILERVIGV

SEQ ID NO: 39897 - DNA, 658 bp, Panicum virgatum
  misc_feature: Ceres CLONE 2000202
  misc_feature: Encodes the peptide sequence at SEQ ID NO. 39898
agaggcagcagctccccccgcaaaaaccctagcttttacctccgccccgtcgtcccccaccaagcgcctccaagatgaagcttgtcaggttcctgatgaagctgaacaacgagacggtgaccatcgagctcaagaatggcaccgtcgtccacggaaccatcaccggtgttgatatcagcatgaatactcatctgaagactgtgaagctcacactgaaagggaaaaatcctgttacccttgatcacctcagtgtgagaggaaacaacatccgctattatatccttcctgacagcttaaacctggagactttgctggttgaggaaacaccaagggtcaaacctaagaagccaacttcagggaagcctttgggacgtgggcgtggccgtggtcgtgggcgcggtcggggtcggagacgttgagcttgctgcccatttggaaattgcattgcggacatctttgcaatgtaatctgctttcgtatctgtttgtacggagtatcacttttgttaaggcagtggcgttggtgctgtctgttcttgctgtggattgagttgatgttagatgttacatgtaactactgtgccatatgctattcccctgaatacctgtgcgtgatgactaaattcatgtgaagtcaaacatgcaaccttttctgatcg

SEQ ID NO: 39898 - protein, 114 aa, Panicum virgatum
  misc_feature: Ceres CLONE 2000202
  misc_feature (5)..(70): Pfam Name: LSM Pfam Description: LSM domain
MKLVRFLMKLNNETVTIELKNGTVVHGTITGVDISMNTHLKTVKLTLKGKNPVTLDHLSVRGNNIRYYILPDSLNLETLLVEETPRVKPKKPTSGKPLGRGRGRGRGRGRGRRR

SEQ ID NO: 39899 - DNA, 694 bp, Panicum virgatum
  misc_feature: Ceres CLONE 2000208
  misc_feature: Encodes the peptide sequence at SEQ ID NO. 39900
ttcctgcttctcgatcggattggggcttcgttgggggggtcttggtaggtgtggtgtgcacgggagttggggcttcgttgctttgcttcgctcgtgcgcaagggagagagagaagagggaggagtaagcgaggaggcagatggcgtcgaagcggatcctcaaggagctcaaggacctgcagaaggatcctcccacctcctgcagcgcaggcccagtcgcggaagatatgttccactggcaagcaacgattatgggtccatcggatagcccatacgctggcggcgtctttttggtcacaattcacttccctccagactacccattcaaaccgcccaaggttgcattcaagacaaaggtcttccatccgaatatcaacagcaatgggagcatctgtcttgatatcttgaaggaacaatggagcccagcattgacagtttctaaggttagtaaattcttctgctttcctgtagctttgtagtaaccaaatgtttcaagccaactgtgccatgtgtcaagcctgcctaagttggaatcatctagttgtttcaatagcttagctgaaaacagcccctgcactgtgacctattcaagtttggttctccagttgcatcatcatcttagaaaacatgcttcctgttttcaggtactactctcaatttgctcccttttgacggacccgaaccctgatgatcca

SEQ ID NO: 39900 - protein, 112 aa, Panicum virgatum
  misc_feature: Ceres CLONE 2000208
  misc_feature (5)..(112): Pfam Name: UQ_con Pfam Description: Ubiquitin-conjugating enzyme
  misc_feature: SWISSPROT Homolog: EC 6.3.2.19 Ubiquitin--protein ligase
  misc_feature: Useful for biocontainment applications
  misc_feature: Useful for making plants with modulated low light sensitivity
  misc_feature: Useful for making plants with modulated light quality sensitivity
MASKRILKELKDLQKDPPTSCSAGPVAEDMFHWQATIMGPSDSPYAGGVFLVTIHFPPDYPFKPPKVAFKTKVFHPNINSNGSICLDILKEQWSPALTVSKVSKFFCFPVAL

SEQ ID NO: 39901 - DNA, 649 bp, Panicum virgatum
  misc_feature: Ceres CLONE 2000216
  misc_feature: Encodes the peptide sequence at SEQ ID NO. 39902
tagaagccccctgcctcctgcgcctccaccctcctcgccgcttctccccctccgagaccgcagatccgtccggtgagaggagcccgcccgccgccatgtcgtccgctgagctcgcctgcacctacgccgccctcatcctcagcgatgacggcatcccgatcacggccgagaagatcgcgacggtggtgaaggccgcgaacgtcaaggtggagtcttactggcccacgctcttcgccaagctcctggagaagcgcagcgttgaggacctcatcctctccgttggatctggtggtggtgctgccccagttgctgctgctgcccctgctggtggtgctgcagcagctgctgccccggctgttgaggagaagaaggaagagcccaaggaggagtctgatgacgacatgggcttcagcctgttcgactgaggagcccctggccagccattagcaaattcacttatgctgtccaagactatcttatgttatgtccctaggcttttgttataagtactcaaattcccctggccagccattagcaaattcacttatgctgtccaagactatcttatgttatgtccctaggcttttgttataagtactcaaatttttgagtttttgagatgtggtgctatggctatgtgctgaacctc

SEQ ID NO: 39902 - protein, 109 aa, Panicum virgatum; identical to SEQ ID NO: 14489
  misc_feature: Ceres CLONE 2000216
  misc_feature (21)..(108): Pfam Name: Ribosomal_60s Pfam Description: 60s Acidic ribosomal protein

SEQ ID NO: 39903 - DNA, 595 bp, Panicum virgatum
  misc_feature: Ceres CLONE 2000217
  misc_feature: Encodes the peptide sequence at SEQ ID NO. 39904
acaagctcgcgtcgcgtcgcgcgcgcactcgcactcacgctcattcactgagccattactcagctcaccaactccagatctcatggcgccctcgcgctgccaccgccccgtcctcctccccacgaccatggccacggtctgcctcctcctcgcgctctgcgccgcgccggcgccggcccacgccgcgcgcgccctgactccgggccgcgcgggcgcggtcaccaaggcgcagcaggggggcggcagcggcagcaacgcgacggcggcggcggcggcggacgagtacctggcgccgcacaaccaggcgcgcgcggtggtgggcgtgcccccgctgcggtggagcgcggacctggcgtcgaccgcggcggcggtggtggcgcagcagcagcggcaggtcgggtgcgcgttcgtggacatgggcggcagcccctacggcgcgaaccaggggtgggcgagctaccgcgcgcggcccgccgaggtggtggcgtcgtgggtggcggaggggcgctactacacccacgccaacaacacgtgcgccgcggggcggcagtgcggcacctacacgcaggtggtgtggcgccgctccgccgaggtc

SEQ ID NO: 39904 - protein, 155 aa, Panicum virgatum
  misc_feature: Ceres CLONE 2000217
  misc_feature (54)..(155): Pfam Name: SCP Pfam Description: SCP-like extracellular protein
MATVCLLLALCAAPAPAHAARALTPGRAGAVTKAQQGGGSGSNATAAAAADEYLAPHNQARAVVGVPPLRWSADLASTAAAVVAQQQRQVGCAFVDMGGSPYGANQGWASYRARPAEVVASWVAEGRYYTHANNTCAAGRQCGTYTQVVWRRSAE

SEQ ID NO: 39905 - DNA, 668 bp, Panicum virgatum
  misc_feature: Ceres CLONE 2000218
  misc_feature: Encodes the peptide sequence at SEQ ID NO. 39906
gacaacgaactccggcctcatctaccttgccgtctctctgcctcgtctccaacggggagggaaaaaaaattagcggggattcagatgaggctctatctccggcaagcggcggccgcggccacggccaccagctcccccctggcggccaccatccgcaagaattctccaagctccctcacccatggccggctcggcttcagccacgcccacacgtcgctgcagacgacgccgaaccaccgcggaaaccgaccagggtgggcggtgcgcgtgcttcccctgacggaggagaacgtggagagggtgctggacgaggtgcggccgagcctgatggcggacggcggcaacgtggcgctgcacgagatcgacggcctcgtcgtcgtgctcaagctgcagggcgcctgcggctcctgccccagctccaccatgacgctcaagatgggcatcgagacgcgcctccgcgacaagatccccgacatcctcgaggtcgagcagatcgtcgacaccgagaccggcctcgagctcagcaccgacaacgtcgagaaggtacttgatgagatcagaccatacctctccggcaccggaggtggaggcctcgagctgctccagatcgatcgatatgtcgtcaagattcgaatcagtggacctgcagctggtgtaatgacggttcg

SEQ ID NO: 39906 - protein, 194 aa, Panicum virgatum
  misc_feature: Ceres CLONE 2000218
  misc_feature (70)..(137): Pfam Name: NifU Pfam Description: NifU-like domain
MRLYLRQAAAAATATSSPLAATIRKNSPSSLTHGRLGFSHAHTSLQTTPNHRGNRPGWAVRVLPLTEENVERVLDEVRPSLMADGGNVALHEIDGLVVVLKLQGACGSCPSSTMTLKMGIETRLRDKIPDILEVEQIVDTETGLELSTDNVEKVLDEIRPYLSGTGGGGLELLQIDRYVVKIRISGPAAGVMTV

SEQ ID NO: 39907 - DNA, 744 bp, Panicum virgatum
  misc_feature: Ceres CLONE 2000222
  misc_feature: Encodes the peptide sequence at SEQ ID NO. 39908
aacctacgtgcacagcgaagccgctgatcggcatctgtcgtcgccggtgcctcggatggtttcccagcttcgatcagcatgcaagtactacactggatatcccaaggacctagggccatcaagaattataccattcacatctgagcgtcagtttgtacagctattgcatgaaggaaggcctgtagttgttgcctttactattaagtgcacttatacacagcatcttgataaagtactggaagaggctgccgccacattttatccacatatcaagttcgtcagagttgaatgcccaaagtatccagggttttgcctcacgaggcaaagaaatgaatatccatttgttgaagtattttacaatccagaacaggctgcaagccaaggaaagagcgtggatcctaacatcaccaagtattctgtaaaagtgctacccttcaactatgatcagagcttgtatggatttcgggaatatttcaagaagcatggtttcaagtattctgaaacaagctaattctgtcaatagaaatatgcaatgtgagaacttctagggagttcattgtcatagttgaactgtggggctgatgtctttcctagttgaaggaatgcctgccatgtgctcatgtcagggtatcatgcctatagattagtactgcaatagcaaatgcgtgctgagctatcaaccttcaatctggtaaacatttccccaaccacaacctggagtattgcacgtctttttattgaatg

SEQ ID NO: 39908 - protein, 169 aa, Panicum virgatum
  misc_feature: Ceres CLONE 2000222
  misc_feature: SWISSPROT Homolog: EC 5.3.4.1 Protein disulfide-isomerase
TYVHSEAADRHLSSPVPRMVSQLRSACKYYTGYPKDLGPSRIIPFTSERQFVQLLHEGRPVVVAFTIKCTYTQHLDKVLEEAAATFYPHIKFVRVECPKYPGFCLTRQRNEYPFVEVFYNPEQAASQGKSVDPNITKYSVKVLPFNYDQSLYGFREYFKKHGFKYSETS

SEQ ID NO: 39909 - DNA, 728 bp, Panicum virgatum
  misc_feature: Ceres CLONE 2000226
  misc_feature: Encodes the peptide sequence at SEQ ID NO. 39910
gttcgggtctcacagcttcggaagcagaggagcggcgactgcgctcgtcgtctccgccaccgtcggcggcctctcgcgatggcgcctctcacggcccccaagtccggtgacgccctcttcgccagcgtcgatcgcgtcaacgcggagctgttcacgctcacgtatggcgccatcgtgcggcagctgctcacggatctggaggaggtcgaggaggtcaacaagcagctagatcagatgggttacaacattggaacacggttggttgatgagttcttagcaaagtcaaacgtatcaaggtgtgttgacttcaaggagactgctgatgttatcgcaaagattggatttaagatgttcttgggtgtgactgcaactgtaaccaattgggatgctgagggtacaagctgcagctttatattggaggacaatcctcttgttgattttgttgagctccctgacacttgccaaggccttcagtattgcaatgtgttaagtggagtaatcaggggagcattggaaatggtgtccatgaagacagaggtgacatgggtccgtgacatgctccgtggggatgatgcctatgagatgcgtgtgaagcttatcaagcaagtcccagaggaatacccctacaaggatgatgactagttgagtttaggcgaagttcctgcagcagggcgcttgtttacttgtctgggatgtaattttgctgtggatatagccctggtattact

SEQ ID NO: 39910 - protein, 187 aa, Panicum virgatum
  misc_feature: Ceres CLONE 2000226
  misc_feature (24)..(174): Pfam Name: TRAPP_Bet3 Pfam Description: Transport protein particle (TRAPP) component, Bet3
MAPLTAPKSGDALFASVDRVNAELFTLTYGAIVRQLLTDLEEVEEVNKQLDQMGYNIGTRLVDEFLAKSNVSRCVDFKETADVIAKIGFKMFLGVTATVTNWDAEGTSCSFILEDNPLVDFVELPDTCQGLQYCNVLSGVIRGALEMVSMKTEVTWVRDMLRGDDAYEMRVKLIKQVPEEYPYKDDD

SEQ ID NO: 39911 - DNA, 708 bp, Panicum virgatum
  misc_feature: Ceres CLONE 2000252
  misc_feature: Encodes the peptide sequence at SEQ ID NO. 39912
ctctttccggcgaccaggcaagcaaggggcggccgatcgccagcagcggcaagcggtgcacaggcggtcttccctgtgaggacgtctgccagcaaccatgttcacggcaaggcggaagatccagaaggagaagggccaggagccggatgagtttgaggagtcggtggcccaggccctgttcgacctggaggcgaccaatcaggagctcaaggccgacctgaaggacctgtacatcaacacggcgcgcgagatcgacatcacgagccagcgcaaggccatcatcatccacgtgccctaccgcctcctcaaggcctaccacaagatccacgccaggctcgtgcgggagctcgagaagaagttcagcggcaaggatgtggtcttggtgggcacccggcgaatcatgaagccccccaagaagggctcctccgcgacgcgcccccgcagccgcaccctgacgtccgtccacgaacagatcctggaggacctggtctaccccaccgagattgtcggcaagcgggtccgctaccgcctagacggcacccgcctcctcaaggtttacttggaccctaaggagcggaacaccaccgagtacaaactagagactttcgggggggtttacaagaagctcactgggaaggaggttacattcgaatacccccctgagcagcagcaagccactgttgcttatgttgttgcagagcttcgttg

SEQ ID NO: 39912 - protein, 203 aa, Panicum virgatum
  misc_feature: Ceres CLONE 2000252
  misc_feature (6)..(191): Pfam Name: Ribosomal_S7e Pfam Description: Ribosomal protein S7e
  misc_feature: Useful for making plants with modulated biomass
MFTARRKIQKEKGQEPDEFEESVAQALFDLEATNQELKADLKDLYINTAREIDITSQRKAIIIHVPYRLLKAYHKIHARLVRELEKKFSGKDVVLVGTRRIMKPPKKGSSATRPRSRTLTSVHEQILEDLVYPTEIVGKRVRYRLDGTRLLKVYLDPKERNTTEYKLETFGGVYKKLTGKEVTFEYPPEQQQATVAYVVAELR

SEQ ID NO: 39913 - DNA, 680 bp, Panicum virgatum
  misc_feature: Ceres CLONE 2000317
  misc_feature: Encodes the peptide sequence at SEQ ID NO. 39914
gcttctctttgcacttccgccccgcctcgccgtctacctcgctgccgcttcgcgccgccgccgctcgctcgcctctccgaccgccgcgaggatgccgttcaagaggttcgtggagatcgggcgcgtggccctggtgaactacggcaaggactatggccgcctcgtcgtcatcgtcgacgtggtcgaccagaacagggcacttgtggatgcccctgacatggtcaggtgccagatgaacttcaagcgtctctcacttaccgacatcaagattgacatcaaacgtgtacccaagaagacaactctgatcaaggcgatggaggaagctgatgtgaagaccaagtgggagaacagctcatggggcaagaagctgattgtccagaagaggagagcagcactcaatgacttcgataggttcaaggtcatgttgacgaagatcaagaggggtggtgctgtcaggcaagagcttgccaagctcaagaaggcgtccacggcttagattatcttttggtggatggcatgttgagtttttggtaccttattatatcagtgattcgtttgagtgttgttaagccagaattagcactcctgtttcctatgaactcttttcaaaccttaatcaagcatggctgtgctctggaggattttgtcatgatggtatgaaatatctaaggtagtttgcg

SEQ ID NO: 39914 - protein, 134 aa, Panicum virgatum
  misc_feature: Ceres CLONE 2000317
  misc_feature (44)..(120): Pfam Name: Ribosomal_L14e Pfam Description: Ribosomal protein L14
MPFKRFVEIGRVALVNYGKDYGRLVVIVDVVDQNRALVDAPDMVRCQMNFKRLSLTDIKIDIKRVPKKTTLIKAMEEADVKTKWENSSWGKKLIVQKRRAALNDFDRFKVMLTKIKRGGAVRQELAKLKKASTA

SEQ ID NO: 39915 - DNA, 708 bp, Panicum virgatum
  misc_feature: Ceres CLONE 2000342
  misc_feature: Encodes the peptide sequence at SEQ ID NO. 39916
accaggcaggcacctcccttccccgagcccccctttcccccctcctcctcctccacccgctgccccgcatccccaccacctccggcgagctctccaccggcggcagcggaagagcgggggtttgaggcgaaggagcagcggagcggagacgaggcgatggggcagcagcagctgatctacgcgttcgtggcgcggggcacggtggtgctggccgagtacaccgagttcaccggcaacttcaccaccatcgcggcccagtgcctgcagaagctccccgccagcaacaacaagttcacatacaactgcgacggccacaccttcaactacctcgtcgaggacggattcacgtactgtgtagtcgctgttgaatcagttggtcggcaaatccccattgctttcctggacagagttaaggaagatttcaccaaaaaatatggtggtgggaaagcagctactgcagcagcaaacagcttgaacagggagtttggatcaaaacttaaagagcacatgcagtactgtgtggaccaccctgaggaggtcagcaagcttgccaaggtgaaggcccaagtctcagaagttaaaggagtgatgatggagaatattgagaaggttctggaccgtggggagaagattgaactgcttgttgacaagactgagaatctccgttctcaggcacaagatttcaggcagcagggcaccaaggtgcgg

SEQ ID NO: 39916 - protein, 183 aa, Panicum virgatum
  misc_feature: Ceres CLONE 2000342
  misc_feature (127)..(183): Pfam Name: Synaptobrevin Pfam Description: Synaptobrevin
MGQQQLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTKV

SEQ ID NO: 39917 - DNA, 685 bp, Panicum virgatum
  misc_feature: Ceres CLONE 2000364
  misc_feature: Encodes the peptide sequence at SEQ ID NO. 39918
tactggatcttcggcgcaaagaggtgcaagctatggaagtcgccaagatcgacctccgcggcgtggagtccggcgggccggggtgggaggctgcccgcgccgcggtgaccgcgtccatgacggcgcacggcttcgtcgtcgtcgcgcacgacgcgctcggcgccgacctccgccgggcgctgttcgcccgcgccctgccggagctcttcgcgctcccgctcgaggccaagaagcgcaacgacaccaagggccagttcaggggctacatcggaccgctccccggcgccaactgggagagcctcggcgtcgaggagcccaccgatgccgccagcgtccgcggcttcgccgacctactgtggccggacggcaacccggagttcagtgcgaccatcgtgtcgttcgccaagaacatactgaagctggaggagatggtggagacgctgctcctggagggcctcggcgtccggggagagagcatcggcgcccacttcgacatgctcagcgacagcatcaggatgtggcgctacggcgcgccgctggacacggagaccgccgtgagcatgcaggcgcactacgacatcaccatgctcaccgcgatcgtgcagcacgacgtggaaggcctggaggtccacgtcggggacgggcgctgggccgccgtccctgccgagcccggcaccgtcgcctt

SEQ ID NO: 39918 - protein, 217 aa, Panicum virgatum
  misc_feature: Ceres CLONE 2000364
  misc_feature: SWISSPROT Homolog: EC 1.14.11.15 Gibberellin 3-beta-dioxygenase
MEVAKIDLRGVESGGPGWEAARAAVTASMTAHGFVVVAHDALGADLRRALFARALPELFALPLEAKKRNDTKGQFRGYIGPLPGANWESLGVEEPTDAASVRGFADLLWPDGNPEFSATIVSFAKNILKLEEMVETLLLEGLGVRGESIGAHFDMLSDSIRMWRYGAPLDTETAVSMQAHYDITMLTAIVQHDVEGLEVHVGDGRWAAVPAEPGTVA

SEQ ID NO: 39919 - DNA, 670 bp, Panicum virgatum
  misc_feature: Ceres CLONE 2000365
  misc_feature: Encodes the peptide sequence at SEQ ID NO. 39920
tgaccgcttgattcatgtataccattttacaaaagatactcaaaaccaaacgcaggttcagaacttcggagagccattttttatggttattcgtgaggacgaaaccctatcttctatcaaggaacgtatacagaaaaagcttaaggttccagatgaggatttctcaaagtggaaatttgcatacatttcacttggccgtccagactattttgaagattcagatattgtggctacaaaatttcagagaaacatgtatggagcttgggagcagtatcttggactggaacatccagacacagctcctaggaaggcacacacggttaatcagaaccggcattcatttgagagacctgtaaaaatttataactaggcaagttaggaatttgaacgatgagccaccacccaataccaagtaagggctgaaattgctggcttgaaataaagtgtgccatagtaggggcgtgctgcttaggttttcaacgaagctgatgagctagtttcagaggaggctttttcagtatgatcggggcagcatctcctcgtctttccccgttttgccctggatatataaagttgtgcagagatgaccccaccgaaccattgtctttcagtagataagctggtatttcctgttaggtgactttatacagtcgaatagccgacgcttttc

SEQ ID NO: 39920 - protein, 122 aa, Panicum virgatum
  misc_feature: Ceres CLONE 2000365
  misc_feature: SWISSPROT Homolog: EC 3.1.2.15 Ubiquitin thiolesterase
DRLIHVYHFTKDTQNQTQVQNFGEPFFMVIREDETLSSIKERIQKKLKVPDEDFSKWKFAYISLGRPDYFEDSDIVATKFQRNMYGAWEQYLGLEHPDTAPRKAHTVNQNRHSFERPVKIYN

SEQ ID NO: 39921 - DNA, 732 bp, Panicum virgatum
  misc_feature: Ceres CLONE 2000383
  misc_feature: Encodes the peptide sequence at SEQ ID NO. 39922
cttgcgttgcccgcaatcgaaagcagatcaaaccctagatctcgtctcgccgccccgatccgaatcccatggattcgtcgtcgtcgtcgtcctccagcctgagccagcagcccgagttcgactacctcttcaagctgcttcttatcggcgactccggcgtcggcaagagcagtctcctcctacgcttcaccgccgactccttcgaggacctctcccccaccataggtgttgacttcaaggtgaagatggttaacattggtggcaagaaactcaagcttgccatctgggacacagctggacaggagagatttaggaccttaaccagctcatactacagaggggcacagggaatcattatggatacatctgatgaaattaatgtcatatcactgaggaaagtctttttttttttgaaagggcactgagtgtatgatgtcactcgacgagaaacatttaccaatctttctgatatatgggcaaaggaaattgacctgtattcaaccaaccaggattgtataaagatgcttgttggaaacaaagtagacaaggaaagtgaaagggctgtcacaaaaaaagaaggaatcgaatttgctcgggaatacggatgtttatttctggaatgcagtgcgaaaacaaaagtaaatgtagaacagtgctttgaggaactcgtcctaaagatattagacacgccaagcctcctagctgatgcttcgtcaggggccaagaagaact

SEQ ID NO: 39922 - protein, 118 aa, Panicum virgatum
  misc_feature: Ceres CLONE 2000383
  misc_feature (22)..(116): Pfam Name: Ras Pfam Description: Ras family
  misc_feature: SWISSPROT Homolog: EC 2.7.11.1 Non-specific serine/threonine protein kinase
  misc_feature: Useful for making plants with altered lignin content
  misc_feature: Useful for making plants with modulated oxidative stress sensitivity
MDSSSSSSSSLSQQPEFDYLFKLLLIGDSGVGKSSLLLRFTADSFEDLSPTIGVDFKVKMVNIGGKKLKLAIWDTAGQERFRTLTSSYYRGAQGIIMDTSDEINVISLRKVFFFLKGH

SEQ ID NO: 39923 - DNA, 727 bp, Panicum virgatum
  misc_feature: Ceres CLONE 2000392
  misc_feature: Encodes the peptide sequence at SEQ ID NO. 39924
acccaccacttgccggccaccatcaccaatccccccagccagcgcggatcgagcgaggccgccgtcgccgagctccgtcatggccgccgcgctgagggctgcgccgccgtccccggccaccgccaggcccgcggaaggcttcgccaaggcggtggcggcgtcgcgggtcgcggcaggcggcgccgtcggggcggccgggaagaggaaggcgcgcggcgtggcggtccgggcgtcgctgttctcgcccaagcccgcggcggccaaggacgcgcggccgtccaaggtgcaggagctctacgtgtacgagatcaacgagcgggaccgcgagagccccgcgtacctgcgcctcagcgccaagcagacggagaacgcgctgggcgacctcgtgcccttcaccaacaaggtgtacaacgggggcctggacaagcggctgggcatcaccgccggcatctgcgtgctgatccagcacgtccccgagcgcaacggcgacaggtacgaggccatctacagcgtctacttcggcgactacggccacatcacggtgcagggcccgtacctgacctacgaggagtcgttcctggccgtcacgggcggctccggcgtcttcgagggcgcctacggccaggtgaagctccaccagatcgtcttccccttcaagatcttctacaccttctacctcgggggcatcccggacctgccgcgggagctgctctgcacgcccgtcccg

SEQ ID NO: 39924 - protein, 215 aa, Panicum virgatum
  misc_feature: Ceres CLONE 2000392
  misc_feature (62)..(215): Pfam Name: Allene_ox_cyc Pfam Description: Allene oxide cyclase
  misc_feature: SWISSPROT Homolog: EC 5.3.99.6 Allene-oxide cyclase
  misc_feature: Useful for making plants with modulated nitrogen use efficiency
MAAALRAAPPSPATARPAEGFAKAVAASRVAAGGAVGAAGKRKARGVAVRASLFSPKPAAAKDARPSKVQELYVYEINERDRESPAYLRLSAKQTENALGDLVPFTNKVYNGGLDKRLGITAGICVLIQHVPERNGDRYEAIYSVYFGDYGHITVQGPYLTYEESFLAVTGGSGVFEGAYGQVKLHQIVFPFKIFYTFYLGGIPDLPRELLCTPV

SEQ ID NO: 39925 - DNA, 651 bp, Panicum virgatum
  misc_feature: Ceres CLONE 2000393
  misc_feature: Encodes the peptide sequence at SEQ ID NO. 39926
cttcgtggttgcgccgtcccctcccctcccgagcactccccctccggcggcagagcggcagcggcgagatggtgaaggggcgcactgggcagcgcgtgaggctctacgtccggggcaccatcctcggatacaagaggtccaagtcgaaccagtacgagaccacgtcgctggtgcagatcgagggggtgaacaccaaggaggacgtctcgtggtactgcggcaagcggatggcgtacatctacaaggccaagaccaagagcagcggcacccactaccgctgcatctggggcaaggtcacccgcccgcacggcaactctggcgtcgtccgcgccaagttcaagtccaacctgccgccggagtctatggggcgcaaggtcagagtcttcatgtaccccagcagcatctaaagataatttcaagatgtggaggattgtgcttatctgctaggtttatcttgagctaaaatgttccgtgtaaggggtctgttcaggttgagagttagcaacatgaactgtctatttgagaaccctttgaagttctccctggttttggtattgtggaccacctaaatcttatatggagttgaagttagaactgaaagtaatttgtcatattttgttcgttgcgcattgcatcagttgtctgggttcg

SEQ ID NO: 39926 - protein, 112 aa, Panicum virgatum
  misc_feature: Ceres CLONE 2000393
  misc_feature (12)..(106): Pfam Name: Ribosomal_L35Ae Pfam Description: Ribosomal protein L35Ae
MVKGRTGQRVRLYVRGTILGYKRSKSNQYETTSLVQIEGVNTKEDVSWYCGKRMAYIYKAKTKSSGTHYRCIWGKVTRPHGNSGVVRAKFKSNLPPESMGRKVRVFMYPSSI

SEQ ID NO: 39927 - DNA, 652 bp, Panicum virgatum
  misc_feature: Ceres CLONE 2000401
  misc_feature: Encodes the peptide sequence at SEQ ID NO. 39928
gttcaggccctttcttcctttctcctcttcgctgacggcaagcgaatccggtaggcggctatggcgacggcggcggcggcggcgttcggctgctcctcggcggcggcgctgccgcccttctcggctctcccgggaagcctatgctcgcgccagtcgcgaccccctccccgcgtgtccctcatcgcctcctcgaagctcggggcgacggcgctcgggttgagagtttcgtgccgtagaaggaagctagttgtctctgcttgctcctccagtgagtccagttcggacgcggcggcgtcccggacggaagccactgttgatataaagcttccaagaagaagcttgcttgtccaatttacatgtaatgcatgtggtgaaaggacccagcggttaataaacagagtagcctatgaaagaggaacagtttttcttcagtgtgcagggtgccaggtgtaccacaagtttgtggacaatcttggtctagttgttgaatacgatctgcgagaagaaaatgcgctacaagaagacaatgtggtgaacacatattgttggagtatattgagcacatgtatagaggcccatctagaggcccatgtataggaactatatatcccatcattctagggtttggagtaatacaacaactattatcctc

SEQ ID NO: 39928 - protein, 178 aa, Panicum virgatum
  misc_feature: Ceres CLONE 2000401
  misc_feature (94)..(157): Pfam Name: zf-DNL Pfam Description: DNL zinc finger
MATAAAAAFGCSSAAALPPFSALPGSLCSRQSRPPPRVSLIASSKLGATALGLRVSCRRRKLVVSACSSSESSSDAAASRTEATVDIKLPRRSLLVQFTCNACGERTQRLINRVAYERGTVFLQCAGCQVYHKFVDNLGLVVEYDLREENALQEDNVVNTYCWSILSTCIEAHLEAHV

SEQ ID NO: 39929 - DNA, 626 bp, Panicum virgatum
  misc_feature: Ceres CLONE 2000403
  misc_feature: Encodes the peptide sequence at SEQ ID NO. 39930
ctcttcgtcttggatccatctccactctcccccctccccccagagcagagagcagacagagcccagcatgtcgtcgtcgtccaaggtcttcaccctcgaggaggtcgccaagcacaacaccaaggacgactgctggctcatcatcgccggcaaggtgtataatgtgaccaagtttcttgaggatcaccctggaggtgatgatgttctgttgtcttccactgccaaggatgctactgatgacttcgaagatgtgggccacagcaccactgctcgtgcgatgatggacgagtacttagtcggcgaaattgatgcaactacaatacccactaaggtgaagtacacgcccccgaagcagccgcactacaaccaggataagacccctgagttcatcatcaagattctccagtttttggtccccttggcgatattgggcttggctgtcgccgtaaggatctacaccaagtcggaatcctcctaataccgtcatcattcgatcaaagattacaactgaataagttagtgaggattgtacgagctagcatggcctgtcatgaatttggaaacttcagtctctgtgatggtatggttacgtgcaacatctattcgtaaagtgagacaagtgaagt

SEQ ID NO: 39930 - protein, 136 aa, Panicum virgatum; identical to SEQ ID NO: 34237
  misc_feature: Ceres CLONE 2000403
  misc_feature (7)..(81): Pfam Name: Cyt-b5 Pfam Description: Cytochrome b5-like Heme/Steroid binding domain

SEQ ID NO: 39931 - DNA, 703 bp, Panicum virgatum
  misc_feature: Ceres CLONE 2000408
  misc_feature: Encodes the peptide sequence at SEQ ID NO. 39932
cacctgctggaagcatacacaaagacagtcctgctgctaagtatttgatggagcgtggtgtggacaggaaggacttcaactcatatggtagccgccgtggtaatgatgaagtaatggcaagaggaacatttgccaacattaggatcgtgaacaagttcttgaacggagaagttggacccaagaccattcacgttcctactggggagaagctttatgtttttgatgcagccatgagatacaaatctgagggccttcccaccataattctcgctggtgctgagtacggaagtggcagttctcgtgattgggctgccaagggaccgatgctcctgggagttaaagctgtgatttccaagagttttgagcgcatccacagaagcaatttggtggggatgggaatcattcctctctgcttcaaagctggtgaggatgctgattcgctcggccttactgggcatgagcggtacagcatcaacctccctaccaacctcagcgagatccgtcctggccaggatgtgactgtcacaaccgacaatgggaaatccttcacctgcacccttcgctttgacactgaggtggagctggtgtacttcaaccatggaggtattctcccctatgtcatccgcaacttggcgcagaagtaaggcagattacaccggttcacccgcgatggcagatggcagatggcacatggcaggctcgt

SEQ ID NO: 39932 - protein, 213 aa, Panicum virgatum
  misc_feature: Ceres CLONE 2000408
  misc_feature (11)..(141): Pfam Name: Aconitase_C Pfam Description: Aconitase C-terminal domain
  misc_feature: SWISSPROT Homolog: EC 4.2.1.3 Aconitate hydratase
PAGSIHKDSPAAKYLMERGVDRKDFNSYGSRRGNDEVMARGTFANIRIVNKFLNGEVGPKTIHVPTGEKLYVFDAAMRYKSEGLPTIILAGAEYGSGSSRDWAAKGPMLLGVKAVISKSFERIHRSNLVGMGIIPLCFKAGEDADSLGLTGHERYSINLPTNLSEIRPGQDVTVTTDNGKSFTCTLRFDTEVELVYFNHGGILPYVIRNLAQK

SEQ ID NO: 39933 - DNA, 739 bp, Panicum virgatum
  misc_feature: Ceres CLONE 2000418
  misc_feature: Encodes the peptide sequence at SEQ ID NO. 39934
gcctttcttccccgcaaagaaagaaacgagcagcagcagcgacgatggcgagcggcggcatgaagagggagatcagcgagacccacgacgccctccgcttcggcatcaacgccggcgtcaaggccgacctcgcgccgccgcatcctctccagtccaccatccaatcggaggccaagttctgggtggacaagaagaggttcgggacggaggctatctacggatccgccttcaacatccgcaaggatctcgatgcccaaatcctctccaggttccaaaggccccctggtgctttgccatcatctatgcttggatatgaggcactgacaggttccttggatgattttggatttgaagattatcttaacatgcctcaagattctgacagtttccgtcaacctgacatgcaccatggaatggaagttcgccttggcttgtccaagggacctatctgccctagcttcaattgatccatccatgtagttctgcagtacgttgtgcaccacacagtccagtacatcggtcaatagaccatattaccatggtgaaaagtgaaaaccgatgagccttgccacctgttcagtgttcagtgtaatgtttcagtcaacgccgaatttagttcttatcctatttgaacttacatttgatgggtggtctgcctctgaatctacgtgtttcggcttgtcgacaaaatttcacagcttgtactccacttatttgatctatgttcatgttggctaca

SEQ ID NO: 39934 - protein, 140 aa, Panicum virgatum
  misc_feature: Ceres CLONE 2000418
  misc_feature (2)..(131): Pfam Name: UMP1 Pfam Description: Proteasome maturation factor UMP1
MASGGMKREISETHDALRFGINAGVKADLAPPHPLQSTIQSEAKFWVDKKRFGTEAIYGSAFNIRKDLDAQILSRFQRPPGALPSSMLGYEALTGSLDDFGFEDYLNMPQDSDSFRQPDMHHGMEVRLGLSKGPICPSFN

SEQ ID NO: 39935 - DNA, 725 bp, Panicum virgatum
  misc_feature: Ceres CLONE 2000421
  misc_feature: Encodes the peptide sequence at SEQ ID NO. 39936
ccctaagccgagcaacgcagagaaaggcgtcttcgtactcgcctctctccgcgactcgaagctttccccccaacccccattccccaccgccgccgccgccgccgccccacccttccgtcgacaccatgagggagtgcatctcgatccacatcggtcaggccggtatccaggtcggaaacgcgtgctgggagctctactgcctcgagcatggcattcaggctgatggccagatgcctggtgacaagaccattggaggaggtgatgatgctttcaacaccttcttcagtgagactggcgctgggaagcacgtcccccgtgctgtatttgttgaccttgagcccactgtgattgatgaagtgaggactggcacttaccgccagctcttccaccctgagcagctcatcagtggcaaggaggatgctgccaacaacttcgcccgtggtcactacaccattggcaaggagattgttgacctgtgccttgaccgcatcaggaagcttgccgacaactgtactggtctccagggcttccttgtcttcaacgctgttggtggaggaacaggctctggtcttggttccctcctccttgagcgcctgtctgttgactatggcaagaagtccaagctcgggttcactgtgtacccatctccccaggtctccacttcagtggttgagccatacaacagtgtcctgttcacccattccctcctggagcacactgatgtt

SEQ ID NO: 39936 - protein, 199 aa, Panicum virgatum
  misc_feature: Ceres CLONE 2000421
  misc_feature (49)..(199): Pfam Name: Tubulin Pfam Description: Tubulin/FtsZ family, GTPase domain
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLFTHSLLEHTD

SEQ ID NO: 39937 - DNA, 544 bp, Panicum virgatum
  misc_feature: Ceres CLONE 2000428
  misc_feature: Encodes the peptide sequence at SEQ ID NO. 39938
ctctgtagcttcggcggtggggtaggtagcggaggcgtgctcgggatctcaacaccaggcgctcggctcaggtcacccgccgctccaagcatccatgtccaggaggaacaccagggagcccaacgacgagaatgtcacccttggccccccggtccgcgaaggagagattgtctttggagttgctcacatctctgcatcctccaccgataccttcattcatgttactgatctgtctgggagggaaactctggctcggatcactggtggcatgaaggtcaaggctgatcgtgatgaatcatcaccttatgctgctatgcttgcagctcacgacgtcgcacctcgtggcacggagcttggtatccctgcactgcacattaagcttcatgcgaccggactcaacaaaaccaagagtcctgggcctggtgctcattctgctcacagggctcttgctcgttctggtatgataattgggcgcattgagtatgttaccccacttcccactgacagcactcgtataaagggtggtaagaggggaaggaggttg

SEQ ID NO: 39938 - protein, 149 aa, Panicum virgatum
  misc_feature: Ceres CLONE 2000428
  misc_feature (28)..(146): Pfam Name: Ribosomal_S11 Pfam Description: Ribosomal protein S11
  misc_feature: Useful for making plants with modulated biomass
MSRRNTREPNDENVTLGPPVREGEIVFGVAHISASSTDTFIHVTDLSGRETLARITGGMKVKADRDESSPYAAMLAAHDVAPRGTELGIPALHIKLHATGLNKTKSPGPGAHSAHRALARSGMIIGRIEYVTPLPTDSTRIKGGKRGRR

SEQ ID NO: 39939 - DNA, 690 bp, Panicum virgatum
  misc_feature: Ceres CLONE 2000433
  misc_feature: Encodes the peptide sequence at SEQ ID NO. 39940
tgctccttcgagtgttcttcccttcagccctccaagtgcagtgggtacatagccccggaatatctatacagaggtgaaatctccaccatgtccgacatatatagtttagggatggttattcttgagatcacaactggagagaagaactgtgcagtttctcaagacagatctgcaagactgtttgtcgacaatgtacataaaaattggcagacagatgagcaaataataaacaagtacccatcactaaatcacaatggtctccagcaagtaagagcatgcattgtaattgggctgaagtgtgtggaggccgataggaacagaaggccttccatagttgatattgttaataagctcaatggaaaacgaaccaatttttgagtaggtctccccttttcagcaagaacgaaacatgatcgttccaaggagaaattgatatccaagatgaagtgaaacctactctatgagcagttgattacatgaattttcttcagaacaaagatcattttttttagaattcactcttcctggaaacagtgtgacactgtattattgaagtacttttctctctgttgatctcattttaaagtagaatttctgttctttcactgcatgaaaatatttgccttttttttctgaacagcatatcataagctttgtcactggaagttgttgggtttcggggctatagcc

SEQ ID NO: 39940 - protein, 125 aa, Panicum virgatum
  misc_feature: Ceres CLONE 2000433
  misc_feature: SWISSPROT Homolog: EC 2.7.11.1 Non-specific serine/threonine protein kinase
CSFECSSLQPSKCSGYIAPEYLYRGEISTMSDIYSLGMVILEITTGEKNCAVSQDRSARLFVDNVHKNWQTDEQIINKYPSLNHNGLQQVRACIVIGLKCVEADRNRRPSIVDIVNKLNGKRTNF

SEQ ID NO: 39941 - DNA, 659 bp, Panicum virgatum
  misc_feature: Ceres CLONE 2000441
  misc_feature: Encodes the peptide sequence at SEQ ID NO. 39942
atcgcccccaatccccgtgcgccgtcgccgctccctcctcccccagacccccagcgccccccaatctcgtcggcagatggacagtggcgggggcgacctgcggagcactatcaagaagtggaatgtcatctacccggtctacctcaactccaagaagacggttgctgaaggccgccgcatcgccaccagtaaggcctgccccgaccccacctgcatcgagatcgccgactgctgctcccacctcaagatcccccacgccatcgagctggataaggcgtaccctcgggatttcttccaggtggggagggtcagggtgcagctcaagaaggatgacggctcccctgtcaatcctgctattaagacgaagaagcagctgatgatccaaatagcagagctagttcccaagcatcacggaaggacaaagaagcaggaatcagcgcccagctcttcaactggtggcagttcgaagaacacaaaaggtgggaaaaagaaaaagtgatggcagtatcatcttgttgcgtttttctgttcatccccgtaccaagtttatgtggaagttgtgtccttttgaggcctgaaaatcattgtgacttgtgggattttgatccatttgaaaatttccatacatattgttcttgtagtatccagattttgatgtg

SEQ ID NO: 39942 - protein, 140 aa, Panicum virgatum
  misc_feature: Ceres CLONE 2000441
  misc_feature (16)..(112): Pfam Name: SRP19 Pfam Description: SRP19 protein
MDSGGGDLRSTIKKWNVIYPVYLNSKKTVAEGRRIATSKACPDPTCIEIADCCSHLKIPHAIELDKAYPRDFFQVGRVRVQLKKDDGSPVNPAIKTKKQLMIQIAELVPKHHGRTKKQESAPSSSTGGSSKNTKGGKKKK

SEQ ID NO: 39943 - DNA, 668 bp, Panicum virgatum
  misc_feature: Ceres CLONE 2000448
  misc_feature: Encodes the peptide sequence at SEQ ID NO. 39944
ggcggccgccgcaccgctcccccccccaccccccacacacacacacacacacatggcgtccctcttcaaggacccgagcaagctgtcggcgtacagggaccggcggttcccggggacgcaggaggagtacgaggcggcgctgcaggcgtcgacgacggtgtacatcgggaacatgtccttctacaccacggaggagcaggcctacgagctcttctcccgcgccggcgagatcaagaagatcatcatggggctcgacaagaactccaagaccccctgcggcttctgcttcgtactgtactactccagggaggatgctgaagatgctgtcaaatatattagcggaacaatgcttgatgatcgtccaatccgtgttgattttgattggggctttgaagaaggcaggcagtggggccgtggacggagtggcggtcaagtcagagatgagtaccggacagattatgatccaggaagaggtggttatggtaagatggttcagaaggagctagaagcacaaagagaattagttgactatggtggatcttttcaaccaaatgctccacctccatacgagagaggcgaacgcaagagaggatatggagactcgtacaggaatgacagaggagattaccaacggaaacgctaccggaatgatgatcggcctgcggctg

SEQ ID NO: 39944 - protein, 205 aa, Panicum virgatum
  misc_feature: Ceres CLONE 2000448
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated water use efficiency
MASLFKDPSKLSAYRDRRFPGTQEEYEAALQASTTVYIGNMSFYTTEEQAYELFSRAGEIKKIIMGLDKNSKTPCGFCFVLYYSREDAEDAVKYISGTMLDDRPIRVDFDWGFEEGRQWGRGRSGGQVRDEYRTDYDPGRGGYGKMVQKELEAQRELVDYGGSFQPNAPPPYERGERKRGYGDSYRNDRGDYQRKRYRNDDRPAA

SEQ ID NO: 39945 - DNA, 688 bp, Panicum virgatum
  misc_feature: Ceres CLONE 2000449
  misc_feature: Encodes the peptide sequence at SEQ ID NO. 39946
agggattgcatcgcatctcctctcgctctctgttgtgtgactgattgccaagaacgctctctgcttgcttgtgttccagcctctgaatctcgtgaggatgtcgtgctgcggaggcaactgcgggtgcggctccggctgcggagggtgcaagatgtacccggacatgactgagcagggcaccaccaccaccagccagactgtcatcatgggcgttgcaccaaccaacaaggggcacgccgagggcggatttgaggccggcgccggagccgagaacggctgcaagtgcggtgccaactgcacctgcaacccctgcacctgcaagtgaggagctcatggccatggccggaccggaggagatctgcagctagtatagcggcgttgtgtgtgcgtcgttcgtttgtctgaaagtgtgtgtggcatgcttaataacggtgttgcgcgtgctgctagtagatggtactgatggggaacaataataatgatggtgctgagatgtcgtcggcgtcgccgccgccgtcgtgtccttcctccccggccggtcgggcacctgtggcggtgctctagcagtgtgttgtgtgtgcagcaggccatgctctgatctttgtggtgtatgtgtgcggcctgctgcttagtgtccctagtgtcatgtgtaaccatccatctatatctatctacatccatcttgtgt

SEQ ID NO: 39946 - protein, 75 aa, Panicum virgatum
  misc_feature: Ceres CLONE 2000449
  misc_feature (1)..(74): Pfam Name: Metallothio_2 Pfam Description: Metallothionein
MSCCGGNCGCGSGCGGCKMYPDMTEQGTTTTSQTVIMGVAPTNKGHAEGGFEAGAGAENGCKCGANCTCNPCTCK

SEQ ID NO: 39947 - DNA, 628 bp, Panicum virgatum
  misc_feature: Ceres CLONE 2000454
  misc_feature: Encodes the peptide sequence at SEQ ID NO. 39948
ggccaccccatctcccatcgcgtgtttcctgacgccaccgcctgtatttatctaccgccgttgcccatcgggagtcttccattccgtcgatcccgtcgagctccggatcccgcgtcccctgcgcgcctcgctctccggagagatctctacacttcttccctcgcgcgatggcccagactgttgtactcagggttggcatgtcctgtgaaggctgtgttggagctgttaagcgagttctgggcaaaatggaaggtgttgaatcttacgatgtagacatcaaggagcagaaggtcacggtgaagggtaacgtaacacctgatgcagtactgcagactgtttccaagacaggcaaaaagacttcattctgggatgctgagcctgcaaccaaccaatccacagcacctgctgatgctactgcttgacaagttggatgtaacaaattccagtgtaattttctggtaaaactacaaatgtgtggggtcttatggtatttagcttcacaatattacaaataatgccagactgctattaaaatttgtacatcctgaatgcccgctattcctagcctgaggtttaaacagtttgggatgtaatggagaattgcttgtatgatatttgacatgttttg

SEQ ID NO: 39948 - protein, 84 aa, Panicum virgatum
  misc_feature: Ceres CLONE 2000454
  misc_feature (6)..(66): Pfam Name: HMA Pfam Description: Heavy-metal-associated domain
  misc_feature: SWISSPROT Homolog: EC 3.6.3.4 Copper-exporting ATPase
MAQTVVLRVGMSCEGCVGAVKRVLGKMEGVESYDVDIKEQKVTVKGNVTPDAVLQTVSKTGKKTSFWDAEPATNQSTAPADATA

SEQ ID NO: 39949 - DNA, 942 bp, Panicum virgatum
  misc_feature: Ceres CLONE 2000466
  misc_feature: Encodes the peptide sequence at SEQ ID NO. 39950
aactaacgctaaaaaagtaacagtttctgtactttattgccggcgtcgtctcctccgccctacctctcatctttccaccgccaacacacacacgcacaacatgggtttcctcgatagcaatctccgttacccgtcggtccagaaggagcgctctgcccacaagcgcaagcgccttgtgcagggccccaactcgtacttcatggacgtcaagtgccccaagtgcttcggtcttaccaccgtgtacagccacgcgaccactcaggtcacgtgccaggggtgcgctcaggtgctcaccaagaccaccggcggcaagtgcatgctcaccgagggctgctctttccgcaagaagccggagcactaaaaaagtccacgaggaagcgaaacggagtacacggccgtctcgtcgaaggaccagtgcgtgtctgcacataaagtctggctacaatgcaatgcacaactacttccaccccagacaccggagacggttgtctttgcggagtgtgggggaataactgtgcgacgccagcagcaaacacgagtggtggcagggaaaagaagcgtgaagggtccacaatgtaatgtgaaagagacgattgcacacccccttggctgcgaaccctctttgtgttgtgcagccccccgggggcggcgacaaacatccataacattttgcgtggtttccatcctttcactttctcaaacgcggccttttgccaaaaacggaccaccatcacggctcacactaaactcggcggctcattcgctgctgaaatgcgcgaggaatatacgatcattaaaagaccatctttttcctcaacgcgcggttcctcacaccggctcctccacttctctcctacgttctgttctaattcacacacacacacgcgtcttacggagacgtttttggcaattgtgcgcgcttttaactcttttcgccggcgg

SEQ ID NO: 39950 - protein, 86 aa, Panicum virgatum
  misc_feature: Ceres CLONE 2000466
  misc_feature (29)..(83): Pfam Name: Ribosomal_S27e Pfam Description: Ribosomal protein S27
MGFLDSNLRYPSVQKERSAHKRKRLVQGPNSYFMDVKCPKCFGLTTVYSHATTQVTCQGCAQVLTKTTGGKCMLTEGCSFRKKPEH

SEQ ID NO: 39951 - DNA, 731 bp, Panicum virgatum
  misc_feature: Ceres CLONE 2000491
  misc_feature: Encodes the peptide sequence at SEQ ID NO. 39952
gatatgcacccaccagcagcaactaacgatacgccatggccgccgccgtgcccctcctccttttgctggccgccgccgccgccgcctcgccggcggcgggcggcggcaagcagacgcacatcaagctgtactttcacgacgtgctgagcgagccgagcccgacggcggtgcgggtggcgcgcgccgccgtcaccaacacctccaagacgagcttcggcctcgtgacgatcatcgacgacccgctcaccgagggccccgacctcaactcctccacgcccctcggccgcgcccagggcacctacatcgccgccggcaaggacgaggtggccctgctcatgaacatgaacttcgtcttccaggccggcacgtacaacggcagcaccgtcgccatcatgggccggaacccggtgttcgacgccgtccgggagatggccgtcatcgggggcaccggcgtgttcaggatggcgcgagggtacgcgcaggccaggacgcacaccttcgacctcaagagcggcgacgccaccgtcgagtaccacctctacatcaaccactgatcgatcgtccgagtgctctgctccactccatccaccgctgtccagtgtcatcaggcgccgcaactaccgcacttggtttccatcgtttcaaccacactgcactttgttttacatcctataaattgatttgccaaacacatccattaccaaatgatgtgtgatgatttgggttgttgg

SEQ ID NO: 39952 - protein, 172 aa, Panicum virgatum
  misc_feature: Ceres CLONE 2000491
  misc_feature (7)..(172): Pfam Name: Dirigent Pfam Description: Dirigent-like protein
MAAAVPLLLLLAAAAAASPAAGGGKQTHIKLYFHDVLSEPSPTAVRVARAAVTNTSKTSFGLVTIIDDPLTEGPDLNSSTPLGRAQGTYIAAGKDEVALLMNMNFVFQAGTYNGSTVAIMGRNPVFDAVREMAVIGGTGVFRMARGYAQARTHTFDLKSGDATVEYHLYINH

SEQ ID NO: 39953 - DNA, 739 bp, Panicum virgatum
  misc_feature: Ceres CLONE 2000500
  misc_feature: Encodes the peptide sequence at SEQ ID NO. 39954
agtctgctccgtgtcaacagcgacgccgcgccggcaggaaccctccctgcctccgccttctcctttcctgctttcctcgtccccgtctcgatctgcccgcccgcccgcccgctccacgcgccgacgcgcgaaatccgcagaccggccctaccctccccgcaccgcctcgccgtccttcctctccctgattccccagccagatcggagctgcggggtcgtcacggttgctgcagcccgtcagttttcagtaagcatctttgggacatcaagtttgctgttattttagaagaggaaatatgcaggcatcaagagctaggcttttcaaggagtacaaggaggtgcagcgagagaaatcagctgaccctgatattcagttgatttgtgatgattcaaacatattcaagtggactgctctcatcaagggaccctcggagactccttatgaaggtggtgtcttccagcttgcctttgctattccagagcaataccctctgctacctccccaagttcgcttcctgactaaaattttccatccaaatgttcatttcaagactggtgaaatttgcttggatatcttgaagaatgcatggagccctgcatggaccctccaatcagtttgtagagccataattgcactgatggctcatccggagccagacagcccacttaactgtgactcaggcaatctcctacgatctggcgacatcagagggtttcagtcaatggccagaatgtacat

SEQ ID NO: 39954 - protein, 147 aa, Panicum virgatum
  misc_feature: Ceres CLONE 2000500
  misc_feature (7)..(146): Pfam Name: UQ_con Pfam Description: Ubiquitin-conjugating enzyme
  misc_feature: SWISSPROT Homolog: EC 6.3.2.19 Ubiquitin--protein ligase
MQASRARLFKEYKEVQREKSADPDIQLICDDSNIFKWTALIKGPSETPYEGGVFQLAFAIPEQYPLLPPQVRFLTKIFHPNVHFKTGEICLDILKNAWSPAWTLQSVCRAIIALMAHPEPDSPLNCDSGNLLRSGDIRGFQSMARMY

SEQ ID NO: 39955 - DNA, 697 bp, Panicum virgatum
  misc_feature: Ceres CLONE 2000510
  misc_feature: Encodes the peptide sequence at SEQ ID NO. 39956
aacttttcctcctccccgtcctctccgctcgggcgaaacccccaaaccctcccctcccccaccccgcggccgatccacccgtcggcgatgacgctgggcagctccggcgccggatcgagcgtcgtcgttcctaggaacttcaggctattggaagagcttgagcgtggagagaagggcattggtgatgggacagtgagctatggaatggatgatgcagatgatatctacatgaggtcatggactggtaccatcattggccctcacaatactgtacatgagggtcgcatctaccagcttaagttgttctgtgacaaggattatcctgagaagccaccatctgtcagattccattcaagaatcaacatgacatgtgttaatcacgagacaggagtggttgatccaaagaagtttggtctgctggcaaactggcagcgggactacacaatggaaaacatcctaatccagctcaagaaggagatggctgcctcacacaatcgcaagctagtgcagcctccggaagggacattcttctaaagaagaattgggtggcccatcttgggattcaacaacagttactgaagttgtttaaatgggggggaaaacaacttctacatctggtgcctgtgcttgtgttttcaagtttcttatgctatgttcttcaatctgtgaacagctgtgaacaatcgaagtatctccc

SEQ ID NO: 39956 - protein, 148 aa, Panicum virgatum
  misc_feature: Ceres CLONE 2000510
  misc_feature (19)..(140): Pfam Name: UQ_con Pfam Description: Ubiquitin-conjugating enzyme
  misc_feature: SWISSPROT Homolog: EC 6.3.2.19 Ubiquitin--protein ligase
MTLGSSGAGSSVVVPRNFRLLEELERGEKGIGDGTVSYGMDDADDIYMRSWTGTIIGPHNTVHEGRIYQLKLFCDKDYPEKPPSVRFHSRINMTCVNHETGVVDPKKFGLLANWQRDYTMENILIQLKKEMAASHNRKLVQPPEGTFF

SEQ ID NO: 39957 - DNA, 817 bp, Panicum virgatum
  misc_feature: Ceres CLONE 2000526
  misc_feature: Encodes the peptide sequence at SEQ ID NO. 39958
actgctcgagatcagctcaagaaccaccatggcgcctctcctccgccctctcgtccttgcgctcctgatcgcgtcctgcgccgcgcagcaggcgccgccggcgcagcccccgccgacgccgaacgcgccgccgtccaactccccaccgcaggcgccacccgccggcaacccgccgccggcgccgcaggcacctccggccggcaaccctcctccggctcccaccgccacccctcctccggctccgaccactcctcctccagcgcccaccactcctcctccggcgcccaccacgccgcctccggctccaaccacccctcctccagcgcccaccacgccgccgccgtcgccgccggcgagcccgccaccggctccgaccaccccgccgccgtctcccccggcgaccccgccacccgctcccgccaccccgcctccgtctccgcccatggcgccgcctccggccacgcctccgcccccggccaccccgccgccagccgcgcccactccggcgccgagcgccgccccgacgctccctcccgtggcgacgccggctctgtctccgaagagccccaagaccccgagccccgccgccgcgacgtccccggcgccggcgatctcgcccgcgggctcgacgacgaacgaagactccggcgcgagcgcgcgcgcggctggattcgccaccgtcgtggcattggcgggcgcgggactcgccgtcctgctttgagtagtagatcgatctcctcctcctcctcccgttgatgttgtcatatccctccctccccgtgcctcgacgacgttgctgctccatttccgttttttt

SEQ ID NO: 39958 - protein, 230 aa, Panicum virgatum
  misc_feature: Ceres CLONE 2000526
  misc_feature: Useful for making plants with altered cell wall content and/or composition
MAPLLRPLVLALLIASCAAQQAPPAQPPPTPNAPPSNSPPQAPPAGNPPPAPQAPPAGNPPPAPTATPPPAPTTPPPAPTTPPPAPTTPPPAPTTPPPAPTTPPPSPPASPPPAPTTPPPSPPATPPPAPATPPPSPPMAPPPATPPPPATPPPAAPTPAPSAAPTLPPVATPALSPKSPKTPSPAAATSPAPAISPAGSTTNEDSGASARAAGFATVVALAGAGLAVLL

SEQ ID NO: 39959 - DNA, 801 bp, Panicum virgatum
  misc_feature: Ceres CLONE 2000529
  misc_feature: Encodes the peptide sequence at SEQ ID NO. 39960
aactggctcctaggttatgttgttgtcattgtcatcaatattatttgccttccagactcctactgttatttattgtgcccttatttactttattttgctttgttgcagattgcgttttggaagaaagccaacctaatctttctgtttttcctgctacggaagctcatattacctttctactccttcacgctcttctgcatcatcctcccgatgacaatgtttgtgcctgaagctgagcttcctgattgggttgtgtgctacattccggccctgatgtccttgctcaacatccttccttctccaaagtcattccctttcatcatcccatacctgctcttcgagaacaccatgtcggtgacaaagttcaacgcgatgatctctggcctgttccagcttggaagcgcgtacgagtgggtggtgaccaagaaatcaggccgctcatcggagggcgatctcatttccctggcaccacccaaggagctgagacaccaaaagacgggctcggcgcctaacctcgacacggttgcaaaggagcagcttgcttcgaaaaaggacgcgaagaagaagcacaaccggatatacaagaaggagctggcgctctcgatgctcctgctaacggccgcggcccggagcttgctgtcgaagcagggtatacacttttacttcctcctgttccagggcatctccttcttgttagtaggccttgacctcataggcgagcaggtcgagtaaaccgtgtaaacagcaattgatagatgtgaaaagcagtggggattgctgcaagggatgtgtgttactgtc

SEQ ID NO: 39960 - protein, 243 aa, Panicum virgatum
  misc_feature: Ceres CLONE 2000529
  misc_feature: Useful for making plants with altered carbohydrate content
  misc_feature: Useful for making plants with altered cell wall content and/or composition
NWLLGYVVVIVINIICLPDSYCYLLCPYLLYFALLQIAFWKKANLIFLFFLLRKLILPFYSFTLFCIILPMTMFVPEAELPDWVVCYIPALMSLLNILPSPKSFPFIIPYLLFENTMSVTKFNAMISGLFQLGSAYEWVVTKKSGRSSEGDLISLAPPKELRHQKTGSAPNLDTVAKEQLASKKDAKKKHNRIYKKELALSMLLLTAAARSLLSKQGIHFYFLLFQGISFLLVGLDLIGEQVE

SEQ ID NO: 39961 - DNA, 710 bp, Panicum virgatum
  misc_feature: Ceres CLONE 2000533
  misc_feature: Encodes the peptide sequence at SEQ ID NO. 39962
tgcgccggcggcggcgaaccatgtctcgtcggcggccagaaatgggtatcttgctcgccaggagtttggctcttctcgctctcctctgcctgcttcttccgtgccatgggaagctctcgaccaagttctacgccaagtcgtgccccggcgtggccaccatcgtgcggtcggcgatggcgcaggccgtcgccaaggagccccggatgggcgcgtccatcatccggctcttcttccacgactgcttcgtcaatgggtgtgacgcgtccatccttctggacgacacgccgacgttcaccggcgagaagaacgccggcgccaactccaactccgtccgcgggtacgaggtgatcgacgccatcaagacgcaggtcgaagccgcctgcaagggcatcgtctcgtgcgccgacatcgtcgccctggcatctcgcgacgccgtgaacttgctcgggggcccgacgtggaacgtgcagctcggccggaaggactcgcgcacggcgagccagagcgccgccaacgccaacctcccgggcccgggctccagcgcggcgtccctcgtctcggcgttcgcggccaagggcctctcggcgcgcgacatgacggcgctctccggcgcgcacaccgtggggcgggcgcgctgcctcttcttccgcggccgcatctacacggagcccaacatcaacgccaccttcgcggcggcgcggcggcaggcg

SEQ ID NO: 39962 - protein, 222 aa, Panicum virgatum
  misc_feature: Ceres CLONE 2000533
  misc_feature (41)..(222): Pfam Name: peroxidase Pfam Description: Peroxidase
  misc_feature: SWISSPROT Homolog: EC 1.11.1.7 Peroxidase
  misc_feature: Useful for making plants with altered cell wall content and/or composition
  misc_feature: Useful for making plants with altered carbohydrate content
MGILLARSLALLALLCLLLPCHGKLSTKFYAKSCPGVATIVRSAMAQAVAKEPRMGASIIRLFFHDCFVNGCDASILLDDTPTFTGEKNAGANSNSVRGYEVIDAIKTQVEAACKGIVSCADIVALASRDAVNLLGGPTWNVQLGRKDSRTASQSAANANLPGPGSSAASLVSAFAAKGLSARDMTALSGAHTVGRARCLFFRGRIYTEPNINATFAAARRQ

SEQ ID NO: 39963 - DNA, 720 bp, Panicum virgatum
  misc_feature: Ceres CLONE 2000545
  misc_feature: Encodes the peptide sequence at SEQ ID NO. 39964
agttcaggcctttcatcagactggtggcgcatttgcataccttcctgcgttgctcgtacgcaaccttccccttccccggtcggttagccccactttgcccgaccgttcagcattctaacaggtgtaggggagatcggcagcattcgtgctccttgcgggctgcctgcaaatttgcttgctagggtttggtcggtggactgtgggctctgcaggatcccggaattgcatccgcgccgagggccatggtgggaaggcataccatcattctcatgcaaccatcgcagaacagagctacgaggacatttatggatttcgattcagttaaccatgcactggatggaatctgtggcctctatgaaaggaaaatcaggaacatcaacccgatggtcatgaacttgacttatgatatcagtgacctgtacaatttcattgatggcctgatcgacataagcgcactggtgttcgacgattccctccatgctttcctgccatatgaccgccagtggataaaacagaagctgtttcagcacctgaagaggctggctgaacagtagagcatggtcaccgctggttttcggcagcgcacacgtcgaggacgaaggtgccaggctggttcgaaattcctggcatgttgtgtaaaggtctatctggcactctggcagtgtagtgtttgacgtgaaccatgtggtttgcacggcgatcaggcactgtattgtgacc

SEQ ID NO: 39964 - protein, 103 aa, Panicum virgatum
  misc_feature: Ceres CLONE 2000545
  misc_feature (3)..(103): Pfam Name: ER Pfam Description: Enhancer of rudimentary
MVGRHTIILMQPSQNRATRTFMDFDSVNHALDGICGLYERKIRNINPMVMNLTYDISDLYNFIDGLIDISALVFDDSLHAFLPYDRQWIKQKLFQHLKRLAEQ

SEQ ID NO: 39965 - DNA, 686 bp, Panicum virgatum
  misc_feature: Ceres CLONE 2000548
  misc_feature: Encodes the peptide sequence at SEQ ID NO. 39966
cattccactccgtccatccatccatccgccatggcgaccgccacgctgctgagctccgccttcgccatgcccgccgccgcccggagggcctcctcctccacctccctaggcttcgccacgtcgcagctcgccggcctctccctctccgccgccgcgcccgcttcaaccgccgcggcccccctcctcaagaggccgatccagcccatcgtcgcgcgccgggtgtgccccttcactgacaagaagacgaaccgggcgaacaaggtgtccttctccaaccacaagaccaagaagcagcagttcgtgaacctgcagtacaagaagctgtggtgggaggccggcaagcgcttcgtcaagctgcgcctctccaccaaggccctcaagaccatcgagaagcacagcctcgacgccgtcgcgcgcaaggccggcatcgacctcaacaagaagtgagccgagcttgagtagtcgagccggtggcggcggtatggtcaggccgagcaatctcgcgaacagatgccactagcttagtctcgtctgtctcaatttctgctgctgctgctgctgctcattcagtcatacagtatttttcctttcctccctaatttgatttgcatccaaccaatgtaggcacatcgaggttgcatatatttttattctgtggaaagagttgatgtttcttcctcttgatc

SEQ ID NO: 39966 - protein, 138 aa, Panicum virgatum
  misc_feature: Ceres CLONE 2000548
  misc_feature (63)..(123): Pfam Name: Ribosomal_L28 Pfam Description: Ribosomal L28 family
MATATLLSSAFAMPAAARRASSSTSLGFATSQLAGLSLSAAAPASTAAAPLLKRPIQPIVARRVCPFTDKKTNRANKVSFSNHKTKKQQFVNLQYKKLWWEAGKRFVKLRLSTKALKTIEKHSLDAVARKAGIDLNKK

SEQ ID NO: 39967 - DNA, 849 bp, Panicum virgatum
  misc_feature: Ceres CLONE 2000553
  misc_feature: Encodes the peptide sequence at SEQ ID NO. 39968
ctccgccgcctgcaacgggaccctagcactggtggctgcccattctgcgaccccgccgccggcagccccagcccttcgctcccagaacccttcgcccccacttcccgcttcgctcgtggttccatctgaagcgagacgcagccatggccgcaggtggtgagccgactaactttcagaaggagcagatgtttggaatggcagagaaagagatggagtacagggttgatatgttcaatcggcttacacagacatgttttgacaagtgcattgcgaacaggcacaaagaagttgagctcaatatgggtgagaacagctgcattgatcgatgtgtttccaagtattggcaggtgacttctctagttggacagcttcttggaaatgcccccaagtgagatgtaatttcgttttgtggtggaagtcttcgattttggctccaaggtttgacggattactaagtaaaccaggactagagaagttacatttttcgatctttagccccgaactttcggcacttggacaacgagcaccggtaccaaattctgcatgtaccgtgcgttttgagcttggaaagcaagatggcatctactcttatccgggcaaactcagccttactgagaatgagaagatgagctatgtttccagcattttacataactggtcttcccctgttcctagttgcatacctatttgtgtccttggcgtactgtagatgctgtcgtttttgtatcgtgggcatattatgtgtgccgccatggtgtctagctgtcttgagtttgatgctggattaaacaacgagcaccagaatttgcacgttgttaatttacaaaatggtggttttaaccttgattc

SEQ ID NO: 39968 - protein, 82 aa, Panicum virgatum
  misc_feature: Ceres CLONE 2000553
  misc_feature (14)..(80): Pfam Name: zf-Tim10_DDP Pfam Description: Tim10/DDP family zinc finger
MAAGGEPTNFQKEQMFGMAEKEMEYRVDMFNRLTQTCFDKCIANRHKEVELNMGENSCIDRCVSKYWQVTSLVGQLLGNAPK

SEQ ID NO: 39969 - DNA, 550 bp, Panicum virgatum
  misc_feature: Ceres CLONE 2000555
  misc_feature: Encodes the peptide sequence at SEQ ID NO. 39970
aaaaaaaaaaaaaaccccaaatatctcgccccgtcagcagcttcacgcacagcacagggagaaaaaggccggctagcgatggctgccaaggccgtctccttcctggtgctcgcgctcctgctcctcgccgtcgcggcgttccccgtggtggtcgtggccggcggcggcaacggcaaaggcaaagggaacggctacgggaatgggaacgggaacgggaacggcggcggcggcaacctgaagccgtgggagtgctcgcccaagtgcgcgtcgcggtgctccaacacgcagtacaagaaggcctgcctcaccttctgcaacaagtgctgcgccacgtgcctctgcgtgcccccggggttctacggcaacaagggcgcctgcccctgctacaacaactggaagaccaaggagggagggcccaagtgcccctagatcagatcagatcccggccgccattgttcctgctcctcctccgttggccgctgctgtcaagatccaccggcttacttacttactgatgatcccggcactgttcgtgctctgttctccccct

SEQ ID NO: 39970 - protein, 116 aa, Panicum virgatum
  misc_feature: Ceres CLONE 2000555
  misc_feature (3)..(116): Pfam Name: GASA Pfam Description: Gibberellin regulated protein
MAAKAVSFLVLALLLLAVAAFPVVVVAGGGNGKGKGNGYGNGNGNGNGGGGNLKPWECSPKCASRCSNTQYKKACLTFCNKCCATCLCVPPGFYGNKGACPCYNNWKTKEGGPKCP

SEQ ID NO: 39971 - DNA, 730 bp, Panicum virgatum
  misc_feature: Ceres CLONE 2000592
  misc_feature: Encodes the peptide sequence at SEQ ID NO. 39972
tacatgaatataagcggcagttgctaaatatccttggaatcgtctaccgctacaagaagatgaaagaaatgagtgcagaagaaagagtaaagaggtttgttccaagggtatgcatatttggtgggaaagcatttgcaacatatatacaggcaaaaaggattgttaaatttattacagatgttgcagctactgtgaaccatgattcagacattggagatctgttaaaggttatatttgttccagattataatgtaagcgttgctgaggcgctcattcctgccagtgaattgtcccagcacatcagtactgctggaatggaagctagtgggacaagcaacatgaagtttgcaatgaatggctgcattcttattggtactttagatggtgcgaatgtggaaatcagtgaggaggttggagaggaaaactttttcctttttggtgcagaggcacatgaaattgtgggtttgcggaaagagagagctgagggaaagtttgtgcctgacccaagatttcaagaggttaaggaatttgtccgcagtggtgtctttgggacttacaactatgatgaattgatgggttctttggaaggaaatgaaggttatggacgagcagattatttcctagttggtaaggatttccccagttatattgaatgccaggaaaaagttgatgaagcttaccgagatcagaaactatggacaaagatgtctatcctcaacacagctggcct

SEQ ID NO: 39972 - protein, 242 aa, Panicum virgatum
  misc_feature: Ceres CLONE 2000592
  misc_feature (1)..(242): Pfam Name: Phosphorylase Pfam Description: Carbohydrate phosphorylase
  misc_feature: SWISSPROT Homolog: EC 2.4.1.1 Phosphorylase
HEYKRQLLNILGIVYRYKKMKEMSAEERVKRFVPRVCIFGGKAFATYIQAKRIVKFITDVAATVNHDSDIGDLLKVIFVPDYNVSVAEALIPASELSQHISTAGMEASGTSNMKFAMNGCILIGTLDGANVEISEEVGEENFFLFGAEAHEIVGLRKERAEGKFVPDPRFQEVKEFVRSGVFGTYNYDELMGSLEGNEGYGRADYFLVGKDFPSYIECQEKVDEAYRDQKLWTKMSILNTAG

SEQ ID NO: 39973 - DNA, 713 bp, Panicum virgatum
  misc_feature: Ceres CLONE 2000595
  misc_feature: Encodes the peptide sequence at SEQ ID NO. 39974
aatctccggcctcaaatcccccgccagcgccagcgccgccccgcaccgtttccggcgatctcgtgggcccctcggaaggaaggaagggacgagagaagatgagttccggcgccggcaggggcaagcccaagggcaccaaggcggtgtcgcggtcgtccaaggccggcctgcagttccccgtcggccgcgtcgcgcgctacctcaagacgggcaagtacgccgagcgcgtcggcggcggcgcgcccgtctacctctccgccgtcctcgagtacctagccgcggaggtgctggagctggccggcaacgcgtcgcgcgacaacaagaagaaccggatcgtgccgcgccacatccagctcgccgtgcgcaacgacgaggagctcagcaagctgctcggcaccgtcaccatcgccgccggaggggtgctgcccaacatccaccagacgctgctgcccaagaaggccggcggcaagggcaaggccgacatcggctccgcctcccaggagttctagccgccgatgcggctttagtcggagccgccgatgcggcggcttcttcttggttcactagtagttctagtgtctcgcctaggctaggataggttttgcaatggatggcttatcgggggaagtttgctgtatctatcaatcaatcaatcttgctggaatggatgaaatggtcggtcgctgctgcttgcaatggttctgtgatctttc

SEQ ID NO: 39974 - protein, 136 aa, Panicum virgatum
  misc_feature: Ceres CLONE 2000595
  misc_feature (18)..(91): Pfam Name: Histone Pfam Description: Core histone H2A/H2B/H3/H4
MSSGAGRGKPKGTKAVSRSSKAGLQFPVGRVARYLKTGKYAERVGGGAPVYLSAVLEYLAAEVLELAGNASRDNKKNRIVPRHIQLAVRNDEELSKLLGTVTIAAGGVLPNIHQTLLPKKAGGKGKADIGSASQEF

SEQ ID NO: 39975 - DNA, 662 bp, Panicum virgatum
  misc_feature: Ceres CLONE 2000601
  misc_feature: Encodes the peptide sequence at SEQ ID NO. 39976
gatcctcacatcatccacctccgcagagcttcacgcattgcacggggagcagaggaaaccatctcccagactcccagcggcagcggcggagaaagctagcgcccaaacccaatccacctagctatctagcgagataggcatggcgcgctgggccattgcgatccatggcggcgcgggcgtggacccgaacctgccggagagccgccaggaggaggccaagcgcgtgctggcgcggtgcctgcaggccggcgtggacatgctgcgcgcgggggcctcggcgctcgacgtcgtcgaggccgtggtgcgcgagctcgagaccgaccccttcttcaactccggccgcggctccgcgctcacccgccgcggcaccgtcgagatggaggccagcatcatggacggccgcggccgccgctgcggcgccgtgtccggcgtctccaccgtcaagaaccccgtctccctggcgcgccgcgtcatggacaagtcgccgcactcgtacctcgccttcgacggcgccgaggagttcgcccgcgagcagggccttgagaccgtggacaacagctacttcatcaccgaggacaacgtcggcatgctcaagctcgccaaggaggcaggcagcatcctggtccgttcgtcgctcactcgaatgaccactcatttcaact

SEQ ID NO: 39976 - protein, 174 aa, Panicum virgatum
  misc_feature: Ceres CLONE 2000601
  misc_feature (2)..(174): Pfam Name: Asparaginase_2 Pfam Description: Asparaginase
  misc_feature: SWISSPROT Homolog: EC 3.5.1.1 Asparaginase
MARWAIAIHGGAGVDPNLPESRQEEAKRVLARCLQAGVDMLRAGASALDVVEAVVRELETDPFFNSGRGSALTRRGTVEMEASIMDGRGRRCGAVSGVSTVKNPVSLARRVMDKSPHSYLAFDGAEEFAREQGLETVDNSYFITEDNVGMLKLAKEAGSILVRSSLTRMTTHFN

SEQ ID NO: 39977 - DNA, 650 bp, Panicum virgatum
  misc_feature: Ceres CLONE 2000602
  misc_feature: Encodes the peptide sequence at SEQ ID NO. 39978
tgattggctcacctcctctgaccaacaaatctccaatccgagcagcacccattcccaaatcccaagcatcatccctttttccctcctgcaaagagggataccattcagctcatcaggcgctcagctcatcccagctccaccaccaagaataagatctgaagcagccaggcaggagctggtgccagctctgcagtcaagcaggctctcccgctcgcaagcagccagcggtcaagccggtcagcagccatgagtaccatgaagttttgccgtgaatggtaagcccctgactgacgacgacggcgctggcgctggtgctcttttgccttcttcagctgggggttcggtagtgaccatgtcctttcttggcagcaacaacatcctgtaccccaaggaggacagggagcagaaggtgctcctctacgcctgccggaactgcgaccaccaggaggttgcggacaacaactgcgtgtaccggaacgtggtgcaccacagcgccggcgagttcacccaggtgctccaggacgtggccggcgaccccacgctgccccgcaccaaggacgtgcgctgcgccgtttgcggccacggcgaggccgtcttcttccaggccaccgcgaggggtgaggaggggatgacgctcttcttcgtctgct

SEQ ID NO: 39978 - protein, 99 aa, Panicum virgatum
  misc_feature: Ceres CLONE 2000602
  misc_feature (1)..(54): Pfam Name: RNA_POL_M_15KD Pfam Description: RNA polymerases M/15 Kd subunit
  misc_feature: SWISSPROT Homolog: EC 2.7.7.6 DNA-directed RNA polymerase
  misc_feature: Useful for making plants with altered lignin content
MSFLGSNNILYPKEDREQKVLLYACRNCDHQEVADNNCVYRNVVHHSAGEFTQVLQDVAGDPTLPRTKDVRCAVCGHGEAVFFQATARGEEGMTLFFVC

SEQ ID NO: 39979 - DNA, 1092 bp, Panicum virgatum
  misc_feature: Ceres CLONE 2000622
  misc_feature: Encodes the peptide sequence at SEQ ID NO. 39980
ttttgatgtgattgcctcttctgtttgcttcctggatccaaccgccgtctcttctctttgcttcctggatccaaccgccgccgccgcggctgcctactctcgtcggcgtctcaagagttgttggattggatgcgttcttcttcctagatcggagcaagactcgcggtgtaaatctcgagaggaggaaggggatcgaggcggctcggttcttgttgttgccgcgtccggttctctcaagaaccagcggcgaggatggatctctgcggcaagagagaggacatggcgctgcaaggcggggattcctgcctcacgccccgcgcttcgcggggcgggcggggcggctgcgagatggagtcgcggtgggcagagggcctcctcgaaggtggtggccggaagcgccgcgtgccggaggaatccgaggacgatgtccaggaaatggatgaggtggattgcggcggcaagcggagcaagccgccgtcgccgcagccgcacacaccggacatccgtgaggctcatgcccccggccgccgccgcatcgcggtggccggcagtggggttaacctcataggagaaatcggccgggacctgtccatcaactgcctcctccggctgtcccgggcagaatatggctcggttgcgtcgttgaaccgggatttccggtctctggtgcgtggaggggagatttacaggctgcggcggcagaataacatctctgagcattgggtgtacttctcctgcaatgttctggagtgggatgcatatgacccctaccgggagcgttggatgacagtgcccaagatgccgcatgacgagtgcttcatgtgctcggacaaggagtctttggctgtgggtaccgagctgcttgtatttgggatggcacacattgtcttcagatacagcatactgacaaactcttggacacgaggcgaggtgatgaattcgccgcggtgtctgtttgggtcagcaagcattggagagaaggcatatgttgctggtggcactgattctcttggcaggatcctcagctcagcagagctatacaactctgaaacacacacctggacaccccttcctagcatgaacagggcacgg

SEQ ID NO: 39980 - protein, 279 aa, Panicum virgatum
  misc_feature: Ceres CLONE 2000622
  misc_feature (231)..(277): Pfam Name: Kelch_1 Pfam Description: Kelch motif
MDLCGKREDMALQGGDSCLTPRASRGGRGGCEMESRWAEGLLEGGGRKRRVPEESEDDVQEMDEVDCGGKRSKPPSPQPHTPDIREAHAPGRRRIAVAGSGVNLIGEIGRDLSINCLLRLSRAEYGSVASLNRDFRSLVRGGEIYRLRRQNNISEHWVYFSCNVLEWDAYDPYRERWMTVPKMPHDECFMCSDKESLAVGTELLVFGMAHIVFRYSILTNSWTRGEVMNSPRCLFGSASIGEKAYVAGGTDSLGRILSSAELYNSETHTWTPLPSMNRA

SEQ ID NO: 39981 - DNA, 742 bp, Panicum virgatum
  misc_feature: Ceres CLONE 2000649
  misc_feature: Encodes the peptide sequence at SEQ ID NO. 39982
aaaatcgctccctgcctccggtcgacctcccctgcccccgcctgcctaatctctccggccagctagccccgacaccgttcgttcgttcgttcgttcgctcgacgagaggagcccggagaccatggcggaccagctcaccgacgaccagatcgccgagttcaaggaggccttcagcctcttcgacaaggacggcgacggttgcatcacaaccaaggagctgggaactgtcatgcgctccctgggtcagaacccgactgaggctgagctccaggacatgatcaacgaggttgatgctgatggaaacggcaccatcgacttccctgagttcctcaacctcatggcccgcaagatgaaggacaccgactctgaggaggagctcaaggaggcattcagggtgttcgacaaggaccagaacggcttcatctccgccgcggagctccgccacgtgatgaccaacctcggcgagaagctgaccgacgaggaggttgacgagatgatccgcgaggcagacgtcgacggcgacggccagatcaactacgaggagttcgtcaaggtgatgatggccaagtgaggccgtgttgatggtattatactaccccgccggaaggaggaaaccttgcattgcgtattagtaaaggcatgcagctcttgtttccttcgacttcccctgaaagaaccgtactagctgtagctgctgaacatttgagtcactctgctgccacccttatctccctcatgtcgt

SEQ ID NO: 39982 - protein, 149 aa, Panicum virgatum; identical to SEQ ID NO: 12456
  misc_feature: Ceres CLONE 2000649
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Useful for making plants with modulated salt sensitivity

SEQ ID NO: 39983 - DNA, 744 bp, Panicum virgatum
  misc_feature: Ceres CLONE 2000658
  misc_feature: Encodes the peptide sequence at SEQ ID NO. 39984
acaacaacctgtgacgtcgcagcctcctcttctcccccaccgaaccgaatcccagccgcagaaaccccccgagcagcagccgcatcgatggcccccaaggcggagaagaagccggcggcgaagaagcccgcggaggaggagcccgcgacggagaaggcggagaaggccccggcggggaagaagcccaaggccgagaagcggctgcccgcgggcaagtccgccggcaaggagggcggcgagggcaagagggggaggaagaaggggaagaagtcggtggagacctacaagatctacatcttcaaggtgctgaagcaggtgcaccccgacatcggcatctcctccaaggccatgtccatcatgaactccttcatcaacgacatcttcgagaagctcgccggcgaggccgccaagctggcgcgctacaacaagaagcccaccatcacctcccgcgagatccagacctcggtgcgcctcgtcctccccggcgagctcgccaagcacgccgtctccgagggcaccaaggccgtcaccaagttcacctcgtcctagatgctagggtttccttctgctcgtgtgaggggttgctccttgcagcgattcctggtcactggctttgcctagtgcggatggtctagttacgtgctgtggttcctgaagttgtttctgtatgaagtggaatagttgtgttatctgatggattgtcaaatttcggtgtgcatgtttaactcttgttcaattcgcatc

SEQ ID NO: 39984 - protein, 153 aa, Panicum virgatum
  misc_feature: Ceres CLONE 2000658
  misc_feature (60)..(130): Pfam Name: Histone Pfam Description: Core histone H2A/H2B/H3/H4
  misc_feature: Useful for biocontainment applications
  misc_feature: Useful for making plants with modulated flowering time
MAPKAEKKPAAKKPAEEEPATEKAEKAPAGKKPKAEKRLPAGKSAGKEGGEGKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 39985 - DNA, 697 bp, Panicum virgatum
  misc_feature: Ceres CLONE 2000667
  misc_feature: Encodes the peptide sequence at SEQ ID NO. 39986
aaagaacacaagagccagctgctcaacgtgtagctctctacagccagcagctaccagctcttatcgaccaaattaaaagagttgccgttggcttatattgatagatcgatcgatttaactaataacaatgcagggcctcagtatgatgaagcagcagcagctcagcagcttgttggtcgccgttgctgctgtcttgctgctaggtctcgccggagccgcgcacggcggcggcaggaagaagctcatcgtctcccgcagcgaggacgagccgtgcaagaagatgacggtgtactaccacgacatcctctacagcggcaacaacaccgccaacgcgacgtcggcggcggtgaccaagccggcggcggcgctgagcttgtcgcactggaagaacggcaccttcttcggcctgctggtggtgttcgacgacctggtgacggaggagcaggcgctgtcgtcggagccggtggcgcgcgcgcagggcttctacttctacgacaagaaggagcagtacaacgcgtggatggccttctccctcgtcttcaactcgacggcgtacacgggcaccctcaacctcatgggcgccgacctcatgtacgagaagacgagggacatctccgtcgtcggcggcaccggggacttcttcatgtcgcgcggcgtcgccacgctgagcctcaccgccgccgagggtaccgtctac

SEQ ID NO: 39986 - protein, 189 aa, Panicum virgatum
  misc_feature: Ceres CLONE 2000667
  misc_feature (22)..(189): Pfam Name: Dirigent Pfam Description: Dirigent-like protein
MQGLSMMKQQQLSSLLVAVAAVLLLGLAGAAHGGGRKKLIVSRSEDEPCKKMTVYYHDILYSGNNTANATSAAVTKPAAALSLSHWKNGTFFGLLVVFDDLVTEEQALSSEPVARAQGFYFYDKKEQYNAWMAFSLVFNSTAYTGTLNLMGADLMYEKTRDISVVGGTGDFFMSRGVATLSLTAAEGTV

SEQ ID NO: 39987 - DNA, 705 bp, Panicum virgatum
  misc_feature: Ceres CLONE 2000681
  misc_feature: Encodes the peptide sequence at SEQ ID NO. 39988
caaagaacatcctccttgacaaagattacgagccccatcttacagacttcgggattgcaaagagcttgtgtgtctcaaaaacacacacgtcgacctatgtcatgggcactattggctacattgatcctgagtacgcgcgcacttcacgcctcaacgaaaagtctgatgtctacagctatggcattgttctgctggagctgctaactggcaagaagccagtggacaatgagtgcaatctccatcacttgatcctatcgaagacggcgagcaatgaggtcatggagaccgtggacgccggcatcggggacacctgcaaggaccttggcgaggtgaagaaggtgttccagcttgcgctcctctgcaccaagcggcagccctcggaccggccgacgatgcacgaggtggtgcgcgtcctggactgcctggtgaacccggacccgccgccaaagtcatccacccagcagccgctgggccagctgccgcaggccccgccgtccgtcccgagctacatgaacgagtacgtcagcttgcggggcgccggggcgctctcctgcgccacctcgaccagcacctcggacgcggagctgttcctcaagtttggcgaggccatctcacagaacacggagtaggggttcctcaaggggtctgctgggtggtcagggcagagggtgatgctgctgcaagtagtggagtagtagctgactg

SEQ ID NO: 39988 - protein, 208 aa, Panicum virgatum
  misc_feature: Ceres CLONE 2000681
  misc_feature: SWISSPROT Homolog: EC 2.7.11.1 Non-specific serine/threonine protein kinase
KNILLDKDYEPHLTDFGIAKSLCVSKTHTSTYVMGTIGYIDPEYARTSRLNEKSDVYSYGIVLLELLTGKKPVDNECNLHHLILSKTASNEVMETVDAGIGDTCKDLGEVKKVFQLALLCTKRQPSDRPTMHEVVRVLDCLVNPDPPPKSSTQQPLGQLPQAPPSVPSYMNEYVSLRGAGALSCATSTSTSDAELFLKFGEAISQNTE

SEQ ID NO: 39989 - DNA, 677 bp, Panicum virgatum
  misc_feature: Ceres CLONE 2000717
  misc_feature: Encodes the peptide sequence at SEQ ID NO. 39990
cttccccactttcctcctcccttggtgttcctttgctggcggcgaccactgggccagcggcagcgccattcgtcgcgtattcgcccgcccggccctttgccggcgaggagcatccaccagagaattagttgaaatggcaagcacggcatgctttgtgattgttagtaagaatgacatcccaatctatgaggctgaagttggatctgctccaaaaaaagaagatttagcttatcagcatcagttcattttgcatgctgcattggatgttgttcaggaccttgcatggactaccaatgcaatgtttctgaggtcggttgatagattcaatgaccttgttgtgtctgtttatgtaactgctggtcatatccttccagtaccatgatattgatctgttttatagaaaccttattaattaaagatttttgaaagaaaaaatagcaaccaacgcaagttgcatagcaattattctatttgaacagttgtgatctaaataaacattatcccttgttccaaattagtgaacagtggtagaacgtggaatatttgcctctcatactttttttcataatcagtatgtgatcaccatgacttccgtttctatctttcctctgatgttttatttgtcctagtgtctttgttttttggcttccttgacgaacaatgtggtacatactaga

SEQ ID NO: 39990 - protein, 82 aa, Panicum virgatum; identical to SEQ ID NO: 38688
  misc_feature: Ceres CLONE 2000717
  misc_feature (9)..(81): Pfam Name: Sedlin_N Pfam Description: Sedlin, N-terminal conserved region
  misc_feature: Useful for biocontainment applications

SEQ ID NO: 39991 - DNA, 595 bp, Panicum virgatum
  misc_feature: Ceres CLONE 2000721
  misc_feature: Encodes the peptide sequence at SEQ ID NO. 39992
gagtttccaccgtctcctcctgccagcggccaaccgtctcgtcgcctccctccccgaccgctcaccccaccctgtccacgacggtcgcccgccggccgccaccccatcgcaatactttttctgccacaatcttagaaccttcctcctccccgtctctggccatcgcggcgaggcgcttcctcgtcccagccttataaatcagccggaagcgagctgtctccctcacagaccgcaacagcacgcagccgacgagggacccgagccgtgccggcaaaatggaaggggaggggcgattggttcgatggcgaagctgtacatgcaggcggtgccgcccccggatctgaacaagaacaccgagtggtacatgtaccccggggtctggagcacctacatcctaatcctcttcttctcctggatcctcggtctctccgacatcgggtgcgcccccggcacggcgtggacgctcgtcaacctcggccacttcacgatcacataccactttttccactggaagaaggggactccgtttgctgataaccaagggatgtataacacattgacatggtgggcacaaatggataatggcacacagctt

SEQ ID NO: 39992 - protein, 97 aa, Panicum virgatum
  misc_feature: Ceres CLONE 2000721
  misc_feature (14)..(97): Pfam Name: ORMDL Pfam Description: ORMDL family
MAKLYMQAVPPPDLNKNTEWYMYPGVWSTYILILFFSWILGLSDIGCAPGTAWTLVNLGHFTITYHFFHWKKGTPFADNQGMYNTLTWWAQMDNGTQ

SEQ ID NO: 39993 - DNA, 699 bp, Panicum virgatum
  misc_feature: Ceres CLONE 2000730
  misc_feature: Encodes the peptide sequence at SEQ ID NO. 39994
aaaaccctagccgaccacaccactccaccccgccgccgcaggcgagaagcagctccagctcaggtaagggcggccgccgccggggagggcgcgcctgcgaagatgcagatcttcgtgaagacgctgacggggaagaccatcacgctggaggtggagtcctcggacaccatcgacaacgtgaaggccaagatccaggacaaggagggcatcaccatgtcgggcatcatccacaagatcgaggagaccctccacatggggggcgaccacaagaaggaggaggagcacaagaaggcggaggcgcacaagaaggccgaggagcaccacaagaaggacggcgagcacaaggagggcatcgtcgagaagatcaaggacaagatcaccggcgagcacggcgacaagtccggcgagcacaaggacgacaaggaccacaaggagaagaaggacaagaagaagaagaagaaggagaagaagcacggcgagggccaccacgacggccacagcagcagcagcgacagcgactgatcgcctcgcggcgcgccgtgcttgccggtgaaaaaggtgcttggagaggactatctaccggaagctgtgtgatgtaatatgtttcacgagtgccatacgtgtgtgtgctaatcaagggagaaatgaaaaaaaaaaccttttatgttgatcaatgtactcctaatgatggctccacgg

SEQ ID NO: 39994 - protein, 139 aa, Panicum virgatum
  misc_feature: Ceres CLONE 2000730
  misc_feature (39)..(129): Pfam Name: Dehydrin Pfam Description: Dehydrin
  misc_feature: Useful for making plants with modulated cold sensitivity
MQIFVKTLTGKTITLEVESSDTIDNVKAKIQDKEGITMSGIIHKIEETLHMGGDHKKEEEHKKAEAHKKAEEHHKKDGEHKEGIVEKIKDKITGEHGDKSGEHKDDKDHKEKKDKKKKKKEKKHGEGHHDGHSSSSDSD

SEQ ID NO: 39995 - DNA, 685 bp, Panicum virgatum
  misc_feature: Ceres CLONE 2000737
  misc_feature: Encodes the peptide sequence at SEQ ID NO. 39996
cactggcacccgagccccggggtgacgctcaacagccagatcctcctggaggcgtgcggctgcgcggagtccctcggcggggtcaaggacgggcgctggaagacctccatcttcttctaccgcgccatgacccgggacggcgcggcggtgcccgcgggccagcaggggcagcagcaccccgacctgcccagggagctcctcggcgtcgcgctccacgagcgcccggggctctacttctccatcgtccgcgcggcgcgcctcgtcctccaggccgacgccgcgttcccccaggtcatggagaagctccagtcctacaaggcccgcgtcgccctcaacttcgaggggtttcagtatcaactgggtgatttctgcctgaggattggaaaatgtgctcctaataattctgaatcactgagaggaatcatgatggaggtagagtattatcccctatcttccatcgaaaaatccagggcaatcatggaagacttctttgacatatggcaggaaacagttgcaaagaagtcattacctggtcatttcattcatgtagaatcgaacttttcagaatatgggctttccgatcaatattctttccaacatactgcagttcagtatgcgacttgcttgcagcagctcatggctacagtcaggtgctagctctaaagatcaagctttagagaataat

SEQ ID NO: 39996 - protein, 218 aa, Panicum virgatum
  misc_feature: Ceres CLONE 2000737
  misc_feature (7)..(211): Pfam Name: TATA_RF Pfam Description: TATA-binding related factor (TRF)
HWHPSPGVTLNSQILLEACGCAESLGGVKDGRWKTSIFFYRAMTRDGAAVPAGQQGQQHPDLPRELLGVALHERPGLYFSIVRAARLVLQADAAFPQVMEKLQSYKARVALNFEGFQYQLGDFCLRIGKCAPNNSESLRGIMMEVEYYPLSSIEKSRAIMEDFFDIWQETVAKKSLPGHFIHVESNFSEYGLSDQYSFQHTAVQYATCLQQLMATVRC

SEQ ID NO: 39997 - DNA, 564 bp, Panicum virgatum
  misc_feature: Ceres CLONE 2000742
  misc_feature: Encodes the peptide sequence at SEQ ID NO. 39998
gagtgaaaagccaacagcaaccgccgccaccccgacctccaaattattcccaatcccccgtttcccaagctctgccgccaactccttccgctcgttcccgtgatggcgcccaaggccaaaaaaaagcccgccaagaaaaagccggcaaaggaaaaggccaaaaaaaagccaaaggctgaaaagcgcgggccgggctccggcaaggagggcggcaagaaaaaggggaaaaaaaaggccaaaaaaagcgtcaagacctacaaaatctatatcttcaaggtcctcaagcaggtgcacccggacattggtatctcctccaaggccatgtccatcatgaactcgttcatcaacaacatcttcaaaaagctcgcgcaggaggccgcccgcctcgcgcgctacaacaagaagcccaccatcacctcccgggagatccaaacctcggtgcgcctcgtcctccccggcaagctcgccaagcacgccgtctctgagggcaccaaggccgtcaccaagttcacctcttcttagattgccgcacggggttgcggtcctgtttcttttcttcatgtt

SEQ ID NO: 39998 - protein, 139 aa, Panicum virgatum
  misc_feature: Ceres CLONE 2000742
  misc_feature (46)..(116): Pfam Name: Histone Pfam Description: Core histone H2A/H2B/H3/H4
  misc_feature: Useful for biocontainment applications
  misc_feature: Useful for making plants with modulated flowering time
MAPKAKKKPAKKKPAKEKAKKKPKAEKRGPGSGKEGGKKKGKKKAKKSVKTYKIYIFKVLKQVHPDIGISSKAMSIMNSFINNIFKKLAQEAARLARYNKKPTITSREIQTSVRLVLPGKLAKHAVSEGTKAVTKFTSS

SEQ ID NO: 39999 - DNA, 676 bp, Panicum virgatum
  misc_feature: Ceres CLONE 2000766
  misc_feature: Encodes the peptide sequence at SEQ ID NO. 40000
acacactgcattcatcaatcatcactcacgtagaacacagaaccagatctgttaatccaggagctgccatgggcatcgtcgacgtcgtctccgtgttctgcgcgctgccgaggactcgccggcacctcaagaagaggaaggagttccagacggtggagatgaagatgcggatcgactgcgaagggtgcgagcgcaaggtgcgcaaggcgctggagggcatggagggcgtgagctccgtggaggtggcgccgcgccagcacaaggtgacggtggccgggtacgtcgacgccggcaaggtgatgcggcgggtggcgcgccggacgggcaagcgggtggagccctggccgtacgtgccgtacgacgtggtggcgcacccctacgcgcccggcgcctacgacaagaaggcgccgcccggctacgtgcgcaacgtcgtcgccgaccccgccgctgcgccgctcgcccgggcctcgtccaccgaggtcaggtacaccgccgccttcagcgacgagaaccccaacgccgcctgcgccgtcatgtagagcttcacgctgcctcgctcctggagtagtagtaggagtagatggactaggaagttgctggtgtttcttggagcatttttttttctactttagtatttctctacgcttgtgctctggttcgattcgctgtaaaaaaa

SEQ ID NO: 40000 - protein, 156 aa, Panicum virgatum; identical to SEQ ID NO: 18903
  misc_feature: Ceres CLONE 2000766
  misc_feature (29)..(91): Pfam Name: HMA Pfam Description: Heavy-metal-associated domain
  misc_feature: Useful for biocontainment applications

SEQ ID NO: 40001 - DNA, 407 bp, Panicum virgatum
  misc_feature: Ceres CLONE 2000767
  misc_feature: Encodes the peptide sequence at SEQ ID NO. 40002
caaccccaagcgcctccgcagccgcaagaccaccgatggcgccttagacggagaactcatcgggggcgaagatccccgaggaggaggatcccgcaccggagaaggcgcaaaagggcccgcaggggaagaagcccaaggcggagcagcgcctccccgcgtgatactcctgctccgtccaggaccgcgagggcgagaagggctagaaggccaagaagagcgtcgagacctacaagatctacatcttatgcgtgttcaagcaggtgcacccggacatcgacctctcctctatggacatgtccattatgtactccttcatcaacgacatcttcaagaagctcgcccccgaggccgacaagctgacctgctccaacaagtcgctcaccatgacatcccgtgagatccagacc

SEQ ID NO: 40002 - protein, 39 aa, Panicum virgatum
  misc_feature: Ceres CLONE 2000767
  misc_feature: Useful for biocontainment applications
  misc_feature: Useful for making plants with modulated flowering time
MDMSIMYSFINDIFKKLAPEADKLTCSNKSLTMTSREIQ

SEQ ID NO: 40003 - DNA, 709 bp, Panicum virgatum
  misc_feature: Ceres CLONE 2000768
  misc_feature: Encodes the peptide sequence at SEQ ID NO. 40004
acaactcacatctcgagcagtcggagttcatccccgagcagacctcgcaagccgcacatcttcttctcctcctgctccagatctcaggcgaaagcttgtccaccatccaccgccacagcatcccaatggctcgcttcgccgtcgtcgccgccatcgtcgcgctcctcgccgtcaccgcggccgcgcaggccccggccgcgacgcccaccccggcgcccaggatggccccgctgccgcctcctccggcgcggtccccggccaccaccccggccccggccccggcaccggccgcgaagccgcccaccgcctcggcgccgtccccgctgtcctctcccccggccccgcccgccgagggcccctccgcgatgaccccgaccacctccgtctccgccgcccccgccggcgcccccaccgccacgcccaccgggaacggcgccgcctcctccgccgtcagcttcgtcgccgtcgccgccgcggtcgccgccgccgtcgtgttctagatggggacgcgttgcgactatgggatctcgagctgtttatactgccatattctttttttgcgattcttttttactgtattagatactgatgatgagagagcagaggagaggacatttgaggggggattcacccagtgctgctagttacacatcatgcatgattcatgatgatatgattattaatggaattctttcatttgttacatcat

SEQ ID NO: 40004 - protein, 124 aa, Panicum virgatum
  misc_feature: Ceres CLONE 2000768
  misc_feature: Useful for making plants with altered carbohydrate content
MARFAVVAAIVALLAVTAAAQAPAATPTPAPRMAPLPPPPARSPATTPAPAPAPAAKPPTASAPSPLSSPPAPPAEGPSAMTPTTSVSAAPAGAPTATPTGNGAASSAVSFVAVAAAVAAAVVF

SEQ ID NO: 40005 - DNA, 731 bp, Panicum virgatum
  misc_feature: Ceres CLONE 2000771
  misc_feature: Encodes the peptide sequence at SEQ ID NO. 40006
tatagaaatccaagaaacaagaatgccgggaagtttatgagactatcagactttttggcctttgcaaaagataaggatttgtctggaatcatgatcactgtagagcgtgctgcattcatggcagagaagcttggatttggtgtggtagatgcagtgatcaaagcccttgatgactctggttacagcaaacagactacccagaaagttatgatccagtcaacgaacagctcagttctagtgaagttcaagcaggaaaccaagtatgaccttgtctacatgatcgaggaagatgtcagagatgctgcgccttcctcccttgcagacatcaagaagtttgctagtgctgtttctgtcagcaccaaatccattttcccaacgaccaatcaattcttgacaaaccagaccaataatctcgctacatcccttcaatcttctggcctcccagtttatgtttatctgctcatgaatgagttcgtttctcaaccatatgactttttctcagacgccaccgcacagatcaatggttatgtgcaaggtgctaaagttgatggagtcatcacagatttccctgggactgctcacagatacaaatcgaactcttgcatgggaaagaatgcaccggactttatgcggcctgcgcagccagggggcatcctttcagtcatggacccaggtgctcagccgccagcggcagcccccatgccgctcttgacagactctgacattgcaga

SEQ ID NO: 40006 - protein, 243 aa, Panicum virgatum
  misc_feature: Ceres CLONE 2000771
  misc_feature: Useful for making plants with altered cell wall content and/or composition
YRNPRNKNAGKFMRLSDFLAFAKDKDLSGIMITVERAAFMAEKLGFGVVDAVIKALDDSGYSKQTTQKVMIQSTNSSVLVKFKQETKYDLVYMIEEDVRDAAPSSLADIKKFASAVSVSTKSIFPTTNQFLTNQTNNLATSLQSSGLPVYVYLLMNEFVSQPYDFFSDATAQINGYVQGAKVDGVITDFPGTAHRYKSNSCMGKNAPDFMRPAQPGGILSVMDPGAQPPAAAPMPLLTDSDIA

SEQ ID NO: 40007 - DNA, 1000 bp, Panicum virgatum
  misc_feature: Ceres CLONE 2000772
  misc_feature: Encodes the peptide sequence at SEQ ID NO. 40008
ggtcggctagtttggacgcaggagaccgcagggcgatgggcgcgccgaagcagaagtggacgtcggaggaggaggaggcgctccgccgtggcgtgctcaagcacggagcgggcaagtggcggaccatccagaaggatcccgagttcagcccagtcctctcgtcccgctccaacatcgacctcaaggacaaatggaggaatctaagtttcagtgcaagtggaatgggttcaagggacaaaacaaggggtccaaggacaactggaccctcatgttccccattgtctacctcacaggcttcggttgccccagtggcaaataaagttgctgaagctccaccaggagctgagaaaaagcaacaggaagtgaaacctcatccaaagtatggtgccatgatcctggaagctctttcggagttgaatgagccaaatggtacagaacttactgaaatctgcagcttcatagaggttgatactaagtcctataggctcgccgattcctttgcgacgagaactccagctccaataaaagcttcagctccaaaacagaaggatccatccaagccatcgaaggtgtcaaagaacctaggattgtttgccacctccagccctgcactagaggcagccatggccgcagcagccaaagtagctgatgcagaggtgaaagcacatgatgcacatgatcagatgatggaggcagaaaggatcctcaagatggctgagaagacggagtctctcctcacgattgcagcagagatctatgatcgatgttcaaggggagagataaccacattaaatccgccgcaaagggaggtctgaaacctaccggaggcctctgttttcatgtacatggataggttgtcctggattatctgcccatattgctcctatgttgtataatttaagtgtttgtgctgtacttgggatatagggttaaactaaataacaccagtgcaccgcctgacatcaatcttttaatgatttgtagagatgtagtcgcatct

SEQ ID NO: 40008 - protein, 259 aa, Panicum virgatum
  misc_feature: Ceres CLONE 2000772
  misc_feature (5)..(57): Pfam Name: Myb_DNA-binding Pfam Description: Myb-like DNA-binding domain
  misc_feature: Useful for biocontainment applications
MGAPKQKWTSEEEEALRRGVLKHGAGKWRTIQKDPEFSPVLSSRSNIDLKDKWRNLSFSASGMGSRDKTRGPRTTGPSCSPLSTSQASVAPVANKVAEAPPGAEKKQQEVKPHPKYGAMILEALSELNEPNGTELTEICSFIEVDTKSYRLADSFATRTPAPIKASAPKQKDPSKPSKVSKNLGLFATSSPALEAAMAAAAKVADAEVKAHDAHDQMMEAERILKMAEKTESLLTIAAEIYDRCSRGEITTLNPPQREV

SEQ ID NO: 40009 - DNA, 315 bp, Panicum virgatum
  misc_feature: Ceres CLONE 2000774
  misc_feature: Encodes the peptide sequence at SEQ ID NO. 40010
aactcgcatctggagccatcggagttcatcagcactctctactcacacagcacatcttcttctcctcctgctacagagctcaggcaaaagcttcgccgccacaacatcccaatggctcgcttcgccgtggtcgccgccatcgtcgccctcctcgccgtcaccgcggccgcgcaggccccggccgcaacacccaccccggcgcccaggatggccccgctgccgcgtcccccggcgcgctccccggccaccgccccggcaccggccgcgaagccgccgaccgcctcggcgccatccccgctggcctctcccccggcc

SEQ ID NO: 40010 - protein, 67 aa, Panicum virgatum
  misc_feature: Ceres CLONE 2000774
  misc_feature: Useful for making plants with altered carbohydrate content
  misc_feature: Useful for making plants with altered cell wall content and/or composition
  misc_feature: The sequence is a functional homolog of SEQ ID NO 1433 in the 10/374,780 US patent application
  misc_feature: The sequence is a functional homolog of SEQ ID NO 1519 in the 10/412,699 US patent application
MARFAVVAAIVALLAVTAAAQAPAATPTPAPRMAPLPRPPARSPATAPAPAAKPPTASAPSPLASPP

SEQ ID NO: 40011 - DNA, 746 bp, Panicum virgatum
  misc_feature: Ceres CLONE 2000778
  misc_feature: Encodes the peptide sequence at SEQ ID NO. 40012
ctcggtgttaatatacagaacggagaggaagtgggaataaaattggaacctgtgaaaacaaaacacccacagctgcattatgaatctaaagtgtatatgctattgcagggtggaaatggtatcccacacctgaagtggtatggtgtcgagggggaatacaacgttatggtcatcgatcttcttggcccaagcttggaagacttgtttaactgctgcaaccggaaactttcaatgaaaacagtgcttatgcttgctgatcaactgataaatcgagtggaatacatgcattccaagggatttattcaccgtgacatcaaaccagacaacttccttatgggcttaggccggaaagctaatcaggtctatataattgattatgggcttgctaaaaaatacaaggaccttcagactcataaacatatcccttacagggagaacaaaaatctgactggaacagcacgttatgccagtgtgaatactcatcttggaatagaacaaagcagaagagatgatctggagtctgttggctatcttctgctatattttttaagaggaagcctcccatggcagggtcttaaagctggaactaagaaacaaaagtatgacaaaattagtgaaaagaaaatgctcacctcaccagaagttttgtgcaaatcttacccaccggaagtcatctcatatttccactattgtcgctccctgcgatttgaagacaggccagattactcttttctgaagaagctttt

SEQ ID NO: 40012 - protein, 248 aa, Panicum virgatum
  misc_feature: Ceres CLONE 2000778
  misc_feature (1)..(245): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 32 in US patent 7179962
LGVNIQNGEEVGIKLEPVKTKHPQLHYESKVYMLLQGGNGIPHLKWYGVEGEYNVMVIDLLGPSLEDLFNCCNRKLSMKTVLMLADQLINRVEYMHSKGFIHRDIKPDNFLMGLGRKANQVYIIDYGLAKKYKDLQTHKHIPYRENKNLTGTARYASVNTHLGIEQSRRDDLESVGYLLLYFLRGSLPWQGLKAGTKKQKYDKISEKKMLTSPEVLCKSYPPEVISYFHYCRSLRFEDRPDYSFLKKL

SEQ ID NO: 40013 - DNA, 667 bp, Panicum virgatum
  misc_feature: Ceres CLONE 2000783
  misc_feature: Encodes the peptide sequence at SEQ ID NO. 40014
gcccaccaaacccctctcctccccgccccatcccagcgatctcactcaccaaccaagcagcacaaacttggcctgtcgacacgccgaggaacgcgcgcgcgctgtgtttgtctccgaccaggcagcgaccatgtcgacgacgacgacgacgacgatgaaggcaagcgacccgggctccgcgtggttcggcagcggcgcccggaacccgccggcggggatgggggcccacaacgtgcggctcatcaccacggccgtcgcggctttcgtgtcagtgctcggcctcgccctcttcctgcacctctacgtctgccacgtccgccgccggaaccggcgccgcgcggcggccgtgctgccgaccacggcggcggccgccgcggccccgaagggcgggctggaccccgcggccatcgcggcgctgccgaccgccgtgtacgggaaggctggcgagccgggcgcctgcaccgagtgcgccatctgcctcggcgccgtgcaggaaggggaggtcgtgagggcgctgcccacctgcgcccacgtgttccacgtcccctgcatcgacacgtggctcccgtcgagctcctcgtgcccggtctgccgcgccgaggtggagccgccgctggaggaggagggcgcggcccggttggtgcaggagaagctgcaggacgtcgtg

SEQ ID NO: 40014 - protein, 178 aa, Panicum virgatum
  misc_feature: Ceres CLONE 2000783
  misc_feature (113)..(154): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MSTTTTTTMKASDPGSAWFGSGARNPPAGMGAHNVRLITTAVAAFVSVLGLALFLHLYVCHVRRRNRRRAAAVLPTTAAAAAAPKGGLDPAAIAALPTAVYGKAGEPGACTECAICLGAVQEGEVVRALPTCAHVFHVPCIDTWLPSSSSCPVCRAEVEPPLEEEGAARLVQEKLQDV

SEQ ID NO: 40015 - DNA, 686 bp, Panicum virgatum
  misc_feature: Ceres CLONE 2000799
  misc_feature: Encodes the peptide sequence at SEQ ID NO. 40016
aaaaagctcatcactgagatcaagaaaacagctaaagaaggccagatgggagctgtcaaagtaatggccaaagatcttatccgtacccggcatcagataacaaagttctaccaacttaaatcccagctccaaggagtttctctaagagttcagacgctaaaatcaactcaagctatgggtgatgctatgaagggtgttacaaaagcaatggctcaaatgaataggcagctaaatttgccagggttgcagaagataatgcaagagtttgagcgacaaaatgagaggatggagatggtgagcgaggtgatgggagatgccatagatgatgctttggaaggagacgaggaagaagaagaaactgaggagcttgtgaatcaagtacttgatgaaattggcattgatatcaaccaagagcttgttggagccccatcggctgctgttgctcagcctgcttctgctggaaaggttgcccaggctgaaagcgccgggaacgctgacagcggaatcgacgccgatttgcaggcaaggttgaacaatctaaggagaatgtaaatgctgcccgatgctgcattaggaaaagagtagtgccttgtagcaccgtttcctgtgaatgtgaatgaatacccactgaaacaaactttacaagccagtgtgtatgttgaaacaaatgaagtattcaatatgct

SEQ ID NO: 40016 - protein, 183 aa, Panicum virgatum
  misc_feature: Ceres CLONE 2000799
  misc_feature (1)..(147): Pfam Name: Snf7 Pfam Description: Snf7
KKLITEIKKTAKEGQMGAVKVMAKDLIRTRHQITKFYQLKSQLQGVSLRVQTLKSTQAMGDAMKGVTKAMAQMNRQLNLPGLQKIMQEFERQNERMEMVSEVMGDAIDDALEGDEEEEETEELVNQVLDEIGIDINQELVGAPSAAVAQPASAGKVAQAESAGNADSGIDADLQARLNNLRRM

SEQ ID NO: 40017 - DNA, 695 bp, Panicum virgatum
  misc_feature: Ceres CLONE 2000814
  misc_feature: Encodes the peptide sequence at SEQ ID NO. 40018
tactgtcctgtgctgcggcaacttgagtctgctgccatgaaagagtactatttcaaagctgatcaccccaccactctctcagcaggttcttcaaatctaaagtatcggaaccccaagtacctctctatgctgaaccacttgaggttttatctcccagaggtctatccaaagttggataagatacttttcctcgatgatgacatagttgtgcagaaagatttgacagggttgtgggatgttgatcttaatggaaaggtcaatggtgctgtggaaacctgtggggagagtttccaccgttttgacaagtaccttaatttttcaaatccacatattgctcggaactttgatccaaatgcatgcggctgggcttatgggatgaacatctttgaccttaaggagtggaagaagaaagatattactgggatctaccacaaatggcaaaacaagaatgaagacagagttctttggaagcttgggacacttccgcctggcctcttgaccttctacaaattgacgcatcccctggataagtcctggcacgttcttggattgggatacaacccaagcatagaccgttcggagatagacggtgctgctgttgttcattacaatgggaacatgaagccatggttggagctggcaatgaccaagtaccgaccatattggaccaagtatatcaagtatgatcaccctta

SEQ ID NO: 40018 - protein, 231 aa, Panicum virgatum
  misc_feature: Ceres CLONE 2000814
  misc_feature (1)..(214): Pfam Name: Glyco_transf_8 Pfam Description: Glycosyl transferase family 8
  misc_feature: Useful for making plants with altered carbohydrate content
  misc_feature: Useful for making plants with altered cell wall content and/or composition
YCPVLRQLESAAMKEYYFKADHPTTLSAGSSNLKYRNPKYLSMLNHLRFYLPEVYPKLDKILFLDDDIVVQKDLTGLWDVDLNGKVNGAVETCGESFHRFDKYLNFSNPHIARNFDPNACGWAYGMNIFDLKEWKKKDITGIYHKWQNKNEDRVLWKLGTLPPGLLTFYKLTHPLDKSWHVLGLGYNPSIDRSEIDGAAVVHYNGNMKPWLELAMTKYRPYWTKYIKYDHP

SEQ ID NO: 40019 - DNA, 589 bp, Panicum virgatum
  misc_feature: Ceres CLONE 2000826
  misc_feature: Encodes the peptide sequence at SEQ ID NO. 40020
gatcagttcagttcagggtagtcgttgtagagagagagcagcagggtagggtacttcattcaaagatgttcttcaggctggcgcagcaggtcctcagcctcagcaggcaggggaagagccgagctgggcctgccttgtccggcgtcgccagacgacacttgtccgctgccgcagactcacaaaggctggccgggaaggtggccgtcatcaccggcgccgccagcggcatcggccaggcgacggccagggagttcgtccggaacggcgccagggtcgtcctcgccgacgtccaggacgacctgggccgcgcgctcgccgcggacctcggggcctcctacatccgctgcgacgtgaccgacgaggcgcaggttgctgcggccgtggacctcgccgtcgcgcgccacggccggctcgacgtcatgttcaacaacgccggggtggtggggtccctggcgcggccggcgctgggcgcgctggacctcgccgacttcgaccgcgtcctggccgtcaacacccggggcgtggtggccggggtgaagcacgcggcgcgggtcatggtgccgcgccgcgccggcagcatcatctgcac

SEQ ID NO: 40020 - protein, 174 aa, Panicum virgatum
  misc_feature: Ceres CLONE 2000826
  misc_feature (44)..(171): Pfam Name: adh_short Pfam Description: short chain dehydrogenase
  misc_feature: SWISSPROT Homolog: EC 1.1.1.288 Xanthoxin dehydrogenase
  misc_feature: Useful for making plants with modulated biomass
MFFRLAQQVLSLSRQGKSRAGPALSGVARRHLSAAADSQRLAGKVAVITGAASGIGQATAREFVRNGARVVLADVQDDLGRALAADLGASYIRCDVTDEAQVAAAVDLAVARHGRLDVMFNNAGVVGSLARPALGALDLADFDRVLAVNTRGVVAGVKHAARVMVPRRAGSIIC

SEQ ID NO: 40021 - DNA, 689 bp, Panicum virgatum
  misc_feature: Ceres CLONE 2000839
  misc_feature: Encodes the peptide sequence at SEQ ID NO. 40022
  misc_feature (599)..(599): n is a, c, t, g, unknown, or other
aacaaaaccctcgctcctaccacccgccgccgcccgcgccgccgcctgcaccagccgcgacaaagatgagtcggcaccctgaagtgaagtgggctcagaggatcgacaaggtttacatcaccgtacagttatctgatgcaaaggatgctaaggtcaatttggagccagatggtgtcttcacattctctggcagtgctggtacaaacttatatgaattgaaactagatctgaatgacaaagtcaatgtggaggctagcaagataagtgtgggtgtcaggtccatattctgtatcgtagaaaaagctgaggccaaatggtggaagaagcttgttcgggatgatcaaagggcacctcactttgtgaaagttgattgggacaaatgggtggatgaagatgatgacggtggtgatgtcaacttggatgggatggacttctcgaattttggtggcatgggcggtatgggcggcatgggtgatatggctggtctgggcggcatgggtggtatgggaatggatgaatttgaggatgagagtgatgatgaagaaaaagtatcaaagcctcaagctgcggagaaggctggtgaggctgagaagacagangcagctgaagctaagacagagacggctcagagcagttgaagagggttccggcatgatccaaaatagattgtatccgcatgttctatggat

SEQ ID NO: 40022 - protein, 190 aa, Panicum virgatum
  misc_feature: Ceres CLONE 2000839
  misc_feature (5)..(79): Pfam Name: CS Pfam Description: CS domain
  misc_feature: SWISSPROT Homolog: EC 5.3.99.3 Prostaglandin-E synthase
  misc_feature (178)..(178): Xaa is any aa, unknown, or other
MSRHPEVKWAQRIDKVYITVQLSDAKDAKVNLEPDGVFTFSGSAGTNLYELKLDLNDKVNVEASKISVGVRSIFCIVEKAEAKWWKKLVRDDQRAPHFVKVDWDKWVDEDDDGGDVNLDGMDFSNFGGMGGMGGMGDMAGLGGMGGMGMDEFEDESDDEEKVSKPQAAEKAGEAEKTXAAEAKTETAQSS

SEQ ID NO: 40023 - DNA, 654 bp, Panicum virgatum
  misc_feature: Ceres CLONE 2000845
  misc_feature: Encodes the peptide sequence at SEQ ID NO. 40024
atctcgcaaaaaaatccccaaatcttcctcctcccaaatccctcgaatcctccgcgcctcgggcaagctctaggtagtcgtcgcagcagcagccatgtcgggccgcggcaagggaggcaagggcctgggcaagggcggcgcgaagcgccaccggaaggtgctccgcgacaacatccagggcatcacgaagccggcgatccggaggctggcgaggaggggcggcgtgaagcgcatctccgggctgatctacgaggagacccgcggcgtgctcaagatcttcctcgagaacgtcatccgcgacgccgtgacctacacggagcacgcccgccgcaagaccgtcaccgccatggacgtcgtctacgcgctcaagcgccagggccgcaccctctacggcttcggcggctgagcccctggcccccgcccgcgtcctgtgtgtcgcgtgcaggcgcaagctggggttcctgatgggttagagaagttgatgtgctgggttctgtcctgtgcctagctgcgttgtaatggtgaagtatggtagcctggggagcttctaatttctacgaccgattccagatcgtcctaggttgatgtttactattttcttattcccacgttgattctgtaattcactctgtattttacttaatgtattttcct

SEQ ID NO: 40024 - protein, 103 aa, Panicum virgatum; identical to SEQ ID NO: 12044
  misc_feature: Ceres CLONE 2000845
  misc_feature (25)..(94): Pfam Name: Histone Pfam Description: Core histone H2A/H2B/H3/H4

SEQ ID NO: 40025 - DNA, 600 bp, Panicum virgatum
  misc_feature: Ceres CLONE 2000857
  misc_feature: Encodes the peptide sequence at SEQ ID NO. 40026
ctagcgccggcgccgcggactcccactgcctcttcgcgtcctcccctctcgccgccgcggagatggccccgaagaaggacaaggctccgccgccgtcgtcgaagccggccaagtccggcggtggcaagcagaagaagaagaagtggagcaagggaaagcaaaaggagaaggtgaacaacgccgttctgttcgaccaggccacctacgacaagatgctctctgaagtgcccaagttcaagcagatcaccccctccgtcctctctgagaggcttcggatcaatggctccctggctcggagggctatcaaggaactgatggctcgtggcctgatccggatggtgtcggtgcactcaagccagcagatctacacaagggcaaccaacacctaaggatggctttgtttgccctctgtcttagaacggttgtcatggttgttaagagtttgctaatttgatgtcacttgtgatggtcagcatctcttgatggctgaaacaatttcagagattttgggtactatctatgctgtttcacctacgaatttaagttgtactatcccgaattactattctgaattctcaatacaggttaggcttctcgagc

SEQ ID NO: 40026 - protein, 108 aa, Panicum virgatum
  misc_feature: Ceres CLONE 2000857
  misc_feature (1)..(106): Pfam Name: Ribosomal_S25 Pfam Description: S25 ribosomal protein
MAPKKDKAPPPSSKPAKSGGGKQKKKKWSKGKQKEKVNNAVLFDQATYDKMLSEVPKFKQITPSVLSERLRINGSLARRAIKELMARGLIRMVSVHSSQQIYTRATNT

SEQ ID NO: 40027 - DNA, 725 bp, Panicum virgatum
  misc_feature: Ceres CLONE 2000861
  misc_feature: Encodes the peptide sequence at SEQ ID NO. 40028
ctcctctctctctctctctctctctctctcggccgccttctttcttctcctttccaagcggcgacgacaggggagtggcgccgcccttgccagtttcgtcgggcgcttcgccggccaagtctccttttctaaactcgtagtcgctgatggggaaagcaaagcgtgcctcaatcttcatcaggctggtttctgcagctggtactgggttcttctatgtgaagcgcaagaatcctcggcggatcactgagaagcttgaatttaggaagtatgatccccgtgtgaacaagcatgttctgttcacagaagcaaagatgaagtgagatcagaaaaccttcacaatgcagaacaggaataggttgtcagcattttgcaatcagaaatctctagtaccattaaggatgtcatgttctggtttccagtgttccatttggataactgtaatgggaatatgattaaggatttgatgtgctcttccagtcgattttttgcaacaataaacattttgttgctcgagtgagctgcagacctgcaaacgactagtttttttttaataattttcttttgaggtatgagctataatcagctcctgatgaaggaaatctggacctcccaagttctatttacacctttcaatcccaccatgtttgtgaaccaatatagttctcagctgaacatgtgaactgccacgatgctccgctaaacatgaagtgaagctgttgtttctg

SEQ ID NO: 40028 - protein, 57 aa, Panicum virgatum; identical to SEQ ID NO: 9772
  misc_feature: Ceres CLONE 2000861
  misc_feature (8)..(55): Pfam Name: Ribosomal_L33 Pfam Description: Ribosomal protein L33

SEQ ID NO: 40029 - DNA, 664 bp, Panicum virgatum
  misc_feature: Ceres CLONE 2000866
  misc_feature: Encodes the peptide sequence at SEQ ID NO. 40030
tagtgagtatgctgtgactgggaatgatgctggcaaaggaacactggtagcagcactagcagaggctgcatttctcattggattggaaaggaacagtgatgtggtcgagatggcgagctgtgcacccctttttgtaaatgacaatgatcgcaggtggagcccagacgccatcgtcttcaactcatggcagcactatggatgcccaaactattggatgctacatttcttcaaggattcgagtggcgctgcccttcaccctacaaccattcagatctccgactacgatcagctggttgcgtctgccatcactttgcagaatgctacagacagaagcccttacctaagaataaaggtggtaaatttcgggaacagagctgtggatctcaacatctctgtggtggggctggcaaacggaatcaagatgtctggatcgaaacagacagttctaacatccagcaatccacttgacgagaactccttcgagcagccagagaaggtggcgccggtgtcgagcccgttggcaaacgcgaagccgcagatgggcttgtccgtgaggccgtactccctcacctcgtttgacctgctgctggaggcgagcaagcatgccagcatctgaagaagcagctgcggtgaccaaccccacgacgaggaaagactgtactgc

SEQ ID NO: 40030 - protein, 204 aa, Panicum virgatum
  misc_feature: Ceres CLONE 2000866
  misc_feature (1)..(188): Pfam Name: Alpha-L-AF_C Pfam Description: Alpha-L-arabinofuranosidase C-terminus
  misc_feature: SWISSPROT Homolog: EC 3.2.1.55 Alpha-N-arabinofuranosidase
  misc_feature: Useful for making plants with altered carbohydrate content
  misc_feature: Useful for making plants with altered cell wall content and/or composition
SEYAVTGNDAGKGTLVAALAEAAFLIGLERNSDVVEMASCAPLFVNDNDRRWSPDAIVFNSWQHYGCPNYWMLHFFKDSSGAALHPTTIQISDYDQLVASAITLQNATDRSPYLRIKVVNFGNRAVDLNISVVGLANGIKMSGSKQTVLTSSNPLDENSFEQPEKVAPVSSPLANAKPQMGLSVRPYSLTSFDLLLEASKHASI

SEQ ID NO: 40031 - DNA, 701 bp, Panicum virgatum
  misc_feature: Ceres CLONE 2000875
  misc_feature: Encodes the peptide sequence at SEQ ID NO. 40032
aaaaaaaaaaaaaaaaaaattgtgttgcatttccatcggttatatgaacactaccctactctagtctcttgtcttgtgttgcaaaattagtaccaagaaagaagatgcggggtttgaggagctcaagcagcctactagtggcggcagcagcactgctgctcttctgctgctgcttcaccattggggacgccaatggcggccttaggctgggttactactcggcgagctgcccgcgcgcggaggacgtcgtcagggagcaggtggcgcagctgtacgacaagcacggcaacacagcggtgtcgtggctgcgcgccctgttccacgactgcatggtcgggtcctgcgacgcgtcgctgctgctggacacgagcgccgccgcgggcgtctccgagaagtccgccccgcggagcttcggcatgcgcaacttcaagtacgtcgacgccatcaaggcggcgctggagcgggagtgccccggcaccgtctcctgcgccgacgtgctcgccctcgccgcgcgggacggcgccgccgcgctgggcgggccgcgcgtcgccatgcgcacgggccggctggacagccgggtgagccgctacgacgaggtggggcgcgacctccccaaccacaacgacagcgtgtcggcggtgctgtcccggttcgcggccgtgggcgtggacgccgagggcgcggtggcgctgctgggcgcg

SEQ ID NO: 40032 - protein, 198 aa, Panicum virgatum
  misc_feature: Ceres CLONE 2000875
  misc_feature (49)..(198): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MRGLRSSSSLLVAAAALLLFCCCFTIGDANGGLRLGYYSASCPRAEDVVREQVAQLYDKHGNTAVSWLRALFHDCMVGSCDASLLLDTSAAAGVSEKSAPRSFGMRNFKYVDAIKAALERECPGTVSCADVLALAARDGAAALGGPRVAMRTGRLDSRVSRYDEVGRDLPNHNDSVSAVLSRFAAVGVDAEGAVALLG

SEQ ID NO: 40033 - DNA, 746 bp, Panicum virgatum
  misc_feature: Ceres CLONE 2000886
  misc_feature: Encodes the peptide sequence at SEQ ID NO. 40034
gccttttccgcatgctccaccaagccgcagcagcagcaggaggaggcggcggctagcagcagaagagcagaccaacaagagtcggagaagcctcccctagcttcgctatgcagcccatcaaggtgtacgccgaccggcggtcgcagccctcccgagccgtcatcatcttctgcagggtgaatcagatcgatttcgaggagatcacggtggatctgttcaagtctcagcacctcaccgccgaattcagaaaaataaacccgatgggacaagtgcctgcaattgttgatggaagattcaaactatttgagagtcatgctattttgaggtacctcgcatccgtgttccccggagttgcagatcactggtatcctgctgacttgttcaccagagccaaaattgagtcaatcttggattggcatcactcaaatttgcgtcgtggtgcagcaacccttgtaatgcacacagcactggctccctttcttggtcttgcgacaagtcctcatgttgtaaaacaagcagaaaaacttctaatgcagtcactaggaaggattgaatcagtgtggctgaagggtgatgcaaagttcttgctaggtagcccccagccatcaattgcagatctgagccttgtttgtgaaataatgcaattggagatccttggcgatgatgtacgtgaccgatttctgggagctcatgagaagatcctcatctggatggataatgtgaagaaagccaccagccctcatttt

SEQ ID NO: 40034 - protein, 212 aa, Panicum virgatum
  misc_feature: Ceres CLONE 2000886
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
MQPIKVYADRRSQPSRAVIIFCRVNQIDFEEITVDLFKSQHLTAEFRKINPMGQVPAIVDGRFKLFESHAILRYLASVFPGVADHWYPADLFTRAKIESILDWHHSNLRRGAATLVMHTALAPFLGLATSPHVVKQAEKLLMQSLGRIESVWLKGDAKFLLGSPQPSIADLSLVCEIMQLEILGDDVRDRFLGAHEKILIWMDNVKKATSPH

SEQ ID NO: 40035 - DNA, 695 bp, Panicum virgatum
  misc_feature: Ceres CLONE 2000888
  misc_feature: Encodes the peptide sequence at SEQ ID NO. 40036
gagagaggacgtccccaaaggagagagagagagagaggcacgcgcagcatccattccttgccgctgccgccgcacactcccattgcagagccccaccccgcgcaaaagcagagcagccactttcccctcccgctccccatctccgtcctcctcccatggcgagctcgacgcgcggcgcgctcctcctcctcctcgcgctgctggcgctggcggcggcggctcgcgcgggcgacgtgccggcggcggcgctgggctgggagctcggggtggtgggcgccgcggtggacgaggagttcggcttccccgccggcggcgactccgtggcgcgccgggtgctgcagggcgggtccgggtacatcagctacggcgcgctgcggcgggacaacgtgccgtgctccgtgcggggggcctcctactacaactgccgccccggcgcgcaggccaacccctactcgcgcggctgctccgccatcgcccgctgccgcggctgatccctcgcccgcccgcccgcccgcccgcttcggcaccggcgaccgccgggaggaagaggagaaggttcatcccgttaatccctcgccgttcagcagaaaaaaaagggaaactgttcatctgcccctttaatcaattgttattgttattagtgctggtattatttgtcttgtcgtccatgcttagccgaagatgattggtggtgg

SEQ ID NO: 40036 - protein, 111 aa, Panicum virgatum
  misc_feature: Ceres CLONE 2000888
  misc_feature (45)..(111): Pfam Name: RALF Pfam Description: Rapid ALkalinization Factor (RALF)
MASSTRGALLLLLALLALAAAARAGDVPAAALGWELGVVGAAVDEEFGFPAGGDSVARRVLQGGSGYISYGALRRDNVPCSVRGASYYNCRPGAQANPYSRGCSAIARCRG

SEQ ID NO: 40037 - DNA, 743 bp, Panicum virgatum
  misc_feature: Ceres CLONE 2000889
  misc_feature: Encodes the peptide sequence at SEQ ID NO. 40038
acctcctccactcgcatcgcgacgtcgcgtccacccgggcacctcccctcgctctccgccctccgtctctccccgccgcggcggcggctgctccccggctgtcaccggacgcgccccgacaactatgaggagatacagtcccccatatcgcagcccccccaggaggggatatggtggcagaggaagaagtcccccacctaggaggggatatggaggacggaaggagggttctggaagtcttttggtccgcaatatcccattaagtgtcagagcggaggatcttcgagttccttttgaaaggtttggtcctgtccgggatgtttacatcccaaaggactattatagtggggagcctcgaggatttgcatttgtggagtttgttgatccttatgatgcctcagaggcccagtatcacatgaaccgccaggttttctttggtcgggagataactgttgttcttgctgctgagtcacgaaaaaggccagatgaaatgcgcaacagagctagagtcaggggttactctggtcatgaaggtcgccgctcttcttattatgggcggtctcgttcccgttcccgctctccacgctatcggggccgtcctcggtcaagatcatactcacctgctccgaggcgacgagatgactactctgtttctccaaggagaaaggaagcacagcacacctctcctcctagacgcccaccaaaggagcttgaagaagataagaggagatcctattctcctg

SEQ ID NO: 40038 - protein, 206 aa, Panicum virgatum
  misc_feature: Ceres CLONE 2000889
  misc_feature (39)..(110): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MRRYSPPYRSPPRRGYGGRGRSPPPRRGYGGRKEGSGSLLVRNIPLSVRAEDLRVPFERFGPVRDVYIPKDYYSGEPRGFAFVEFVDPYDASEAQYHMNRQVFFGREITVVLAAESRKRPDEMRNRARVRGYSGHEGRRSSYYGRSRSRSRSPRYRGRPRSRSYSPAPRRRDDYSVSPRRKEAQHTSPPRRPPKELEEDKRRSYSP

SEQ ID NO: 40039 - DNA, 695 bp, Panicum virgatum
  misc_feature: Ceres CLONE 2000893
  misc_feature: Encodes the peptide sequence at SEQ ID NO. 40040
tcccctcccctcttctcccggcggcgctttagctctagggttctagctcctcctctccggcggcgcgcgcgcatcgacggatcccatctcccagcccggaaggcggcggcgagacccgaggctaggcaaagatggtgagagtcagcgtccttaatgatgcattgaagagtatgtacaacgcagagaagcgtggtaagaggcaagtcatgatccggccctcttcaaaagtgatcatcaagttcctcatcgtcatgcagcgccatggctacattggtgagtttgagtacgttgatgaccatcgggctgggaagatcgtggttgagttgaacgggaggctcaacaagtgcggggtgatcagccctcgctttgatgttggcgtgaaggagatcgaggggtggactgcccggctgctcccatctcgtcagtttgggtacattgtcctgacaacctctgctggcatcatggaccatgaggaagccaggaggaagaatgttggtgggaaagtgctcggcttcttctactgaatgaaagttttgtgaaagtgatcggtgtagtaggatatttatcttatgatgtatcctgtctattcctagttgattaccgaaagcacttaagagggatatttgagctgttttggtagttctgaagaattatgcctgcaaattttatttccaaatgttatcatgtgccactgg

SEQ ID NO: 40040 - protein, 130 aa, Panicum virgatum
  misc_feature: Ceres CLONE 2000893
  misc_feature (5)..(130): Pfam Name: Ribosomal_S8 Pfam Description: Ribosomal protein S8
MVRVSVLNDALKSMYNAEKRGKRQVMIRPSSKVIIKFLIVMQRHGYIGEFEYVDDHRAGKIVVELNGRLNKCGVISPRFDVGVKEIEGWTARLLPSRQFGYIVLTTSAGIMDHEEARRKNVGGKVLGFFY

SEQ ID NO: 40041 - DNA, 752 bp, Panicum virgatum
  misc_feature: Ceres CLONE 2000911
  misc_feature: Encodes the peptide sequence at SEQ ID NO. 40042
ctctaaaccctacccgcgccgccgcctcgcatcgccagccgccgccgcgccgtgcgagctcagaccgaccagcttcaaccatggcggacgtcgatgtcgagcccgaggtcgccgccggcgcgcccaagaagaggacgttccgcaagtacagctaccgcggcgtcgacctcgacgcgctgctcgacatgtccaccgacgacctcgtccagctcttccccgcgcgcgcgaggagaaggttccagaggggtctgaagaggaagcccatggcgctcatcaagaagctgcgcaaggcgaaaaaggatgctcctgccggcgagaagccagagccagtgaggacccatctccgcaacatgatcattgtccctgagatgattggaagcatcattggtgtctacaacggcaagacattcaaccaggttgagatcaagcctgagatgattggccactacctcgctgagttctccatctcctacaagccggtcaagcacggtaggcccggtatcggtgccactcactcctcacggttcattccgctgaaatgagttattagcccagttgtcagcctccagaatccagcacggaaggcgcatggcatgtcttgtttccttccagttgtgctgcttgttttgaacaaagtacataccaatggtgttttgctctgtttcagctctagaatcctagctaagcactgcacaatttatgctgttttgagttaatcttatctatactgcgatgtgggtacttttatcggc

SEQ ID NO: 40042 - protein, 153 aa, Panicum virgatum; identical to SEQ ID NO: 12318
  misc_feature: Ceres CLONE 2000911
  misc_feature (55)..(136): Pfam Name: Ribosomal_S19 Pfam Description: Ribosomal protein S19

SEQ ID NO: 40043 - DNA, 612 bp, Panicum virgatum
  misc_feature: Ceres CLONE 2000919
  misc_feature: Encodes the peptide sequence at SEQ ID NO. 40044
gtatgtccatatcgcgacgtttctgctcttttgcctagcaccattttttatcttcaccctggcagctggcaacattaacaactcctcccttcaatcagcattggggctcactggccttttcctatgcttcttcggtttactgtatggtggcttttggagaatacaaatgaggaagagattcaacctgcccgaaaataccttctgctgccgcaaccccgatgcgacagattgtttccagtggttgttctgctgctcatgttcccttgcccaggaggtcagaaccgctgatcactacgatattacagaggacaggtcacacagagggcaagtgacagaggaaagtccgcgcataatgtccccgttgcgacgtgaagatggttcgcccctgttcaagtcccatccgagttcgccatacaggagtggcaatgctagtccatcgatcttcattctggagagcccatcagctccacgcaggtcatctggatccacgcctcagggtggttcaccgatgaggagcgatagggcgacggaggcaccaaccccttccgtttccacagagaagtttgaccgcgtcatgaaggagctaccagcccaatgagatgataaatgtat

SEQ ID NO: 40044 - protein, 198 aa, Panicum virgatum
  misc_feature: Ceres CLONE 2000919
  misc_feature (2)..(95): Pfam Name: PLAC8 Pfam Description: PLAC8 family
YVHIATFLLFCLAPFFIFTLAAGNINNSSLQSALGLTGLFLCFFGLLYGGFWRIQMRKRFNLPENTFCCRNPDATDCFQWLFCCSCSLAQEVRTADHYDITEDRSHRGQVTEESPRIMSPLRREDGSPLFKSHPSSPYRSGNASPSIFILESPSAPRRSSGSTPQGGSPMRSDRATEAPTPSVSTEKFDRVMKELPAQ

SEQ ID NO: 40045 - DNA, 745 bp, Panicum virgatum
  misc_feature: Ceres CLONE 2000921
  misc_feature: Encodes the peptide sequence at SEQ ID NO. 40046
aaaaatacaagacactactgaagtcgactcgttattagctctagccatggcctcctatgcagtagcaactactctcctttgcgccctcgtcattttctctttggagagaagcgtgttcgcggaagagtatgttgagatgaccctatatacagagacagcgaacgcgggaggaccaaacccgacgctcgcacgttcggtgagcataggcaagcctacatggttcggttcgatccacatgcgtgatcggcatatggtcgatcggctaggttccaacgcaaacaccatcggccgtgtgctgtgcacagatttcaaagtagttgctgacatcgagaacacctggtacacgtacatgaccttgtggttcaagagtggcaggttcaatgggtctacacttcaagtaggaggacttaatacgccgggagatgctgagtgggcaattctgggagggactggcaatcttagaatggcacgtggtattgtccaccgcaaattattggagaaggagcagttcagtgtatacgcatattacacccccatgccctacgtggtggcttcggggcgtgagcttgatacaaacttgtaggctgttcatgctgcatgcatgccaaacaagaagaccaccaatgtttaccacctttgttttatgtttgtttcctaataaatgatcctggatcttcattcaggatttgtgccaagctttagtctttaatatgtctccgcatcaataaagtggtgtgtttttttc

SEQ ID NO: 40046 - protein, 178 aa, Panicum virgatum
  misc_feature: Ceres CLONE 2000921
  misc_feature (15)..(161): Pfam Name: Dirigent Pfam Description: Dirigent-like protein
MASYAVATTLLCALVIFSLERSVFAEEYVEMTLYTETANAGGPNPTLARSVSIGKPTWFGSIHMRDRHMVDRLGSNANTIGRVLCTDFKVVADIENTWYTYMTLWFKSGRFNGSTLQVGGLNTPGDAEWAILGGTGNLRMARGIVHRKLLEKEQFSVYAYYTPMPYVVASGRELDTNL

SEQ ID NO: 40047 - DNA, 596 bp, Panicum virgatum
  misc_feature: Ceres CLONE 2000936
  misc_feature: Encodes the peptide sequence at SEQ ID NO. 40048
acccgcacccgcgccgccgccgccccgcgccccgtcgccgccgccgccccgcgccccgtcgccgccgccgccccgcgccccgtcgccgcagacgcctccgccccgtcgccgcgatgacaaagcgcaccaagaaggccggaatcgtcggcaaatatggaactaggtatggtgctagcttgcgtaagcaaatcaagaagatggaggtgtctcagcactccaagtacttctgcgagttctgtggaaagtttgctgtgaaaaggaaagcagttggaatctggggatgcaaggactgcgggaaggttaaggctggtggtgcttacaccatgaacactgctagtgcagtcactgtcaggagcacaatcggtcgcttgagggagcagactgaagcataatcggagctcttctctgcagtagtcctgtgctttttgtagcgtctaagacatatggctgtttggcctaagaacattcatgaatattctggttatgcttaaggatatcaaaaattatggtgctaaaatttgtacttcgttgctgttgcaaagttgacctgtcttgatccattcatgatgtagaatttcctcatggttcttacactt

SEQ ID NO: 40048 - protein, 92 aa, Panicum virgatum
  misc_feature: Ceres CLONE 2000936
  misc_feature (2)..(91): Pfam Name: Ribosomal_L37ae Pfam Description: Ribosomal L37ae protein family
  misc_feature: Useful for making plants with modulated cold sensitivity
MTKRTKKAGIVGKYGTRYGASLRKQIKKMEVSQHSKYFCEFCGKFAVKRKAVGIWGCKDCGKVKAGGAYTMNTASAVTVRSTIGRLREQTEA

SEQ ID NO: 40049 - DNA, 645 bp, Panicum virgatum
  misc_feature: Ceres CLONE 2000963
  misc_feature: Encodes the peptide sequence at SEQ ID NO. 40050
gaaaaacccttgttttatttccgcagctcctccctcccttgtccgctccaccgccctgctctgcccaagcagcacgcgcatcgcgctcccagatccccctcccgcattccccgaggccagcttgtagtgaacacgatgagtgcttcagcagctgctggtgtgaagatggtgtctgcacgcccctgcatctcggcttcacaaggaatgcttgcctcgagggcagcggtttccaggattgaaaccaccgctagatttgcaagctgccccaaaatctgctgctccaggcctcttggttctaagcgtgctggttttgtcgtaagagcaatgtcaggagagagtggcccacaggggcttcccattgatctcagaggtaaaagggcatttattgctggagttgctgatgacaatggctatggatgggcaattgcaaaagctcttgctgcagctggtgcggaaattcttgttggtacatgggtgccggcacttaacatatttgagacaagtctgaggcgtggaaagttcgacgaatcacgcaagttgccagatggatctcttatggatattgttaaagtctatccacttgatgctgtctcatctaagcactgtatggatcttcatctctgttatatctgcatccgcattttc

SEQ ID NO: 40050 - protein, 169 aa, Panicum virgatum
  misc_feature: Ceres CLONE 2000963
  misc_feature: SWISSPROT Homolog: EC 1.3.1.9 Enoyl-[acyl-carrier-protein] reductase (NADH)
  misc_feature: The sequence is a functional homolog of SEQ ID NO 2 in US patent 7141721
MSASAAAGVKMVSARPCISASQGMLASRAAVSRIETTARFASCPKICCSRPLGSKRAGFVVRAMSGESGPQGLPIDLRGKRAFIAGVADDNGYGWAIAKALAAAGAEILVGTWVPALNIFETSLRRGKFDESRKLPDGSLMDIVKVYPLDAVSSKHCMDLHLCYICIRI

SEQ ID NO: 40051 - DNA, 696 bp, Panicum virgatum
  misc_feature: Ceres CLONE 2000964
  misc_feature: Encodes the peptide sequence at SEQ ID NO. 40052
gaaagattcaattatgatttcggaatatccatctcttgttgaggaatggactaatgatagacttgaaaacgaaatggacattgtcttagatgccgtgaacagaataagatcgatgaagccaccaacagattcaaatgaaagacgacctgcttttgcactttgccgaggccaagagattgctgccactatccaatgctatcaatatctaattgtgtctctttcctccgtatcacatctcaagatcctgacagagaacgatgaaactccagctgactgtgccactgctgttgtaaataaagacttatctgtgtaccttcagctccaaggagctctaaatgcatatgctgaacgtgaaaaactaaggaagaaaaaggatgaaattcaaaagctacaaaatgccttgacacagaaaatggacgcctctggttaccgtgacaaggctccacagaatgtgcaggaagaggacatgagaaagctcacggcattattggaacaactagaggtcatcagtgaagctgagaagaaattagatgcaaaaattggaaataactgagtcttgcctctgttttaaagatgctctgcttgtaccaaagttgatcccacattttttttactggaaagttagttatgcacctgtattctcaggtatagaattgatggttttgatcgaaataaagccacattttccagcatgta

SEQ ID NO: 40052 - protein, 183 aa, Panicum virgatum
  misc_feature: Ceres CLONE 2000964
  misc_feature: SWISSPROT Homolog: EC 6.1.1.9 Valine--tRNA ligase
KDSIMISEYPSLVEEWTNDRLENEMDIVLDAVNRIRSMKPPTDSNERRPAFALCRGQEIAATIQCYQYLIVSLSSVSHLKILTENDETPADCATAVVNKDLSVYLQLQGALNAYAEREKLRKKKDEIQKLQNALTQKMDASGYRDKAPQNVQEEDMRKLTALLEQLEVISEAEKKLDAKIGNN

SEQ ID NO: 40053 - DNA, 714 bp, Panicum virgatum
  misc_feature: Ceres CLONE 2000966
  misc_feature: Encodes the peptide sequence at SEQ ID NO. 40054
atttcctcaaccgaagccctacccacccatccaccccggcggcggcggcggcggcgtagcagcagcagaagcacccgaagatggtgaagttcctgaagcccggcaaggccgtgatcctcctccagggccggttcgccggccgcaaggcggtgatcgtgcgcgtgttcgaagagggtacccgcgaccgcccctacggccactgcctcgtcgccggcctggccaagtaccccaagaaggtgatccgcaaggactccgccaagaagaccgccaagaagtcccgcgtcaagtgcttcatcaagctcgtcaacttcacccacatcatgcccacccgctacacgctcgacgtcgacttcaaggacgtcgcctcgggcgggcccgacgcgctctctacccgggacaagaaggtcgccgcttgcaaggccgccaaggcgcgcctcgaggagaggttcaagaccggcaagaacaggtggttctttaccaagctccgcttctagatgcttggcgtcccgcatagtgcctgctttaggtgtcagtttcttgtatcggacactctttaagctatctctgctttggtattgccatgaagcctttgtgcttagtattacggatctcggagataattttattaagacatgtcgttgatgtgctaaatgttgtcaatcatagatctggctgaaattttgttccgaattgctgcttgagatgtgttgattt

SEQ ID NO: 40054 - protein, 137 aa, Panicum virgatum; identical to SEQ ID NO: 33860
  misc_feature: Ceres CLONE 2000966
  misc_feature (52)..(137): Pfam Name: Ribosomal_L27e Pfam Description: Ribosomal L27e protein family
  misc_feature (7)..(40): Pfam Name: KOW Pfam Description: KOW motif

SEQ ID NO: 40055 - DNA, 681 bp, Panicum virgatum
  misc_feature: Ceres CLONE 2000968
  misc_feature: Encodes the peptide sequence at SEQ ID NO. 40056
agaggcacggccaaaaattttccgaggttttcgcctctcgcagcgcaccagcgccacccggagcggctcgccgtcggcgcggaggaggagagcggaggaggctacgcgatggcggaagagaatgctggaaagaaagaggaggaggaatttagcacaggtcctctgtccgtcctaatgatgagtgttaagaacaacacccaggtgcttatcaactgccgcaacaacaagaagctgctcggccgtgttcgtgcttttgatcgccactgtaacatggtgcttgagaacgtgcgggaaatgtggacagaggtccccaagaccggcaagggcaagaagaaggctctgcctgtgaacaaggacaggttcatcagcaagatgttcctcaggggtgactcagtcatcatcgtgctgagaaacccaaagtgagcgtccagcaagccaccttgatctggggtttgaggaagccatgtatctgttgaagactgtagcttatctacttatctatgtttttggaggattaaccagtagtctggaaccgctgcttatgtggcatggtgatggcgcatgagcacacgtttcatgagtttgttaactggagtatgtacttgccaactgctgtattttgatcacggtatgctgtgcttgtgtttctgattatggaacttgtgcgatgtgatctttatc

SEQ ID NO: 40056 - protein, 104 aa, Panicum virgatum
  misc_feature: Ceres CLONE 2000968
  misc_feature (22)..(101): Pfam Name: LSM Pfam Description: LSM domain
MAEENAGKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPK

SEQ ID NO: 40057 - DNA, 725 bp, Panicum virgatum
  misc_feature: Ceres CLONE 2000969
  misc_feature: Encodes the peptide sequence at SEQ ID NO. 40058
tcagagatagatccctggaactcattgatcaaggtcttagtggtccaattgatgcacaagggttccagaatgctctatatatgatagacatagggcagaatgatgtaaacgctcttctgtccaacttgccctatgatcaagttattgccaaattcccgccaatacttgctgagattaaggatgctgtgcagactctgtataacaatgggagtcgaaacttttggatacacgggactggtgctctcggttgcctgcctcagaagcttgctataccgaggaaaaacgacagtgatcttgatcagtatgactgtctcaagacctacaacagagctgccgttgcattcaacacagcgctggacagcctatgcgatcagcttagtgcgcagatgaaagacgcgacaatagtgtacaccgatctattccccatcaagtatgatctggttgccaaccacactaaatatggcttcgacaagccgctgatgacatgctgtgggtacggagggcctccctacaactatgatttcaacaaaggctgtcagtctaaggatgtgacggcctgcgacgacggctctaagttcgtcagctgggacggggtgcacctcacggaggccgccaatgccgtcgtggccaaagcgatactgagctctcagtactccaaacccagcctcaagtttgatcagttctgcagggtctgatacttgctcatacctgatactgtaccttcc

SEQ ID NO: 40058 - protein, 230 aa, Panicum virgatum
  misc_feature: Ceres CLONE 2000969
  misc_feature (2)..(212): Pfam Name: Lipase_GDSL Pfam Description: GDSL-like Lipase/Acylhydrolase
  misc_feature: SWISSPROT Homolog: EC 3.2.1.51 Alpha-L-fucosidase
RDRSLELIDQGLSGPIDAQGFQNALYMIDIGQNDVNALLSNLPYDQVIAKFPPILAEIKDAVQTLYNNGSRNFWIHGTGALGCLPQKLAIPRKNDSDLDQYDCLKTYNRAAVAFNTALDSLCDQLSAQMKDATIVYTDLFPIKYDLVANHTKYGFDKPLMTCCGYGGPPYNYDFNKGCQSKDVTACDDGSKFVSWDGVHLTEAANAVVAKAILSSQYSKPSLKFDQFCRV

SEQ ID NO: 40059 - DNA, 731 bp, Panicum virgatum
  misc_feature: Ceres CLONE 2000974
  misc_feature: Encodes the peptide sequence at SEQ ID NO. 40060
  misc_feature (662)..(662): n is a, c, t, g, unknown, or other
acgtggtgcgtgttctggaccttgaaggctgtgatggtccggtatgcttggacggcctgtgcaaactggtcctgctgaggtacctgagcctcagaggcaccgctgccagtgagctcccagcagcaattggggatctaaggtgtctggagacacttgatgtgagatcaacaaaggtggaagaggtgcctgtgagtattctcaggctggaaaacctaatgcatttgcttgctgggagtgccaaggtgcctgaaggcatcgttaagatgaaggccctgcagacattgtcatgcggtggcaccacaaagagctctgtgaacttcattgaagagatcagtaaacacgataacttgagggagctggaattgtattctgatgctactgaaacgcctgggaacaagaagcgtgtcatgttccctgctcatggattccggagtgttaaaaaactgtgcatctggtgcccctcaccattggtgacctttgagcccaatgcactgccagcagtccaagtgcttgaactgaggttccagaaaggccttgctgatggatcgagtggcgtgtctggcaaggagaatctgtcaagcctgaagcatctgctccttgagtttgagcagaacgatgcgggtgccatggcaactgtcaatgctgtgaggaactctcctcangctgtcctcccagatcatctatatatcgctatcaaggtggatggtaagagctattaatatggtgcagat

SEQ ID NO: 40060 - protein, 238 aa, Panicum virgatum
  misc_feature: Ceres CLONE 2000974
  misc_feature: SWISSPROT Homolog: EC 4.6.1.1 Adenylate cyclase
  misc_feature (220)..(220): Xaa is any aa, unknown, or other
VVRVLDLEGCDGPVCLDGLCKLVLLRYLSLRGTAASELPAAIGDLRCLETLDVRSTKVEEVPVSILRLENLMHLLAGSAKVPEGIVKMKALQTLSCGGTTKSSVNFIEEISKHDNLRELELYSDATETPGNKKRVMFPAHGFRSVKKLCIWCPSPLVTFEPNALPAVQVLELRFQKGLADGSSGVSGKENLSSLKHLLLEFEQNDAGAMATVNAVRNSPXAVLPDHLYIAIKVDGKSY

SEQ ID NO: 40061 - DNA, 684 bp, Panicum virgatum
  misc_feature: Ceres CLONE 2000977
  misc_feature: Encodes the peptide sequence at SEQ ID NO. 40062
ttacttggacgtttgctgggagaaagaagagattgatgaagagaagagcacagcactacggaagaccaagtcaataatactcactaatagctctgcatgcaaattgaagttgggagatttgaagggtgctttgttggatgcggattttgcactgcgtgaaagggagggaaatgctaaggcttttttccgacaaggacaggcacacattgcacttaatgacattgatgcagcagtggagagcttcaagcacgcactggagttggagccaaatgatggtggaatcaaaagagagctggctgctgcaaagaagaagattgctgatagaagaaatcaagagcggaaggcatttgctaggatgttccaaccttctggaaaatctgataagagcagcgaagagaacaattgatctgcagtttctttcccccggcagaaactttggttggttaaatctgggacacataccgggacaggagtaacaagggaatctgtgctgcaaaaattaagattccctatcttagatagaaggaaacatagtggggggatggaaagcttttgttttctcttactacagaaactagcaattcgtgcgtgtgtcccagtgttgttcttcatgaaaaagccaggacattaaacttaacaatgcaattttcagacgttgcagtaagtcttgccattagaccgttc

SEQ ID NO: 40062 - protein, 134 aa, Panicum virgatum
  misc_feature: Ceres CLONE 2000977
  misc_feature (58)..(91): Pfam Name: TPR_1 Pfam Description: Tetratricopeptide repeat
  misc_feature: SWISSPROT Homolog: EC 5.2.1.8 Peptidylprolyl isomerase
YLDVCWEKEEIDEEKSTALRKTKSIILTNSSACKLKLGDLKGALLDADFALREREGNAKAFFRQGQAHIALNDIDAAVESFKHALELEPNDGGIKRELAAAKKKIADRRNQERKAFARMFQPSGKSDKSSEENN

SEQ ID NO: 40063 - DNA, 755 bp, Panicum virgatum
  misc_feature: Ceres CLONE 2001010
  misc_feature: Encodes the peptide sequence at SEQ ID NO. 40064
agccctcagcccctcacctagctctattcaagcagaagcagtactaccagtacagcttctcctctggcccttcgacaacgcagcaaacctccactgttcaaggtagagccagaggatgatgaggcgttgcggcggtctctcttcgccgctcgcggctgtgtcccttctcctcctcctcatctgcttcttccaccgcgcggcggcggctcgccccctgccggctgctgctgctgctgttcctcttcaggttcaccaagaggatgtagccaaggtggctgcagatggcgagccggtgcttcagaaaggctccgcgggtagtgacgatgagctctcggtctcatcagtcgagctctcggtgatgatgggagcagaggaggaggaggcggaggagccggcgtgcgaggaggggaacgacgactgcatgcagcggcggctgctccgcgacgcgcacctcgactacatctacacccagcacaagggcaagccataagcgaggatccccatcttctctggcgtacgttgggagtgtgtgggtgggggacaaagtcgtacatgctgcaaagttgacactgctgggaatctcatctctagtatatctctaccgtctgctagctacctgcttacaatttctctgccactgatcaaccagtatccggggatccatgtaggattaatatatgtgtgtgactgtgtcatcacctcgtttgtacatcgtctctcttggagtcttggtcatgtataatacatgcatcatt

SEQ ID NO: 40064 - protein, 124 aa, Panicum virgatum
  misc_feature: Ceres CLONE 2001010
  misc_feature (18)..(123): Pfam Name: PSK Pfam Description: Phytosulfokine precursor protein (PSK)
MMRRCGGLSSPLAAVSLLLLLICFFHRAAAARPLPAAAAAVPLQVHQEDVAKVAADGEPVLQKGSAGSDDELSVSSVELSVMMGAEEEEAEEPACEEGNDDCMQRRLLRDAHLDYIYTQHKGKP

SEQ ID NO: 40065 - DNA, 730 bp, Panicum virgatum
  misc_feature: Ceres CLONE 2001012
  misc_feature: Encodes the peptide sequence at SEQ ID NO. 40066
atcttctttctccctctctcaaaagtcagatctcgatctgcttgctggctgcctcgttcaccttctaccccacccccatcatccagcggcaagtgcccggtgaacgcgctcaaattcggcgtgtgcgtcaacgtgctcggcctcgtcaagggcgaggccggcaaggtgcccgctgagccgtgctgcagcctcctcaacggtctcgccgacttggaggccgccgtctgcctctgcacggccatcaaggccaacgtgctcggcgtcgccatcgacatccctatcaagctcagcgccctcgtcaactactgtggcaagtgcgtgcccaaaggctacacctgtgcgtaaacacgccgcggctacacgctcgtatagccgctcacgcaatctgcatggcatatatacgtgcgttgggtttgctgctgaactcttctgtctcatttgtgcatgcaacttcggttctgcaacctagaaccatgcatttcgtccaaatgctttgtcagtttgtgtgtattgcattgtgtctcttgacgaatttcctttcatttttgaatttgttcataagaggcatgcatctctccttgaagtgaacaagaggagtagtgttgcttctagttattacaaatcatgtaatctgttgggaaacatttatcgtgtatgtaaaatcaagcgcttgaactatctgtaataatacttatttcgttaattgttccttctctttcgaagggataat

SEQ ID NO: 40066 - protein, 114 aa, Panicum virgatum
  misc_feature: Ceres CLONE 2001012
  misc_feature (32)..(113): Pfam Name: Tryp_alpha_amyl Pfam Description: Protease inhibitor/seed storage/LTP family
  misc_feature: Useful for making plants with modulated biomass
  misc_feature: Useful for making plants with modulated flowering time
  misc_feature: Useful for making plants with modulated oxidative stress sensitivity
IFFLPLSKVRSRSACWLPRSPSTPPPSSSGKCPVNALKFGVCVNVLGLVKGEAGKVPAEPCCSLLNGLADLEAAVCLCTAIKANVLGVAIDIPIKLSALVNYCGKCVPKGYTCA

SEQ ID NO: 40067 - DNA, 631 bp, Panicum virgatum
  misc_feature: Ceres CLONE 2001063
  misc_feature: Encodes the peptide sequence at SEQ ID NO. 40068
aaccctagaagccccctgcctccagcgcctccaccctcctcgccgcctctctccctctgagaccgcagatccttccggtgagaggaacccgcccgccgccatgtcgatcgctgagctcgcctgcacctacgccgccctcatcctcagcgatgacggcatcccgatcacggccgagaagatcgcgacggtcgtgaaggccgcgaacgtcaaggtggagtcttactggcccgcgctcttcgccaagctcctggagaagcgcagcgttgaggacctcatcctctccgttggatctggtggtggtgcggccccagttgctgctgctgcccctgctggtggtgctgcagcagcagctgccccggctgttgaggagaaggaagaggccaaggaggagtctgacgatgacatgggcttcagcctgttcgactgaggagaccctggcccagccattagcaaattcacttatgctgtccaagacttatcttatattatgtctctaggcttttgttacaagtactcaagttttgagtttttgagatgtgctatggctatgtgatgaaccgcaaaccatcttattagagtgaaacctgtttctatgttgtgttcaatcttaaatggttcttgaggtctgttt

SEQ ID NO: 40068 - protein, 108 aa, Panicum virgatum; identical to SEQ ID NO: 26139
  misc_feature: Ceres CLONE 2001063
  misc_feature (21)..(107): Pfam Name: Ribosomal_60s Pfam Description: 60s Acidic ribosomal protein

SEQ ID NO: 40069 - DNA, 686 bp, Panicum virgatum
  misc_feature: Ceres CLONE 2001073
  misc_feature: Encodes the peptide sequence at SEQ ID NO. 40070
catccctctcctcatcccttgcgcagttgcgctgcgcatatatcagccgggggccttgggacctcccgcccccgcatccatccatccgtcccctcgaagcaatcgactggaattggaaagaagcgagggacgagagcagcagcgcccgccgtcggcatgggtctgcaggaggaatttgaggagcacgcggagaaggccaagaccttgcctgactccactacagatgagaacaagctgatcctctacgggctctacaagcaagcaaccgttggtgatgtcaacactgggcgtcctgccttctacgacctgaaaggcaaagctaaatgggatgcttggaaggccgttgaagggaagtccaaggaggaagcgatgactgattacatcaccaaggtgaagcagctgctggaggaggctgctgctgcatccacttcctaggccacgaaaacaccaccatccatagtgctgcgtgcatcaataagtaataaacattgttatctgtcagatggctccaggtttcatctatacatgtaattgttcgtcgtcatggatgttcagtgtcgtttaaggctgcaaaactcatgtgaaaacaaatggatgctgtctcagctcatcaccttatggatcttcaaactctgttatttctgcacccgcattttcatgcccatgagtacagtacgagtctgcag

SEQ ID NO: 40070 - protein, 92 aa, Panicum virgatum; identical to SEQ ID NO: 26083
  misc_feature: Ceres CLONE 2001073
  misc_feature (3)..(87): Pfam Name: ACBP Pfam Description: Acyl CoA binding protein
  misc_feature: SWISSPROT Homolog: EC 5.3.3.8 Dodecenoyl-CoA isomerase

SEQ ID NO: 40071 - DNA, 673 bp, Panicum virgatum
  misc_feature: Ceres CLONE 2001078
  misc_feature: Encodes the peptide sequence at SEQ ID NO. 40072
acaatttttccaattttccaccctcccctccccgctccgtcgtcgtctgagttgccgtgacgagtgggcagtggagcaggggggaggaaggagattccatagacaaaataggacacgtcttcctccgcgaagtgcgccctcctcctcgcttggcctccctcctcctcgcttggccgtaacccctcgcttctcgcgctgttcctttcctggttccaacaactcgtaaggccgccgttcgtctccgcctcgggggaagatgatgatcgcgcggcgcctgctccgatcaaatgcctccgcccagtggctacaggcaagcagcttggtgaagtatgtaaccagcacagcaactttgcaagggcaagcagaatgtttgtcggatacatcaatcagacattttagttcagcgtcatctgcccaatctgactcaactgaagaaaatggatttaaggggcatggcatgttggcaccctttacagctggctggcagagcaatgacttgcatccactgattatcgagagatctgagggttcctatgtttatgacataaatggaaataagtacctagattctcttgcaggactatggtgtacagctttaggtggtagcgagcctcgattagtcaaagcagcaactgatcaattaaacaagttacccttctatcattccttttgg

SEQ ID NO: 40072 - protein, 138 aa, Panicum virgatum
  misc_feature: Ceres CLONE 2001078
  misc_feature: SWISSPROT Homolog: EC 2.6.1.62 Adenosylmethionine--8-amino-7-oxononanoate transaminase
MMIARRLLRSNASAQWLQASSLVKYVTSTATLQGQAECLSDTSIRHFSSASSAQSDSTEENGFKGHGMLAPFTAGWQSNDLHPLIIERSEGSYVYDINGNKYLDSLAGLWCTALGGSEPRLVKAATDQLNKLPFYHSF

SEQ ID NO: 40073 - DNA, 698 bp, Panicum virgatum
  misc_feature: Ceres CLONE 2001086
  misc_feature: Encodes the peptide sequence at SEQ ID NO. 40074
tcgtcttcttccccaccccacccccgagctcctcagatcagatcggcgaaagcccaaatcccaagcagaggagcgaaatctcgagcgctcgtgccggcgaagaccacgagaaggaggccgcggcacgagagctccccaggcatctgtttctcttcgcagcgccagcggcagcggcgttagcagcggcagcagcagcaagagggagatgtctgcgttcagcggcgatgagaccgcccccttcttcggcttcctcggcgccgccgccgcgctcatcttctcatgcatgggggcggcgtacgggacagccaagagtggcgtaggcgtagcgtccatgggtgtcatgcgccctgagctcgtcatgaagtccatcgtgcccgtggtcatggctggtgtgctcggtatctacggcctcatcattgccgtcatcatcagtactgggatcaaccccaaggccaagccatactacctcttcgacggctatgcccacctgtcgtctggcctagcctgtggtcttgctgggcttgccgccggcatggccattggcattgtcggtgatgctggtgtgagggctaacgctcagcaacctaagctgttcgtgggcatgatcctcatcctcatttttgccgaagcactcgccctctacggtcttatcgtcggcatcatcctctcatcccgcgcgggccagtcccgtgcagact

SEQ ID NO: 40074 - protein, 164 aa, Panicum virgatum
  misc_feature: Ceres CLONE 2001086
  misc_feature (92)..(157): Pfam Name: ATP-synt_C Pfam Description: ATP synthase subunit C
  misc_feature (13)..(78): Pfam Name: ATP-synt_C Pfam Description: ATP synthase subunit C
  misc_feature: SWISSPROT Homolog: EC 3.6.3.14 H(+)-transporting two-sector ATPase
MSAFSGDETAPFFGFLGAAAALIFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 40075 - DNA, 678 bp, Panicum virgatum
  misc_feature: Ceres CLONE 2001103
  misc_feature: Encodes the peptide sequence at SEQ ID NO. 40076
gcaacaagccacagctcaactgcatcagcgagttgcagcagagatcgagatggagatccgcggcatgggcaccaccgccgtcctcgctctcctcgtcgccggcggcggctacgtgtgccgcgactgggtcgtgagcctgctcgagccgcccgtgtgcacgccgaggccgtgggactgctgcgacgccgccgtctgcaccagggagtacatccccttctgccgctgcgccgacgaggtggaggcgtgccccagcaactgcagcgagtgcgagctggcggaggcggacccgccccgctaccgctgcctcgaccagttccacggctaccctgggcccaagtgcacgccgttgccgtggatgggcaactagcccagcacgtacacgcccgatcagctatatctacggacacgtacgtacgtccacaaataaataaaattagctactgtagcaagtgattgttcatccgccgtggacaattagctaccctgctcgctagctgctactgtatttcgtgcaactcaataagagacgtgcccaagtagacctcggtcccaagtgcagatcagagtggagatagatatgatcaaccgagtacagtactacactactactgcacgttgatccattgtgcaagtacgtactccctcgtactaatgcgtccatgcgacaccgtgttgtgg

SEQ ID NO: 40076 - protein, 105 aa, Panicum virgatum
  misc_feature: Ceres CLONE 2001103
  misc_feature (69)..(93): Pfam Name: Bowman-Birk_leg Pfam Description: Bowman-Birk serine protease inhibitor family
  misc_feature (43)..(67): Pfam Name: Bowman-Birk_leg Pfam Description: Bowman-Birk serine protease inhibitor family
MEIRGMGTTAVLALLVAGGGYVCRDWVVSLLEPPVCTPRPWDCCDAAVCTREYIPFCRCADEVEACPSNCSECELAEADPPRYRCLDQFHGYPGPKCTPLPWMGN

SEQ ID NO: 40077 - DNA, 677 bp, Panicum virgatum
  misc_feature: Ceres CLONE 2001112
  misc_feature: Encodes the peptide sequence at SEQ ID NO. 40078
acaacctctttctcgacccctctccgcagcccgcgaccaccacctcctctcgccgccgccgccgccgccgcgaggcttaggaaccaccccatctccgcaaaatggcggctgcagcggctaggagcctgctcctgagacacctccgcgtgccggcagccccgtcggcggccaccgtcaggccggcggcggcgctgcagggggccctttgggggcggcggtggatgtcgtcggatgagaccaagggttcgttcctcgacaagagcgaggtcaccgaccgcatcatcaaggtcgtcaagaacttccagaagatcgacgacccctccaaggtgacaccagatgcccatttcaagaatgatcttggcctcgacagcttggacacggtggaggttgtcatggctttggaagaggaatttggttttgagatacctgacagcgacgctgacaagattgactctgttaaactggcagttgacttcattgcctcacaccctcaggcaaaatgagcatacttttatgtggtataaatgcttagctttactatccacaccgagaacattacctcctctgcatgatatctagtcttgtgatttcgacattgtactgctagcccttttttgaatgttatctctgagatccgagctgtggattctctagaccaaataatatatttgaatgtg

SEQ ID NO: 40078 - protein, 133 aa, Panicum virgatum
  misc_feature: Ceres CLONE 2001112
  misc_feature (58)..(126): Pfam Name: PP-binding Pfam Description: Phosphopantetheine attachment site
  misc_feature: SWISSPROT Homolog: EC 6.1.1.13 D-alanine--poly(phosphoribitol) ligase
MAAAAARSLLLRHLRVPAAPSAATVRPAAALQGALWGRRWMSSDETKGSFLDKSEVTDRIIKVVKNFQKIDDPSKVTPDAHFKNDLGLDSLDTVEVVMALEEEFGFEIPDSDADKIDSVKLAVDFIASHPQAK

SEQ ID NO: 40079 - DNA, 700 bp, Panicum virgatum
  misc_feature: Ceres CLONE 2001115
  misc_feature: Encodes the peptide sequence at SEQ ID NO. 40080
aagcacacagagatcagtaaccaagcaatcagcggttctcaccaccaaattcaagaactcaggaggcatctgtctcctctgctctcgcgttagcgaagccagcacccagcagagaagcatgatggcggcaagagcaggagcgttggcggtggcgtgcctcgtggccgccgtggcggcggcgctgctggcctcgccggcgtcggcgcaatcggggtcgtgcacgaccacgctgatcagcctgtacccgtgcctgaactacatcagcggcaatgtgtcgacgccgccgtcctcgtgctgctcgcagctcgccagcgtcgtgcagtccaagccgcagtgcctctgcgccgcgctcagcggcgactcgtcgtccctcggcgtcaccatcgacaagaagcgcgcgctcgagctccccaaggcctgcaacgtcgataccccgccggcgagcaagtgcaactctgccggcggcggcaacgcaccgggcgccgcgacaccgaccacgccgtcggccggcgtgccagcgaccgcaggggccagcggcggatcgaaggcgacgccgacggcgccctacctgacatctggcgctggcgctggcgcgtcgatccggggggcggtgagcctggcgctcgcattcgcggctgtcgccgtctacgcggcctcggcggccgtgtgggcatctcggctcagctagctatgttttgct

SEQ ID NO: 40080 - protein, 188 aa, Panicum virgatum
  misc_feature: Ceres CLONE 2001115
  misc_feature (33)..(110): Pfam Name: Tryp_alpha_amyl Pfam Description: Protease inhibitor/seed storage/LTP family
MAARAGALAVACLVAAVAAALLASPASAQSGSCTTTLISLYPCLNYISGNVSTPPSSCCSQLASVVQSKPQCLCAALSGDSSSLGVTIDKKRALELPKACNVDTPPASKCNSAGGGNAPGAATPTTPSAGVPATAGASGGSKATPTAPYLTSGAGAGASIRGAVSLALAFAAVAVYAASAAVWASRLS

SEQ ID NO: 40081 - DNA, 666 bp, Panicum virgatum
  misc_feature: Ceres CLONE 2001123
  misc_feature: Encodes the peptide sequence at SEQ ID NO. 40082
aaaagcaaggcacatgtaacaatccaaggtgcaaagcgcttcaagtatggctaggtcccacgcagctcttctgctcctcttggtcggcgccatagcggcgtcaggttatcagtatcaacgggactcggtgggctcgacgttcttcctccagcacgatctgtaccccggatccaagatgacgctccatttcagccccaccgcgccgggggtgcccgcgctcacgcgcgcccgcgccgacgccatccccttcgcctccgccaagatccgcgagatcctcgccctcttctccatcccggcgggctcccccgcagccgacgcggtgcgcttcaccctggccgagtgcgaggccccaccagtgccgggcgtggcggcgcagcggtgcgccacctccccggaggccatggtcgacttcgcggcctcctggctcggcacccgggccatccacgcgggcaccaccaggctcggcagcagcagggacggaggggcggcggcgccgccgaggcaggcgtacgtggtggagtccgtccggccgctgccggtggtcggccggggcatggtggcttgccactccctgccctacccgtacgcggtgttcgggtgccacaccaccaccgccgccgtgttcagggtggcgcttgccggggccgacgggagcagggctgaggc

SEQ ID NO: 40082 - protein, 206 aa, Panicum virgatum
  misc_feature: Ceres CLONE 2001123
  misc_feature (30)..(205): Pfam Name: BURP Pfam Description: BURP domain
MARSHAALLLLLVGAIAASGYQYQRDSVGSTFFLQHDLYPGSKMTLHFSPTAPGVPALTRARADAIPFASAKIREILALFSIPAGSPAADAVRFTLAECEAPPVPGVAAQRCATSPEAMVDFAASWLGTRAIHAGTTRLGSSRDGGAAAPPRQAYVVESVRPLPVVGRGMVACHSLPYPYAVFGCHTTTAAVFRVALAGADGSRAE

SEQ ID NO: 40083 - DNA, 669 bp, Panicum virgatum
  misc_feature: Ceres CLONE 2001129
  misc_feature: Encodes the peptide sequence at SEQ ID NO. 40084
acccgccgccgccgcccgccgtcgccgctctcgctcgcaccgtcgcatcgccgcaggattcgcaaagatggcggtgccgctgctgacgcagaagatcgtgaagaagcgggtgaagcagttcaagaggccccacctcgaccgctacaagtgcctcaagccaagctggcgcaggcctaagggtattgactcccgcgtcaggcggaagtttaagggatgcaccttgatgcccaacattggatacggctctgacaagaagaccaggcactaccttcccaacaagttcaagaagttcgttgtacacaatgtctctgagcttgagctgcttatgatgcacaacaggacgtactgtgctgagattgcccacaacgtctccacccgcaagcgcaaggagattgtcgagcgcgctgcgcagctggacatcgtggtcaccaacaagcttgccaggctccgcagccaggaggacgagtgaaatgttcagtagttgcagttgcagttgcagttgcagttgcgttagagcagtactgagattgaagatacctttccagtttccaccatttgtatgcttgtgttagacttgttctgtaaacgaaattttgctatgagtgaatggcgaaccccatctagttttgacctgacatccataaagtgtgagtgatttcctatcgcttc

SEQ ID NO: 40084 - protein, 133 aa, Panicum virgatum; identical to SEQ ID NO: 32446
  misc_feature: Ceres CLONE 2001129
  misc_feature (14)..(123): Pfam Name: Ribosomal_L32e Pfam Description: Ribosomal protein L32

SEQ ID NO: 40085 - DNA, 671 bp, Panicum virgatum
  misc_feature: Ceres CLONE 2001133
  misc_feature: Encodes the peptide sequence at SEQ ID NO. 40086
acccaccgtgcgccaccattttcccctcctcatctcgcccgccgtcctctcctcctcgatctcctcgcacctcgcatccgcagctctccccggcgcttaaccaaggagcggcggcgatggcggcgaggctggcgcagctgcgcgcgcaggcggcgcgtgcggcggagctcgcctcgaagcacggctgcgcctactacaaggaggtcatggagaagaacaagcagtacatagtgcagccccccaccgtcgagaagtgccaggagctctccaagcagctcttctacacccgcctcgcaagtctaccaggccgctatgaagcattctggaaggagcttgatggtgtcaagcaggtatggaagaacagaaaggagctcaaggttgaggaccttggggttgcgactttatttggagttgagctttatgcatggttctgcgtaggcgagattgttggcagagggtgcaccttaaccggctataaggtctagatgatttctcctggttaagacctgctttgcaatctatacttttagctgatgcttgtcgaaacgacgatgatacctgccttcattcacaattttgtttcttaaaaagagtttctctagtgctgaatgtcagcaaggacgggcacatcgttgcaacattgcctcaataatttgctcgctcgattgtcc

SEQ ID NO: 40086 - protein, 122 aa, Panicum virgatum
  misc_feature: Ceres CLONE 2001133
  misc_feature (8)..(122): Pfam Name: ATP-synt_G Pfam Description: Mitochondrial ATP synthase g subunit
MAARLAQLRAQAARAAELASKHGCAYYKEVMEKNKQYIVQPPTVEKCQELSKQLFYTRLASLPGRYEAFWKELDGVKQVWKNRKELKVEDLGVATLFGVELYAWFCVGEIVGRGCTLTGYKV

SEQ ID NO: 40087 - DNA, 723 bp, Panicum virgatum
  misc_feature: Ceres CLONE 2001155
  misc_feature: Encodes the peptide sequence at SEQ ID NO. 40088
agcagctccgagcctccgagcatacacgcacacttgaagctagaggcctagagcccacagcatctgctcgagactctgccagccaagagagtctcgaggatctagctagctaggctgcgaggatgtcgctggtaaggctgttggacacgctggccccggagtcgtggaggaaccccttcagcatcttcggcacggcggtggccgccgacgcgtggctggtgagcgacacctcggcgttcgccaacacctacatcgagagccgggacacggcgggcgcgtacgtgttcagcgcggcgctgccgcccggcgtgaagaaggaggaggtgagggtggaggtggacgagggcaacgtgctggtcatcaccggggagcgcagcgtccgccgggaggagcgcagcgacaggtggcaccacatcgagcgcagctgcgccacgttcctcggcaggttccacctgcccggggacgccgccgtggacggcgtcagggccgccatggacgccggcgtgctcacagtcaccgtgcccaaggtcggggccatcgccgccgccgccgccgccgccgagccgacgatggccgcggaggccggcccctgctgatctgacgcgccggcgcgcgcgctcgatcacgggcggcgcggcacgcccctgttgaatgagcagtaaggtctctcgtccgtaccgtctgaagcgtccccctcctctggtttggtattgcatacttttt

SEQ ID NO: 40088 - protein, 157 aa, Panicum virgatum
  misc_feature: Ceres CLONE 2001155
  misc_feature (45)..(149): Pfam Name: HSP20 Pfam Description: Hsp20/alpha crystallin family
MSLVRLLDTLAPESWRNPFSIFGTAVAADAWLVSDTSAFANTYIESRDTAGAYVFSAALPPGVKKEEVRVEVDEGNVLVITGERSVRREERSDRWHHIERSCATFLGRFHLPGDAAVDGVRAAMDAGVLTVTVPKVGAIAAAAAAAEPTMAAEAGPC

SEQ ID NO: 40089 - DNA, 1061 bp, Panicum virgatum
  misc_feature: Ceres CLONE 2001164
  misc_feature: Encodes the peptide sequence at SEQ ID NO. 40090
ggtcggcgagggtttaggcatacgaggtcagattccggtggtctgctccgaccccgttcgcgaccgggacgcgatccccttcctctggtcgccgccgcccgccgccgcgatgcctcggtattactgcgactactgcgacacctacctcacccatgactcaccatctgtccgtaagcaacacaatgctggatacaaacacaaggcgaatgttcgaacgtactatcagcaatttgaggagcagcaaactcaaagtttaattgatcaaagaatcaaggaacatctcggacaagctgcagcttttcaagtaggtgcccctttcaatcagcatctgctctcgttcccaggagccatggcccgcccgcgccttccgattctaccaacccctggcatgcctcatggattccctcaagcacctggtgcaccattgatgccaggagtgaggcccccaatttttccagctcctggtgttccaggttatcctggtggcccacctaccatgcagcaaccaggtgccccaccaaccatgccacaaccaggtgcccctcctggctctggaccacaaccaggtgccccacctggttcggttccgatgcagatagctcccctcccaaggcctccaacactaccacctccaacatctggggtcccaggagcccccattcctaacagcacagcacctccagccatgtaccaaacgaatccaccaccacctgcaggcccaacttctggtgctcctccggctccaccatctgctccacagcctgcattctcctatgcgcaaccatctgagggcaaccactgattctgttcctcaggcatacttcaaccactgattctgttactcaggcatatgaagtatgcgcagaaaggttgctcatttgaatgtttggtggtgccatcatttaactgagaccgtttcgataggtctgttgcttggatcctgagggattgttgagaaaagcttcctatcagtgtgtattcggtgcggttggggactagttgatgtaagttaactatgtaatcgactgaagcctattaatttcagagacgcttaaaagtcc

SEQ ID NO: 40090 - protein, 230 aa, Panicum virgatum
  misc_feature: Ceres CLONE 2001164
  misc_feature (1)..(38): Pfam Name: zf-U1 Pfam Description: U1 zinc finger
MPRYYCDYCDTYLTHDSPSVRKQHNAGYKHKANVRTYYQQFEEQQTQSLIDQRIKEHLGQAAAFQVGAPFNQHLLSFPGAMARPRLPILPTPGMPHGFPQAPGAPLMPGVRPPIFPAPGVPGYPGGPPTMQQPGAPPTMPQPGAPPGSGPQPGAPPGSVPMQIAPLPRPPTLPPPTSGVPGAPIPNSTAPPAMYQTNPPPPAGPTSGAPPAPPSAPQPAFSYAQPSEGNH

SEQ ID NO: 40091 - DNA, 676 bp, Panicum virgatum
  misc_feature: Ceres CLONE 2001175
  misc_feature: Encodes the peptide sequence at SEQ ID NO. 40092
acgaccgcgtcgtcctcgtctccaccagccagccaagccagcaaccgcatcgaagcagccagcggcctagggtttccgcgccaaggagcgagcgacgaggcatgacgactgcggcgcgcccgacctgggctccggccaagggcggcaacgagcaggggggcacccgcatcttcgggccctcccagaagtactcctcccgcgacctcgccgcgcacacctccctcaagcccaggaaagagggccagcagacccaagaggagttacagaagaggaacctcagggaggaacttgaggatcgtgagcgcaagcactactcttccaaggataagtcctacgctgaagagagagaccggcggaaaagttcaagccagctgctattagaaggttcaaagagagatgccgaggataagatagttccacgagaaatcgatgcagatgactctgatgtggagcctaaaagtgacgacgaaagcgatgaagacgaagatgacgacgatgatgacacggaagcactaatggcagagcttgagaggattaagaaagaaagagctgaggagaagcttagaaaggagcgccaacaagcagaagaggaggccaagatgaaggaggctgaactgatgcggggaaaccctttgatcaatgtcaacaatcctggctccttcagcgtcaagagaag

SEQ ID NO: 40092 - protein, 191 aa, Panicum virgatum
  misc_feature: Ceres CLONE 2001175
  misc_feature (1)..(191): Pfam Name: Cwf_Cwc_15 Pfam Description: Cwf15/Cwc15 cell cycle control protein
MTTAARPTWAPAKGGNEQGGTRIFGPSQKYSSRDLAAHTSLKPRKEGQQTQEELQKRNLREELEDRERKHYSSKDKSYAEERDRRKSSSQLLLEGSKRDAEDKIVPREIDADDSDVEPKSDDESDEDEDDDDDDTEALMAELERIKKERAEEKLRKERQQAEEEAKMKEAELMRGNPLINVNNPGSFSVKR

SEQ ID NO: 40093 - DNA, 650 bp, Panicum virgatum
  misc_feature: Ceres CLONE 2001180
  misc_feature: Encodes the peptide sequence at SEQ ID NO. 40094
gaatcgggggggccatcaggtgggatttgattcggggaggcgaaggagctctctcgccgccatggacgaggaggagcacgaggtgtacggccaggagatcccggaggacggcgatatggacggcgctgacgtcgatatggccgccggcggggacgactcggcgaagctgcaggagctcgacgagatgaagcgcaggctgaaggagatggaggaggaggctgccgccctccgcgatatgcaggccaaggtcgccaaggagatgcaaggaggtgaccctagtgcatcaacagctgaggcgaaggagcaggtggatgcccgctctgtgtatgttggaaatgttgattatgcgtgtacaccagaagaagtacagcagcacttccaagcttgtggaactgtcaatcgggtgacaatcttgaccgacaagtttgggcagccaaaaggttttgcttatgttgaatttctggaacaagaagctgtccaggaggctcttaatttgaatgaatcagagttgcatggtcgccagattaaggttgcaccgaagaggactaatgtccctgggatgaagcagcgtccaccacgcgggtttaacccgtaccatggctacccatatagatcatacggagcgccgtacttccccccatatggttatg

SEQ ID NO: 40094 - protein, 196 aa, Panicum virgatum
  misc_feature: Ceres CLONE 2001180
  misc_feature (88)..(157): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MDEEEHEVYGQEIPEDGDMDGADVDMAAGGDDSAKLQELDEMKRRLKEMEEEAAALRDMQAKVAKEMQGGDPSASTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGFNPYHGYPYRSYGAPYFPPYGY

SEQ ID NO: 40095 - DNA, 722 bp, Panicum virgatum
  misc_feature: Ceres CLONE 2001181
  misc_feature: Encodes the peptide sequence at SEQ ID NO. 40096
ctaccgccgctcttgtcctgacacggagtgaccccgccagccgctgccactgcacagacacacactcctctcccacactctgctcgcatctcttcttcttcttctctctctctagaagaggaacgagcaagcagctgaggtgagccgagcgcaggtgccccatctctctccctccctccctggagttccttgggtgatcttcggtagcggcggaaccatgaaggcgctggtggtggcggtgctgcttctgctctcctccaccctcgccgcgtcacaatggtgcgtgtgcaggcaggatgcgccgcaggcctcgctgcagaagaccatcgactacgcctgcggcgcgggggcggactgcaactccatccatgagaacgggccgtgctacaaccccaacaacgtccccgcgcactgctcctgggcggccaacagctactaccagaacaacaaggccaagggcgccacctgcgacttcaccggcaccgccaccctcaccaccagcgatccaagttcttctggctgctctttccctacaagtgcaaggtacattgtgcacttcacttaaattaactgtataccatgatccatgaagttacttactactgccactacggactggttgagtagtcattcatatttcgaaattgtgcattttcggaactggcaccccatgaaacctatgcatcatcttgaatcagatcttttgtaatgtagtaaattct

SEQ ID NO: 40096 - protein, 115 aa, Panicum virgatum
  misc_feature: Ceres CLONE 2001181
  misc_feature (20)..(104): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered alkaloid content
  misc_feature: Useful for making plants with altered cell wall content and/or composition
MKALVVAVLLLLSSTLAASQWCVCRQDAPQASLQKTIDYACGAGADCNSIHENGPCYNPNNVPAHCSWAANSYYQNNKAKGATCDFTGTATLTTSDPSSSGCSFPTSARYIVHFT

SEQ ID NO: 40097 - DNA, 716 bp, Panicum virgatum
  misc_feature: Ceres CLONE 2001186
  misc_feature: Encodes the peptide sequence at SEQ ID NO. 40098
aactctgctctcccccttccttcccctccccccgtcccctgtccgtctccgcccagatccagatccagacaggcaacgcaggcagggagattgatgtggatgaaatcaatcatccatatgcatcttgacacctaaagacactgttggttggtttgctcattcatgtttcagggttcaatcaccacaccaggataagcaaccgagacaatggcggcagactctagcgctcgtaggcagccaaccttcaccaaggttgaccagctgcgcccggggacccatggccacaacctcattgtcaaggtcgttgactccaagatggtcgtccagaggggccgcgatggagggccgcagggcaggcagatgcggattgctgagtgcttggtcggcgatgaaaccggcatcatcgtcttcactgcaagaaacgaccaagtggatgtaatgaagcctggaacaactgttgaactgaggaatgcaaagattgacatgttcaagggttcgatgcggctcgccgttgacaagtggggaattgtgaaagctgcagaaagcccagctgagtttgcagtcaaggaggacaacaacctgtccttgattgagtttgagctggtgaccgtggtggagtgaaaaccaccttttgtaggaggatgttgcgttatgttatgttgttgaacctattgggcaccaccaaaaaataaacaagacatggttgatgttctcgt

SEQ ID NO: 40098 - protein, 137 aa, Panicum virgatum
  misc_feature: Ceres CLONE 2001186
  misc_feature: Useful for making plants with modulated drought sensitivity
  misc_feature: Useful for making plants with modulated water use efficiency
MAADSSARRQPTFTKVDQLRPGTHGHNLIVKVVDSKMVVQRGRDGGPQGRQMRIAECLVGDETGIIVFTARNDQVDVMKPGTTVELRNAKIDMFKGSMRLAVDKWGIVKAAESPAEFAVKEDNNLSLIEFELVTVVE

SEQ ID NO: 40099 - DNA, 676 bp, Panicum virgatum
  misc_feature: Ceres CLONE 2001224
  misc_feature: Encodes the peptide sequence at SEQ ID NO. 40100
acatccactcccaggccgccgccccatcccaggccgtccccgcccccatcccacgcctccgccgccggtcagggcgccgccccgccctcccctccggttgcgcctgcagaggccgccgtcctcggcgccgtcgccgtcgtgcacggcttcacaggcgagtccagttggatggtgcagctcacggccgtccacctcgccgcggcgctcgaccaccaggtccacggcttctccgagggcctcccgggccacatcctcgacatcgccccggtgctcgacgactgcgacgccgccttccgcgccgactacccgcccccgctcccctgcttcctctacggcgagtccctcggcggcgccatcgcgctgctgctccagctccgccgcggggacctctggcgcgacggcgccatgtgcggggtcagcccgcgcttcaagccgccctggccgctcgagcacctcctcgccgccgccgccgccgtcgtgcccacctggcgcgtcgccttcacgcgcgggaacatccccgagcgctccttcaaggtggaggggaaacgccggctcgcgctcgcctcgccgtgccgcaccacggcgccgccccgcgccgccaccgcgctcgagctcctccgtgcacggcgccgacgacaccgtctgcgacccggcctgcgtcgaggagctgttcagg

SEQ ID NO: 40100 - protein, 225 aa, Panicum virgatum
  misc_feature: Ceres CLONE 2001224
  misc_feature: SWISSPROT Homolog: EC 3.1.1.23 Acylglycerol lipase
TSTPRPPPHPRPSPPPSHASAAGQGAAPPSPPVAPAEAAVLGAVAVVHGFTGESSWMVQLTAVHLAAALDHQVHGFSEGLPGHILDIAPVLDDCDAAFRADYPPPLPCFLYGESLGGAIALLLQLRRGDLWRDGAMCGVSPRFKPPWPLEHLLAAAAAVVPTWRVAFTRGNIPERSFKVEGKRRLALASPCRTTAPPRAATALELLRARRRRHRLRPGLRRGAVQ

SEQ ID NO: 40101 - DNA, 786 bp, Panicum virgatum
  misc_feature: Ceres CLONE 2001231
  misc_feature: Encodes the peptide sequence at SEQ ID NO. 40102
gaagaaccgagccgccctttccgagaactgaagccaccggacgcgcggcctcctcctgccccctctgccgccgaaatccgcgcgagaatgacgatggcggaggccgaggctggcagggcggcgatccggcgtgccttgcgctcgctgaaacggaggcacctcgctgaggaaggggcgcacagaccggccatcgaggcgctcacccgtcccttcgccgcccacgctttggagtggaaggagaaggctgagaagcacgagttggaactgcagcagtgctacaaagcgcaatcccggctgtctgagcagcttgtaaccgaaatagaagagggtaaagcatcaaaagcgctgctcaaagagaaggaagcaacggttacaagtttgcaggctgaacttgagaagacaagcgaagagaacgtgcagctaaagcaatcaattgacgaaaaaacaaaagccttagatcttcttattcaggagcaccaggcagttaaagccgaacttgagcaggcattaacaaaacttaaagctgcagaggatgagaaccagagtttgattgatagatggatgctagagaagatgaaggatgccgagaggctcaacgaggccaatgcgatgtacgaggaggatggctcaggaggcaggatgattggatgtcactgattgtttgggacgatggagaaattattcagattttttcatttgaagattttttatttcggcagtggcgttgtcaaattgtacaagcgtatgcagatgcagagtgaatgaaagtattcagtatgatccatc

SEQ ID NO: 40102 - protein, 189 aa, Panicum virgatum
  misc_feature: Ceres CLONE 2001231
  misc_feature (14)..(171): Pfam Name: ATG16 Pfam Description: Autophagy protein 16 (ATG16)
MTMAEAEAGRAAIRRALRSLKRRHLAEEGAHRPAIEALTRPFAAHALEWKEKAEKHELELQQCYKAQSRLSEQLVTEIEEGKASKALLKEKEATVTSLQAELEKTSEENVQLKQSIDEKTKALDLLIQEHQAVKAELEQALTKLKAAEDENQSLIDRWMLEKMKDAERLNEANAMYEEDGSGGRMIGCH

SEQ ID NO: 40103 - DNA, 705 bp, Panicum virgatum
  misc_feature: Ceres CLONE 2001242
  misc_feature: Encodes the peptide sequence at SEQ ID NO. 40104
attcgacccataagcttttgcgatccctccctctcccaccgccgcatcgcattctccgatccgaagctctctgctcgcagccatggggaagagctacccgaccgtgagcgctgagtaccaggaggccgtcgagaaggccaggcgcaagctccgcgccctcatcgccgagaagagctgcgcccccctcatgctccgtctcgcgtggcactcggcggggacgttcgacgtgtcctcgaggaccggcggccccttcggtacgatgaagaacccggcggagcaggcgcacggcgccaacgcgggtctcgacatcgccgtgcggttgctcgagcccgtcaaggaggagttccccatcctctcttacgccgatctgtaccagcttgcgggagttgtggccgtggaggtgaccggtggacctgaggtccccttccaccccggtagggaggtgagacttttcatcccttttctactgcctttggggttttccctgggtttaaggccttgattcgaaatgcccaagaggagggtgtgaaggtagttgggcgagatctggttgtttactccaaatagtgcccctgatttctgatttatgagcgtattatcatcggtttggtgggttcttctatttattcatggcacgttatcctatcatttaagggtaccttttcacccttgaaatcgtttgtttggtttgtgttcgtgccttgc

SEQ ID NO: 40104 - protein, 139 aa, Panicum virgatum
  misc_feature: Ceres CLONE 2001242
  misc_feature (19)..(136): Pfam Name: peroxidase Pfam Description: Peroxidase
  misc_feature: SWISSPROT Homolog: EC 1.11.1.11 L-ascorbate peroxidase
  misc_feature: Useful for making plants with modulated heat sensitivity
  misc_feature: Useful for making plants with modulated water use efficiency
  misc_feature: Useful for making plants with altered carbohydrate content
  misc_feature: Useful for making plants with altered cell wall content and/or composition
MGKSYPTVSAEYQEAVEKARRKLRALIAEKSCAPLMLRLAWHSAGTFDVSSRTGGPFGTMKNPAEQAHGANAGLDIAVRLLEPVKEEFPILSYADLYQLAGVVAVEVTGGPEVPFHPGREVRLFIPFLLPLGFSLGLRP

SEQ ID NO: 40105 - DNA, 693 bp, Panicum virgatum
  misc_feature: Ceres CLONE 2001268
  misc_feature: Encodes the peptide sequence at SEQ ID NO. 40106
cccggccaccgcctcccgaagcacagcatcccccacatctccaccaccatggccggcagcagcagcaagctcctgttcgtgtgcgccgccgtcgccctggcggcggcgatggccccgtcgccggccgccgcggcgggcgacggcgggttcacgacgttcaagctctacttccacgacatcgtgggcgggacgagcccgacggcgatccgcatcgcgcaggcggcgtcctccaactcctcctccaccttcttcggcgcggtggtggccatcgacgacccgctcaccacggggccgacccgcgccgcggggaccgaggtcgggcgcgcccagggcacctacacgttcgcggaccagagcacgttcgggctcctgatggtgatgaacttcgtgttcaccgccggcgagcacaagggcagcagcctctcgatcctgggccggaaccaggtgctcgccgacgtccgcgagatgagcgtcgtcggcggcagcggcaagttccggatggcgcgcgggtacgtgcaggcgcacaccatcgactccggcgccacctccggggagaccgtcgtggagtacaccgtcaacgtcaaggcgtagccgccgccgccgccgtcgtctcgctctccggcggctgctgctgctgctgccgcctgagatgggtttcagtctttgtactttagcttgttgttcttcattctg

SEQ ID NO: 40106 - protein, 180 aa, Panicum virgatum
  misc_feature: Ceres CLONE 2001268
  misc_feature (12)..(180): Pfam Name: Dirigent Pfam Description: Dirigent-like protein
MAGSSSKLLFVCAAVALAAAMAPSPAAAAGDGGFTTFKLYFHDIVGGTSPTAIRIAQAASSNSSSTFFGAVVAIDDPLTTGPTRAAGTEVGRAQGTYTFADQSTFGLLMVMNFVFTAGEHKGSSLSILGRNQVLADVREMSVVGGSGKFRMARGYVQAHTIDSGATSGETVVEYTVNVKA

SEQ ID NO: 40107 - DNA, 589 bp, Panicum virgatum
  misc_feature: Ceres CLONE 2001270
  misc_feature: Encodes the peptide sequence at SEQ ID NO. 40108
acaacgccagacatcgatcgccgctgtctacatagcggtggaggggcactacaagcgagcatcgtaaagccagaaaataggatggcacacgctgaggtcgccgccgtggtcgccgccgggaccggcaccgaggccccagacctggcgctggcggggcgcgtggcacgtcatgaccggcgcgtcgcggggcatcgggcgcgccgtcccggcgcacctgtcctccctgggcgcgagcctcgtgctgggctacacgtcgcgcgccgacgagggcgacacactcggcgcgtccctgccccgctccttggccatgatgggggacgtccccgaccaggccggcgcgcggtcgctcttcaacacctccctggcctctgtccggggcgcctgggcgcacatcctcgtggccaactcctgcgtgctccactactcgtatcccaccgtggtgggcaccgccaccaagtccttcaaccgcctcttctccctgaacatgcgtggcgcggtcctgtgtctccgcgaggcgctgaaccccctccccctccactgcggcgggcggatgctggacgagacgtcgtccttggtgcggagtctccct

SEQ ID NO: 40108 - protein, 139 aa, Panicum virgatum
  misc_feature: Ceres CLONE 2001270
  misc_feature: SWISSPROT Homolog: EC 1.1.1.100 3-oxoacyl-[acyl-carrier-protein] reductase
MTGASRGIGRAVPAHLSSLGASLVLGYTSRADEGDTLGASLPRSLAMMGDVPDQAGARSLFNTSLASVRGAWAHILVANSCVLHYSYPTVVGTATKSFNRLFSLNMRGAVLCLREALNPLPLHCGGRMLDETSSLVRSL

SEQ ID NO: 40109 - DNA, 721 bp, Panicum virgatum
  misc_feature: Ceres CLONE 2001274
  misc_feature: Encodes the peptide sequence at SEQ ID NO. 40110
ttgacccagagttaataaatctgaaagcaaaactccaaggtgcaaagcttggaaatggaagtctactggacatagaatcccttcagaagagtatagaagctcgtacaaaacagttgttgcctttatatacgcagattgcaatacggtttgctgaattgcatgatacttccctcagaatggcagctaaaggtgtgattaagaaagttgttgattgggaagaatcacgttctttcttctacaaaaggctacggaggaggatctccgaagatgttcttgcaaaagaaataagaggaatagctggtgaccacttcactcaccaatcagcagttgagctgatcaaggaatggtacttggcttctcaaggcacaacaggaagcactgaatgggatgatgatgatgcttttgttgcctggaaggacaaccctgaaaactacaagggatatatccaaaagctacgggctcagaaagtgtctcagtcgctctccaatcttgcggactccagtaaagatctagaagcattctcccagggtctttctacactattagataagatggatccctctcagagagccaagttggttcaggaagtcaagaaggtccttggttgatgaaatgataagaacacatccaatataatgtgtatgctacatgttttttgatgaagtacatacatagaaggatattggtcagccttgattgatcatttctgatctgaattgaa

SEQ ID NO: 40110 - protein, 201 aa, Panicum virgatum
  misc_feature: Ceres CLONE 2001274
  misc_feature: Useful for making plants with altered oil content
  misc_feature: Useful for making plants with modulated herbicide sensitivity
DPELINLKAKLQGAKLGNGSLLDIESLQKSIEARTKQLLPLYTQIAIRFAELHDTSLRMAAKGVIKKVVDWEESRSFFYKRLRRRISEDVLAKEIRGIAGDHFTHQSAVELIKEWYLASQGTTGSTEWDDDDAFVAWKDNPENYKGYIQKLRAQKVSQSLSNLADSSKDLEAFSQGLSTLLDKMDPSQRAKLVQEVKKVLG

SEQ ID NO: 40111 - DNA, 666 bp, Panicum virgatum
  misc_feature: Ceres CLONE 2001276
  misc_feature: Encodes the peptide sequence at SEQ ID NO. 40112
atcccatctccatctcccatccactgccactcgctaccagccgatctcgatctgctgcatttcctctagcgctttagccttcagccagccgatctttcagagttgatctttcagagagcaagatcgaaggaaagatgtcgactgtgagccgtgcctccctggaccagaagcttgccatggccaagcgctgctcgcgagaggcaaccattgcaggaactaaggcggcagctgtggcaaccattgcctctgcgattccaactctggcgagcgtgaggatgctgccatgggcgaaggccaacatcaaccccaccggccaggccctcatcatctccacagttgcggggatggcctacttcatcgcggccgacaagaagatcctgtctctggcgaggcggcactcgtatgaggaagcgcccgagcacctcaagaacacctccttccaaggaaccggccgcccgcacccagctttcttcaggccatgagacaattatggagctcttcgtcagtactcggtactagtactacatgtcgtcgtcccgtcgatgatgtctgaataaactaccagtcccagctattagcccactaatcctagaggggcccctgtaattagtttgtactgttggtgatccaattcaaagggaacgaaacttgatgctgctgatcatc

SEQ ID NO: 40112 - protein, 115 aa, Panicum virgatum
  misc_feature: Ceres CLONE 2001276
  misc_feature (11)..(89): Pfam Name: ENOD93 Pfam Description: Early nodulin 93 ENOD93 protein
MSTVSRASLDQKLAMAKRCSREATIAGTKAAAVATIASAIPTLASVRMLPWAKANINPTGQALIISTVAGMAYFIAADKKILSLARRHSYEEAPEHLKNTSFQGTGRPHPAFFRP

SEQ ID NO: 40113 - DNA, 692 bp, Panicum virgatum
  misc_feature: Ceres CLONE 2001278
  misc_feature: Encodes the peptide sequence at SEQ ID NO. 40114
tgaaacctctcgttctcgtgagcctgtgccgccgcaggccgcaccctaaaccaccctagcacatcggcaaggcaaggaggcggctggcggccatggcggcggcgaatgctggggacgtggaggtggtcgacttcgactccgatgacgacgacctcatggacgacgacgcccccgaggccaacccggccccggccgccctccgcctccgctccaccatcgccgccggcggggactccgccgccgcgcgcaagaccaagggccgcggattccgcgaggagccttcctcctcgcgccccctagccggccgcgccgatttcgattccctcggctccgacgacggccctggacccctcagatctattgaggggtggattattttggtaaccggcgtccatgaagaagcacaggaggatgacctacataatgctttccgggaatttgggcaggtcatgaacctgcacttgaatttagatcgtcgtactgggtttgtcaaaggatacgctttgattgaatatgaaagctttgacgaagctcaggctgcaataaaagcaatggacggaactgagcttgttacacagataataaatgttgactgggcatttagtagtggcccagtcaaacgaagaaatgttcgcaggagatcaaggagccctgccaggaggaggtattgagcttgccttctccaccatgtc

SEQ ID NO: 40114 - protein, 192 aa, Panicum virgatum
  misc_feature: Ceres CLONE 2001278
  misc_feature (95)..(166): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAANAGDVEVVDFDSDDDDLMDDDAPEANPAPAALRLRSTIAAGGDSAAARKTKGRGFREEPSSSRPLAGRADFDSLGSDDGPGPLRSIEGWIILVTGVHEEAQEDDLHNAFREFGQVMNLHLNLDRRTGFVKGYALIEYESFDEAQAAIKAMDGTELVTQIINVDWAFSSGPVKRRNVRRRSRSPARRRY

SEQ ID NO: 40115 - DNA, 611 bp, Panicum virgatum
  misc_feature: Ceres CLONE 2001282
  misc_feature: Encodes the peptide sequence at SEQ ID NO. 40116
aaaagagataaatttttacttcggataacaaaatggatccgaacaatgttcaagcaagtcttgacaagctcaagcaaattctggccggtcgtacaactacagatctgatctccaaccttgaccgtcaactacttccccagaacaaccctatctttatcagttctacagtcgcatccacgtataatatgccaagtggccaagatggtctcgccgatattgaaaagaacttagaagctgacaatgttcacaagagatatcatcttgactcatgcctctcttagaaactgtcaatacggctgaagaaaaggagaaaaaggaaaagaaaaagaagaagaaaaaggataaaaagaaggacaaagaccaagataagaagaaaaaatcgaaaaatctccgttatgcagctggtgaggtctggcatgatgaaactatggatgactggccagaaaatgacttccgaatattcgtgggcaatctgggtaacgaagtttctgatgaaatgttgtcattggccttcagaagatatccctcatttaatcgcgctaaggttgtgagagatagaaagacttcaaagacaaaaggatatggttttgtatcgatagcaaaagcagaag

SEQ ID NO: 40116 - protein, 114 aa, Panicum virgatum
  misc_feature: Ceres CLONE 2001282
  misc_feature: SWISSPROT Homolog: EC 5.2.1.8 Peptidylprolyl isomerase
MPLLETVNTAEEKEKKEKKKKKKKDKKKDKDQDKKKKSKNLRYAAGEVWHDETMDDWPENDFRIFVGNLGNEVSDEMLSLAFRRYPSFNRAKVVRDRKTSKTKGYGFVSIAKAE

SEQ ID NO: 40117 - DNA, 662 bp, Panicum virgatum
  misc_feature: Ceres CLONE 2001287
  misc_feature: Encodes the peptide sequence at SEQ ID NO. 40118
gaacagagccagtcagccagagagccaagcagtcgccgcgccgcgccatcatgtgtacatagacccacctcgacacttcgtcagcgtcgcactgaagagcgagggtagcagcagccttccccgagttcgccatggccagagcgatccggcacgccgcccacaaggagcaccacttgttcctcgtcgattccggcgggagcagcggcaccgaccgcagcttcgtgtgcgacggctgcggctgcccgggcgccggcctccgctaccgctgcggcgcgtgcgacttcgacctgcacgcgccctgcgcgacggcgcccggggccgcgtggttcttcttccacggccagcacccgctcgtgttcgaggtggccgccggcgtcggcgaacctcgccgccgcagcgacatctgcgagacggacatccgcggcatgcactaccgctgccggccgtgcggcttcgacgtgcaccccatctgcgcgcagctaccgggcgccgccatctcgccgctgcacccggagcgcgtcgtgatgctcagcgtgggcgcccccgagtgcgcgcgctgcggcgccgactgcgtgtggcgctaccgctgtggcgtgtgcgacgtcaacattcacccaagatgcctgctggggactgatcagacgccgctcaacattaccctc

SEQ ID NO: 40118 - protein, 176 aa, Panicum virgatum
  misc_feature: Ceres CLONE 2001287
  misc_feature (30)..(58): Pfam Name: C1_3 Pfam Description: C1-like domain
MARAIRHAAHKEHHLFLVDSGGSSGTDRSFVCDGCGCPGAGLRYRCGACDFDLHAPCATAPGAAWFFFHGQHPLVFEVAAGVGEPRRRSDICETDIRGMHYRCRPCGFDVHPICAQLPGAAISPLHPERVVMLSVGAPECARCGADCVWRYRCGVCDVNIHPRCLLGTDQTPLNIT

SEQ ID NO: 40119 - DNA, 686 bp, Panicum virgatum
  misc_feature: Ceres CLONE 2001313
  misc_feature: Encodes the peptide sequence at SEQ ID NO. 40120
ctgagaaacggctaccacatccaaggaaggcagcaggcgagcccccgagctacctcaccggcgagttccccggcgactacggctgggacaccgcggggctgtccgctgaccccgagaccttcgccaagaaccgcgagctggaggtcatccactcccggtgggccatgctcggcgcgctcggctgcgtcttccccgagctgctcgctcgcaacggcgtcaagttcggcgaggccgtctggttcaaggccggctcccagatcttcagcgagggcggcctcgactacctcggcaaccccagcctcatccacgcccagagcatcctcgccatctgggccgtccaggtcgtgctcatgggcgccgtcgagggctaccgcattgccggcggcccgctcggcgaggtcgtcgacccgctctaccccggcggcagcttcgaccccctcggcctggctgacgaccccgaggccttcgccgagctcaaggttaaggagctcaagaacggccgcctcgccatgttctccatgttcggattcttcgtccaggccatcgtcaccggcaagggcccgctcgagaacctcgccgaccacctcgccgacccggtcaacaacaacgcctgggcctacgccaccaacttcgtccccggcaactaagctccgatccattggcaatgcaacttcattgtcttccgg

SEQ ID NO: 40120 - protein, 214 aa, Panicum virgatum
  misc_feature: Ceres CLONE 2001313
  misc_feature (13)..(181): Pfam Name: Chloroa_b-bind Pfam Description: Chlorophyll A-B binding protein
EKRLPHPRKAAGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAVQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGN

SEQ ID NO: 40121 - DNA, 731 bp, Panicum virgatum
  misc_feature: Ceres CLONE 2001334
  misc_feature: Encodes the peptide sequence at SEQ ID NO. 40122
acgcgcagcagcaaccgtaagccttaagcaggagcgaccgcaaccccgagccctactgctactaccgccgccgccaccgcgccgaacgccatggccgacccagcggagcaccgtccggccgaggaggaggaggccgcggcgggcggcgaggacgaggacaccggcgcccaggtcgcgcccatcgtcaagcttgaggaggtcgccatcaccaccggcgaggaggacgaggacgtcctactcgacatgaaggccaagctgtatcgattcgataaggaggggaaccagtggaaggagcgtggtactggcaccgtcaagctgttgaagcacaaggagacctccaaggtccgcctcgtcatgcgtcaggcgaagacactgaagatctgcgcaaatcaccttgtggtggcgacgacaaagatgcaagagcacgcgggtagcgacaagtcttgcgtgtggcacgcgctggacttcgccgacggcgagctgaaggaggaaatgtttgcgatccgctttgggtcggtcgaaaactgcaagaagttcaaggatactgttgaagagatcgctgatcagcaagggaagaatgaggaaaaagaaagtgcggaggcctcctcagctgccgaattggtagagaagttaacggtgacagaggccaaaaaggaggaggctgcggataaagaggaagctcctgcagcagatgatgaggatgtcaaagagtggaggtccctgctttcact

SEQ ID NO: 40122 - protein, 213 aa, Panicum virgatum
  misc_feature: Ceres CLONE 2001334
  misc_feature (38)..(159): Pfam Name: Ran_BP1 Pfam Description: RanBP1 domain
  misc_feature: Useful for biocontainment applications
  misc_feature: Useful for making plants with modulated flowering time
MADPAEHRPAEEEEAAAGGEDEDTGAQVAPIVKLEEVAITTGEEDEDVLLDMKAKLYRFDKEGNQWKERGTGTVKLLKHKETSKVRLVMRQAKTLKICANHLVVATTKMQEHAGSDKSCVWHALDFADGELKEEMFAIRFGSVENCKKFKDTVEEIADQQGKNEEKESAEASSAAELVEKLTVTEAKKEEAADKEEAPAADDEDVKEWRSLLS

SEQ ID NO: 40123 - DNA, 647 bp, Panicum virgatum
  misc_feature: Ceres CLONE 2001346
  misc_feature: Encodes the peptide sequence at SEQ ID NO. 40124
cacatttaaccctagagaccgctcgagccgtcctccgccgccgctcccgctcatcttctcctcgctcgctctccctccctcgtcgatccaggatgaagtttgttgctgcctatctacttgctgtcctcgctggcaaccccagcccctctgcggaggatttgtcggccatcctggagtccgttggctgtgaaattgacaatgaaaagatggagctcctgctgtcccaactgagtgggaaggacattactgagctcatcgctgcaggcagggagaagtttgcttccgtcccatgcggcggcggtggtgtggctgtcgcagcagctgccccagctgctggtggagctgctcctgcggctgaggcgaagaaggaagagaaggtggaggagaaggaagaaagcgatgatgacatgggcttcagcctcttcgactaggctcgtgcagttatcagagttgtcttttggtcagaaaaaatcaagagtcatgatgtttggatttcaaccatgttttattttgctaatcaccggaacaactgttgctgtcttgaatcttgatctgtagtaattcagatgtaggttactatgctggttggggtttactgctgaaccagagttttccctatcctatatatcagatgaatgaattggttg

SEQ ID NO: 40124 - protein, 112 aa, Panicum virgatum
  misc_feature: Ceres CLONE 2001346
  misc_feature (17)..(111): Pfam Name: Ribosomal_60s Pfam Description: 60s Acidic ribosomal protein
  misc_feature: Useful for making plants with altered oil content
  misc_feature: Useful for making plants with modulated biomass
MKFVAAYLLAVLAGNPSPSAEDLSAILESVGCEIDNEKMELLLSQLSGKDITELIAAGREKFASVPCGGGGVAVAAAAPAAGGAAPAAEAKKEEKVEEKEESDDDMGFSLFD

SEQ ID NO: 40125 - DNA, 719 bp, Panicum virgatum
  misc_feature: Ceres CLONE 2001394
  misc_feature: Encodes the peptide sequence at SEQ ID NO. 40126
cacaaattgttggcctgcaagagctaaaaatgcaattacgtcgatgggcaaggggaatgctttttgatgagaaacgacgggctatgggcttagggattgctagcagaagagctccccatatggcatttcttggcaatccaggaactggtaaaactatggttgctcgaattcttggaaagctgcttcatatggttggagttctccccaccgacaaagttaccgaagttcagagaactgatcttgttggagaattcgtggggcatactggaccgaagactaggaggaagatacaggatgctgagggaggtattcttttcgtggacgaagcttacaggttgataccaatgcaaaaatctgatgacaaggattatggtttagaagccttggaggagataatgtcggtaatggacagtggcaaggtagttgtcatatttgctgggtactgtgagccaatgaaacgtgtcattgcctcaaatgatggcttctgtaggagagtcacgaaattcttctatttcgaggatttcagcacgacagaactagcagagatcctacatatgaagatgaagaacccaagtgagagcagcttactttatgggttcaaactgcacccaagctgcagcattgaggtcattggagagctgattggcagagagaccaccgaagagcggcggaaacagatgaatggaggccttgtagacacgctgctcatcaatgcccgc

SEQ ID NO: 40126 - protein, 238 aa, Panicum virgatum
  misc_feature: Ceres CLONE 2001394
  misc_feature (39)..(224): Pfam Name: AAA Pfam Description: ATPase family associated with various cellular activities (AAA)
QIVGLQELKMQLRRWARGMLFDEKRRAMGLGIASRRAPHMAFLGNPGTGKTMVARILGKLLHMVGVLPTDKVTEVQRTDLVGEFVGHTGPKTRRKIQDAEGGILFVDEAYRLIPMQKSDDKDYGLEALEEIMSVMDSGKVVVIFAGYCEPMKRVIASNDGFCRRVTKFFYFEDFSTTELAEILHMKMKNPSESSLLYGFKLHPSCSIEVIGELIGRETTEERRKQMNGGLVDTLLINA

SEQ ID NO: 40127 - DNA, 644 bp, Panicum virgatum
  misc_feature: Ceres CLONE 2001402
  misc_feature: Encodes the peptide sequence at SEQ ID NO. 40128
agagggagcaaaaaccaaaccaaaagggtgggaaaaagaaaaatggcggtgacactcggccacgccgccgccgctgtggcgctcctcgccgtcgcggccgtctgcgccgacggcgcctccacgttctactcctcggaccccaacctcggatccgcccgcgtcgtcttccagacaaattatggtgatattgagtttggcttctttcctcatgttgcgcctaagactgttgagcacatcttcaaacttgtgcggcttggctgctacaacacaaatcatatcttcagggtcgacaagggatttgtggcacaagttgctgctgttgtgggaggtagaaccgccccaatgaatgcggtgcagaaaagagaagcagagaaaacaattgtcggtgaatttagtagtgtcaagcatgtgaggggaatactatccatgggaaggcactcggatccagatagcggcggttcatccttttctttccttcttggcgatgctccacaccttgatgggcagtatgctgtatttgggagggtcactaaaggtgatgatacattgagaaagctagagaggcttccaacccgcagagaaggcatttttgtgatgccaatcgagcgaatcgacatcctatcaacatactattatgatattga

SEQ ID NO: 40128 - protein, 200 aa, Panicum virgatum
  misc_feature: Ceres CLONE 2001402
  misc_feature (39)..(198): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MAVTLGHAAAAVALLAVAAVCADGASTFYSSDPNLGSARVVFQTNYGDIEFGFFPHVAPKTVEHIFKLVRLGCYNTNHIFRVDKGFVAQVAAVVGGRTAPMNAVQKREAEKTIVGEFSSVKHVRGILSMGRHSDPDSGGSSFSFLLGDAPHLDGQYAVFGRVTKGDDTLRKLERLPTRREGIFVMPIERIDILSTYYYDI

SEQ ID NO: 40129 - DNA, 530 bp, Panicum virgatum
  misc_feature: Ceres CLONE 2001424
  misc_feature: Encodes the peptide sequence at SEQ ID NO. 40130
gcttcgccttcccgagggggttcgtgcccttccagaggaacgccggggactagcccgccgacgtcgtctctgccttcaacatcctgctccccggcacgcagtccatggccatgacgctcttcggggcctcgcccgaggtgcccgacaaggcgctcgccaaggggttccagatgggcgcccaagaggtggacaagatccaggccgaactcccgcccaagaagagctgaggacccaggtggaactgattttgggatggccatcagtcgctgatgatgatattggtatgcattggtcggttggaagttcgattattctgctgttgcttcgtttgcttcattgcttgtgattgagcgtgcaatgcaatcgtacgcgtcggtgggtttgtgttgtgtgtgatgatcgacaggtaactgtgagtgtgtgacctgcaaaatgagttggtaggtgcctctctctgtcttgacataagctgagcgcctgatggagaacagcctgctcatcttatatgattcagaacctcaatcatttgt

SEQ ID NO: 40130 - protein, 40 aa, Panicum virgatum
  misc_feature: Ceres CLONE 2001424
  misc_feature: SWISSPROT Homolog: EC 1.15.1.1 Superoxide dismutase
  misc_feature: Useful for making plants with modulated nitrogen use efficiency
MAMTLFGASPEVPDKALAKGFQMGAQEVDKIQAELPPKKS

SEQ ID NO: 40131 - DNA, 884 bp, Panicum virgatum
  misc_feature: Ceres CLONE 2001430
  misc_feature: Encodes the peptide sequence at SEQ ID NO. 40132
gtcttccgctgttctagcgtttctttcctcctgccatctgggagggaggcggcggcgagaagggggaggactggagtgaggactgaagcatggcagcctcttcggctctcaggctaatcctgggctcctcatcggcgtcgcgccgccagattctgtccgagatgggatacaagttcacacttcttagtgcggatatcgacgagaaggagatcagaaaggagaagccagaggaactggtggtcgccttggctcatgcgaaagcggatgctatacttgagaagatgaagaacaatgggatgatgaaagagattgttgattctcaagagactactttgatgatcactgctgaccaagttgttgttcatgatggagtgattagagaaaaacctagcactccagaagaggcacggaaattcatcaaagggtactctgaaagccatgctgcgacaattggatctgttcttgttacaaatgtgaagactggagctagaaaggaaggatgggataaagcagaagtttatttccacaaaattcctgatgaagttgtggagagtttgattgaggagggcgatgttttctatgttgctggtggtctcctagtagagcatcccctaacttcacctctcgtggaagccattgttggtacaattgacagtgtcatggggctaccgaaagcgctcaccgagaagctgatcaaagaatccctttcagagcaatagctacaaccctctggactgaaactgactggtgatgcagaaagcatattggtggtgctggcaaaatcaatttggcagaatcgtattgtgagaatcatgtgttcatcccatttcccgacaaagaatttatgtgatcagctaccatgaatggaattctcccttagcttc

SEQ ID NO: 40132 - protein, 185 aa, Panicum virgatum
  misc_feature: Ceres CLONE 2001430
  misc_feature (1)..(183): Pfam Name: Maf Pfam Description: Maf-like protein
MGYKFTLLSADIDEKEIRKEKPEELVVALAHAKADAILEKMKNNGMMKEIVDSQETTLMITADQVVVHDGVIREKPSTPEEARKFIKGYSESHAATIGSVLVTNVKTGARKEGWDKAEVYFHKIPDEVVESLIEEGDVFYVAGGLLVEHPLTSPLVEAIVGTIDSVMGLPKALTEKLIKESLSEQ

SEQ ID NO: 40133 - DNA, 923 bp, Panicum virgatum
  misc_feature: Ceres CLONE 2001433
  misc_feature: Encodes the peptide sequence at SEQ ID NO. 40134
aactcgaccgacaggcccgcagaacaaaacacacgacagcgaaagccttccacttccaacagtcgatatgccgaagaacaagggaaagggcggcaagaaccgcagaagaggaaccaaggagaatgacgaccagcgccgtgagctgaccttcaaggaggacggccaggagtacgctcaggtcatcaagatgctcggaaacggccgtctcgaggctctttgcttcgatggcagcaagcgtctcgcaaacatccgaggcaagatgcgcaagaaggtgtggattaatcagggtgatatcatcctcctctcccttcgcgacttccaagacaacaagggcgacgttattctcaagtacactgccgacgaggcccgcaccctcaagtcctacggcgagctgcctgagcacgccaagatcaatgagaccgacagcttcggccagggcgaggacggcgaggcctacttcgagttcggcgaggccgactcggacgatgactcttctgacgacaatgccgatggtaccaagaagaaggaggttgacattgacgacatttgagcgtacttgccaccatcttcatccccgcatggagtctgcctcctctccagccggcttcttgtgaagcttctgtagaggttgtaacgctctcagcgctggggaggcaaaagtcattccaggccctggctagacacagtgatctctcacatcgttggcctggtatgatatggggaacgctgtcttctctctcaaaccttgctgaggcacatgaataacgcaagaagatctttttgcattctttttggccatttcaaggtcccacgacagtatgtttggacgcaggatggcggccgtggtgggagagacgtcacggccgtcaaattcatttcaaaaatatcgcttattataaattaacaaaagacattccctcctg

SEQ ID NO: 40134 - protein, 160 aa, Panicum virgatum
  misc_feature: Ceres CLONE 2001433
  misc_feature (30)..(94): Pfam Name: eIF-1a Pfam Description: Translation initiation factor 1A / IF-1
MPKNKGKGGKNRRRGTKENDDQRRELTFKEDGQEYAQVIKMLGNGRLEALCFDGSKRLANIRGKMRKKVWINQGDIILLSLRDFQDNKGDVILKYTADEARTLKSYGELPEHAKINETDSFGQGEDGEAYFEFGEADSDDDSSDDNADGTKKKEVDIDDI

SEQ ID NO: 40135 - DNA, 455 bp, Panicum virgatum
  misc_feature: Ceres CLONE 2001436
  misc_feature: Encodes the peptide sequence at SEQ ID NO. 40136
accattacagtacgagctccggctgacgcgccccgcactctcacacaaaagctcaagtcttgcgctcgctcgctcgcggctacatctacaatggcgcgcttccagctcgcggccctggccatggccatgctcttcgccgcggcggcggcgcaggccccggccgccaccccaacgccggcgcccagggcgacccccccgccggcgactcctccgccgaccccggcgccggtgtctccgcccgcgcaggcccccgccgttcctcccccggccccggcacccgcgactccggcccccgcccccaaggccgccgccccggcgacggctgaggcccccacccccgcggcgagctccccgccggcacccgccgccatgggcccctccccgtcacccaccaccgacgtgccccctgcctccagcgccgccgccggcgtctccccagccgccaaatgggccgc

SEQ ID NO: 40136 - protein, 121 aa, Panicum virgatum
  misc_feature: Ceres CLONE 2001436
  misc_feature: Useful for making plants with altered carbohydrate content
  misc_feature: Useful for making plants with altered cell wall content and/or composition
MARFQLAALAMAMLFAAAAAQAPAATPTPAPRATPPPATPPPTPAPVSPPAQAPAVPPPAPAPATPAPAPKAAAPATAEAPTPAASSPPAPAAMGPSPSPTTDVPPASSAAAGVSPAAKWA

SEQ ID NO: 40137 - DNA, 492 bp, Panicum virgatum
  misc_feature: Ceres CLONE 2001446
  misc_feature: Encodes the peptide sequence at SEQ ID NO. 40138
aactcacatctcgagcagtcggagttcatccccgagcagacctcgcaagccgcacatcttcttctcctcctgctccagatctcaggcgaaagcttgtccaccatccaccgccacagcatcccaatggctcgcttcgccgacgtcgccgccatcgactcgctcctcgccgtcaccgcggacgcgcaggccccgggcgcgactcccaccccggcgcccatgatgggcccgctgccgcctcctcctgcgcggtccccggccaccaccccggtgccggccccggcgcctgacgctaacccgcccacaggctcagcgccgtccccgctgtcctctcccccgggcccgcccgccgagggcccctccgcgttgacccgaaccacctacttctcagccgtcccagccggcgcgcccaccgccacgccgacagggaacggggccgcctcctccgctgtccccttgggttccgtgacccgacctggtcggctcctcggacgt

SEQ ID NO: 40138 - protein, 122 aa, Panicum virgatum
  misc_feature: Ceres CLONE 2001446
  misc_feature: Useful for making plants with altered carbohydrate content
MARFADVAAIDSLLAVTADAQAPGATPTPAPMMGPLPPPPARSPATTPVPAPAPDANPPTGSAPSPLSSPPGPPAEGPSALTRTTYFSAVPAGAPTATPTGNGAASSAVPLGSVTRPGRLLG

SEQ ID NO: 40139 - DNA, 710 bp, Panicum virgatum
  misc_feature: Ceres CLONE 2001448
  misc_feature: Encodes the peptide sequence at SEQ ID NO. 40140
aaagggaatttgacagtctagacagaggggcaaagggaaaaagcggtaggcattgccccaacattgggccagggctagaagagagaacctattcggatccaccctcgtagtctcggcgggatctcaggctcagatcgacctcggctcgggaagcgatcgaactccagcttgaggtggcaggctcgctcgagctccgctcattgacagccctccccatcaggctcaggcttcccttctctctgactcccctcccttcgtcttctttccctggcggcgccgactgggcgagcagcagcgccattcgtcacatcttcgcccagccctttgccggcgacgagcatccaccaggaaagcacctcgttctcaaatgaagcacatattcaagattgttgctatactggtagcaatctcagccatctgggttgcactccttgaaacctcaactgttcctcgaagttatacttggctgcttccaatctacttggtagtggctcttggatgctacggcctttttatggttggatttggacttatgttcttcccaacttgccctcaagaagctatactactgcaacaggatattgtggaggcaaaggaattcttagcaaagaagggtgttgatgtgggctccgagtgaggctaatttcagcaatcgacattcatgatcattttgaaggatcaccattctattccttggaatagactacatt

SEQ ID NO: 40140 - protein, 89 aa, Panicum virgatum
  misc_feature: Ceres CLONE 2001448
  misc_feature (1)..(86): Pfam Name: DPM3 Pfam Description: Dolichol-phosphate mannosyltransferase subunit 3 (DPM3)
MKHIFKIVAILVAISAIWVALLETSTVPRSYTWLLPIYLVVALGCYGLFMVGFGLMFFPTCPQEAILLQQDIVEAKEFLAKKGVDVGSE

SEQ ID NO: 40141 - DNA, 678 bp, Panicum virgatum
  misc_feature: Ceres CLONE 2001480
  misc_feature: Encodes the peptide sequence at SEQ ID NO. 40142
acccaaaaaaattatcgaatcccgcctccctcgtatcgccccaacccaaaaccgagttccctccaattccacccgcctcccctccgagatggacgccggcgcaccgaaggtgaagaaggcggcggcgggccgcaagcttggcgggccgaagaagaagccggtgtcgcgctccgtcaaggccgggctccagttccccgtcggccgcatcgggcgctacctcaagaagggccggtacgcgcagcgcgtgggcacgggcgcccccgtctacctcgccgccgtcctcgagtacctcgcggccgaggtcctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcagagaaggcggccaagtcgcccaagaaggccgccgcgaagtcccccaagaagtaggctgctcatgatgatgcgcgcgcggatctcaccttgcttttgtgtgtatgtagttccgcatctcaatgtatcgtgtcctccgagctgcggatcctatgtcgtaggtctagtctttagctgtagtggttggtgat

SEQ ID NO: 40142 - protein, 151 aa, Panicum virgatum; identical to SEQ ID NO: 11988
  misc_feature: Ceres CLONE 2001480
  misc_feature (27)..(100): Pfam Name: Histone Pfam Description: Core histone H2A/H2B/H3/H4

SEQ ID NO: 40143 - DNA, 675 bp, Panicum virgatum
  misc_feature: Ceres CLONE 2001483
  misc_feature: Encodes the peptide sequence at SEQ ID NO. 40144
gagactgcctgcctgccgcggcgctccggctgcgctccgatccagagcgagcgagagcaaggaccccagcgctccccgccgcgagacctcacgcggttccgacgcgatcggcgccgtcgagccacccctgagcatcccctcgcgtgtgaagctacccagtttgctccaggattgtgtccattcgagaatatggctagaaagaggaacccaattgtctatctggatgtatccataggtgatgaactagatggaagaatgatctttgagttatttgctgatgttgctcccctgatatctgagaacttcagagctttatgcacaggtgagctgggaaagactaagaagccattatgctacaagggttcaaccttccaccgtgtcatcaaggggttcatggcacaaggaggtgacttcgcaaaaggaaatggttctggtggagaaagcacatatagtgggaaatgtgcagatgaagctggtgtcctacgccatgatgatcgtggtctcttgacaacggcagatactggctcccaattttgtattactttcaagcctaattctcatcttgacagggtctttggatctccactgttgcctaattcaaattgaacaaccctgcttgtagaaataaaacacactgtttttggcaagcttcttgttggaaatgatgtgttaaag

SEQ ID NO: 40144 - protein, 138 aa, Panicum virgatum
  misc_feature: Ceres CLONE 2001483
  misc_feature (8)..(138): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MARKRNPIVYLDVSIGDELDGRMIFELFADVAPLISENFRALCTGELGKTKKPLCYKGSTFHRVIKGFMAQGGDFAKGNGSGGESTYSGKCADEAGVLRHDDRGLLTTADTGSQFCITFKPNSHLDRVFGSPLLPNSN

SEQ ID NO: 40145 - DNA, 695 bp, Panicum virgatum
  misc_feature: Ceres CLONE 2001526
  misc_feature: Encodes the peptide sequence at SEQ ID NO. 40146
ttggacgatgcagcagcagttgcatatgtgccgctcgccgccggcggatggggccacgtgcagaggcaatgggatgggaagcgacatcaccgtgtgcttcaccgtctagggagcctgtacttgctgctgagtgcatgatcccttcaattcaaccatccctgtcccagcggcctagccgaatttgtgttccctgctctttgtcccctgttcttcttcactggatacagatccacttaattggggatcttggattgctcaaatacttcttcatgaagctctcagactagctaaaaatctcatatttggggatatttcttctttcgaaaggtccaaattgacatggaaagctttgtgaattatttccgacctgacgtaatggaagcggtgtattcgtgggccaaagggtcgatctatcaaatcatggagatgactcaagtgtttgaaggcagcttcaacagggccatcaggaggctggaagaggctctgcagcagctaattcttgcatccaggtcgattggggaaactgaactggaagcaaaacttgaggaggaagtcagcaagatcaagagggatagatatagtattcgctgcatctttgtacttgtaacatatcttgatggcgtcatgatttcgtaaaagtgcatagagaaattaaatctctcttggctattttattttcagtgctgttggcctga

SEQ ID NO: 40146 - protein, 98 aa, Panicum virgatum
  misc_feature: Ceres CLONE 2001526
  misc_feature (1)..(82): Pfam Name: DSHCT Pfam Description: DSHCT (NUC185) domain
MESFVNYFRPDVMEAVYSWAKGSIYQIMEMTQVFEGSFNRAIRRLEEALQQLILASRSIGETELEAKLEEEVSKIKRDRYSIRCIFVLVTYLDGVMIS

SEQ ID NO: 40147 - DNA, 461 bp, Panicum virgatum
  misc_feature: Ceres CLONE 2001535
  misc_feature: Encodes the peptide sequence at SEQ ID NO. 40148
aattcattgacctctcctcgcaggtcgcaagatagcatggcaccggttaaggtattcgggtccgcggtgttcgcgaacgccgcgcgtgtgatggcgtgcctcgaggaggtgggcgtcgagtacgacgtcgtcgaggtcgactacatggccaaggagcacaggggcctcgagcatctggcgagaaacccgttcggccaaatcccaccgtttcaggatggggacatcacgctcttcgagtcccgagcaatctcaaagtatgtgctccgaagatatgccaagtccgcccaagatgacctgctgcgagagggcaacccggacgaagctgcgatggaggatgtgtggacagaggtggaggcacatcactaccgaccgggcatggggcccatcttctacgagtgcttcgtgtaccgcgcgaggctgagcaacactcctaaccaaaaggttgaggacgagagtgtcaa

SEQ ID NO: 40148 - protein, 141 aa, Panicum virgatum
  misc_feature: Ceres CLONE 2001535
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
MAPVKVFGSAVFANAARVMACLEEVGVEYDVVEVDYMAKEHRGLEHLARNPFGQIPPFQDGDITLFESRAISKYVLRRYAKSAQDDLLREGNPDEAAMEDVWTEVEAHHYRPGMGPIFYECFVYRARLSNTPNQKVEDESV

SEQ ID NO: 40149 - DNA, 632 bp, Panicum virgatum
  misc_feature: Ceres CLONE 2001542
  misc_feature: Encodes the peptide sequence at SEQ ID NO. 40150
aacctcatccacacaagcaacctctgaccggcgtcagctcgttgccccacacggccacaccacactcgcacacgcaacgaagctccacgatcctgcgcagcatctatcgcgccagctagattagcttgctcagctcagctcgatcgccggcggcagcccggatggtggagccggaggccgccttcgccgtcgccagcgtcctggccgtggtcaccgtggccgtcctgctgcgcgcgtgctcccgccgcgccgcgcccgcgacgccgcgccggagggaggaggcgcgcgctcaccgccgcggcgcggtcatggcggacgccgccttcttcgcgggcggcgtggcggacgtcgacgcgggcctcgacgacgccgcgctcagggcgctgcccaaactgatctacggcaacgaggaagccgaggcggccgggaagacgaaggcggcgtgctgcgcggtgtgcctgggcgagtacgccggcggcgacgtgctccggatgctgcctcggtgcgggcacgccttccaccagcgctgcgtcgaccgatggctgcggctgcaccagacgtgccctgtctgccgctcgccgccggggctcagccccgccgcggcgacagctctggccgcgcccacgcacccc

SEQ ID NO: 40150 - protein, 156 aa, Panicum virgatum
  misc_feature: Ceres CLONE 2001542
  misc_feature (96)..(137): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MVEPEAAFAVASVLAVVTVAVLLRACSRRAAPATPRRREEARAHRRGAVMADAAFFAGGVADVDAGLDDAALRALPKLIYGNEEAEAAGKTKAACCAVCLGEYAGGDVLRMLPRCGHAFHQRCVDRWLRLHQTCPVCRSPPGLSPAAATALAAPTH

SEQ ID NO: 40151 - DNA, 626 bp, Panicum virgatum
  misc_feature: Ceres CLONE 2001588
  misc_feature: Encodes the peptide sequence at SEQ ID NO. 40152
ccccaaaacttcctcctcttcttcttgccgagaaagcctgcgcgagcaagcgagcgaaccagcgaggccgaggcgttgctgcaatggcggactcgtcggcgccgacgcgggtgatgatggcggtgaacgagtcttcgctgaaggggtacccgcacccctccatcagctgccgcgccgccttcgactggatgctctccaagctcatccgctccaacaccgggggcttccacctcctcttccttcacgtccaggtcccagacgaggacggatttgatgatatggatagcatctatgcatcaccggaggactttcaccaaatgaagcagagagacaggataagagggcttcacttgcttgagttctttgtaaaccaatgccatcagttagggataaaatgtgaggcatggattagacatggcgatccaaaggaggttatctgcagtgaagtgaagagagtccatcctgaccttctagttgtgggaagcaggggccttgggccatttcagagggttttcgtgggcacagtgagcgagttctgcgtcaagcatgctgaatgtcccgtcatcaccatcaagcgcaaggctaatgaagctcctcaggaccctgtggacgattgaagtcatgct

SEQ ID NO: 40152 - protein, 177 aa, Panicum virgatum
  misc_feature: Ceres CLONE 2001588
  misc_feature (21)..(164): Pfam Name: Usp Pfam Description: Universal stress protein family
MADSSAPTRVMMAVNESSLKGYPHPSISCRAAFDWMLSKLIRSNTGGFHLLFLHVQVPDEDGFDDMDSIYASPEDFHQMKQRDRIRGLHLLEFFVNQCHQLGIKCEAWIRHGDPKEVICSEVKRVHPDLLVVGSRGLGPFQRVFVGTVSEFCVKHAECPVITIKRKANEAPQDPVDD

SEQ ID NO: 40153 - DNA, 722 bp, Panicum virgatum
  misc_feature: Ceres CLONE 2001591
  misc_feature: Encodes the peptide sequence at SEQ ID NO. 40154
atggctcgccgcgactctgccgtctctctcgcctctttcccctcgcctccgccgccccgaagctcccccacctccccgtcgccgtaaaccctagccccgagcccgcgctcgtgctcccctcctcctactccgcatcgccgtctcccgcgctcccccgcctcttctcctcctccgcgggcgggtcaagcatggtcgtggtgggctccgcggactccttcgccagcatcctctccaaggtccaagaggagaagcgaccggcggagttctactacgcggcggagtggagcggaccgggcagggcgatcgcccctttcatatccaagctaagcgaccggtacccgagcataccagtgtataaagttgacattgacatgcaaggggtcggaagcaagcttggtgagctaaaagtttactcagtgcctacgttccatttctatcataagggagagaagaccagtgaagtggtgggtgctgacaccaagaaacttgaagcagctatggagagtctgcacaagcagcagtagaggctccagagaagacagtgttgttccgttgtttcatgtgaaggcagtgcctgtgattcgtgctagtgtggtttgactaatgagttttggatctgtcagcttaggcaaaattgtccagaactccaggtgtttctcgtgtttggatagagtgatatgcagtggaaataaagattgtgctcttcctatgggcttttattc

SEQ ID NO: 40154 - protein, 173 aa, Panicum virgatum
  misc_feature: Ceres CLONE 2001591
  misc_feature (63)..(169): Pfam Name: Thioredoxin Pfam Description: Thioredoxin
  misc_feature: SWISSPROT Homolog: EC 1.8.1.9 Thioredoxin-disulfide reductase
GSPRLCRLSRLFPLASAAPKLPHLPVAVNPSPEPALVLPSSYSASPSPALPRLFSSSAGGSSMVVVGSADSFASILSKVQEEKRPAEFYYAAEWSGPGRAIAPFISKLSDRYPSIPVYKVDIDMQGVGSKLGELKVYSVPTFHFYHKGEKTSEVVGADTKKLEAAMESLHKQQ

SEQ ID NO: 40155 - DNA, 820 bp, Panicum virgatum
  misc_feature: Ceres CLONE 2001616
  misc_feature: Encodes the peptide sequence at SEQ ID NO. 40156
agttcctcccactcgcgccgccgcctcctcctcctcgtcctcctcgacgcaggctctctcgcctgaggacccgctcgccgccaccatgatcatccccaagaagaaccgcaatgagatctgcaagtacctcttcaaagagggcgtgctgtacgccaagaaggactacaacctggccaagcacccgcagattgatgtgccgaacctgcaggtgatcaagctcatgcagagcttcaagtccaaggagtatgtcagggagaccttctcgtggcagcactactactggtacctcaccaacgatggcattgagcacctccgcaactacctcaacctgccatctgagatcgtgcctgccacgctcaagaagtctgccaggcctcctggccgcccattcggctctggcccacctggtgaccgcccaaggggtccacctcgctttggtgaggacaggccaaggtttggtgacagggatggttaccgtagtggtccccgtcctggtggtgactttggtggtgagaagggtggagctcctgctgagtaccagccgtccttcaggggtcctggtggcagaccaggctttggccgtggtggtggcagtggcttcggtgctggcccgacctcttcatccatggagtgaactacccctagtttggacatgatgttttccttcggttgagccgtttaattttgaaggacagttcctatgtactagtgatgtttatcaggattggcaagtgctgaccatatgcgaaaattatgctatcttggtacctttcaatataatactagcctttgcaaaaagtgcatcatgttttcccactcc

SEQ ID NO: 40156 - protein, 182 aa, Panicum virgatum
  misc_feature: Ceres CLONE 2001616
  misc_feature (3)..(98): Pfam Name: S10_plectin Pfam Description: Plectin/S10 domain
  misc_feature: Useful for making plants with modulated nitrogen use efficiency
MIIPKKNRNEICKYLFKEGVLYAKKDYNLAKHPQIDVPNLQVIKLMQSFKSKEYVRETFSWQHYYWYLTNDGIEHLRNYLNLPSEIVPATLKKSARPPGRPFGSGPPGDRPRGPPRFGEDRPRFGDRDGYRSGPRPGGDFGGEKGGAPAEYQPSFRGPGGRPGFGRGGGSGFGAGPTSSSME

SEQ ID NO: 40157 - DNA, 486 bp, Panicum virgatum
  misc_feature: Ceres CLONE 2001617
  misc_feature: Encodes the peptide sequence at SEQ ID NO. 40158
gatccatcgtcgtcgtcatcatcatcaccgtcacatcagcaatccacctcgcaccggcgcgcaccatccatctatctcccgccgtcctcaccgtcgccacactccggcatccatccaccaccactccgtcaagtcacctaagcgagaatggccgcccgcttcgccgccgccctcgtcgcagtcctcgccctcttcgccgcagccgcaaaggcgcaggtcccggccgcgacgcccaagagcgcgccggccccggcaccgcccaagatggccccgctgccgcggccgccgaccaagtccccggcggcctccccgcctgcgccgcccacggcgagcccggtctccgcgcccttggccgccgtcccggccatgagcccgttgggcgccggcgtcggcgacgcgctgcccccggctggtgcctccgtgctgaccccggccgccgcgccggccaccgagaagagcaccgccgcatctgccaccgccgccacc

SEQ ID NO: 40158 - protein, 112 aa, Panicum virgatum
  misc_feature: Ceres CLONE 2001617
  misc_feature: Useful for making plants with altered carbohydrate content
MAARFAAALVAVLALFAAAAKAQVPAATPKSAPAPAPPKMAPLPRPPTKSPAASPPAPPTASPVSAPLAAVPAMSPLGAGVGDALPPAGASVLTPAAAPATEKSTAASATAA

SEQ ID NO: 40159 - DNA, 683 bp, Panicum virgatum
  misc_feature: Ceres CLONE 2001628
  misc_feature: Encodes the peptide sequence at SEQ ID NO. 40160
ggctcattcaggaggagaacgtgagattcaaagaactatgttggagctgctgaatcagctagatggttttgactcacgtggagatgttaaagttattctagcaacaaaccgcattgaaactcttgatccagctttgcttcggccaggccgaatagaccggaagattgaatttcctctgccagatattaaaactaggcgtcgcatcttccagatacacacctcaaaaatgacgttagccgatgatgtgaacttggaagaattcgtgatgacaaaggatgagttctcgggggctgatatcaaggctatttgtacggaagctgggttgctagcattgcgagaacgtagaatgaaggtgacccatgcggatttcaagaaggccaaggagaaggtgatgtacaagaaaaaggaaggcgtcccagatggtctctacatgtgatcccttcattgtcaggacaagctatctttattgtagtagcacatctctcttcatcacgggagatatgtgggcttgtttgtcatagtacttgtcgcactcagtttggaaaacatgtattatccttcgatttatttgaagtaagaaaattccctttgagaggatgctggaacgctgtgtaggcaaggcttgcgctgcagcatacagcttttaattctcttggccgcaatgaacattcactatcgtgttc

SEQ ID NO: 40160 - protein, 144 aa, Panicum virgatum
  misc_feature: Ceres CLONE 2001628
  misc_feature (1)..(112): Pfam Name: AAA Pfam Description: ATPase family associated with various cellular activities (AAA)
  misc_feature: SWISSPROT Homolog: EC 3.6.4.6 Vesicle-fusing ATPase
AHSGGEREIQRTMLELLNQLDGFDSRGDVKVILATNRIETLDPALLRPGRIDRKIEFPLPDIKTRRRIFQIHTSKMTLADDVNLEEFVMTKDEFSGADIKAICTEAGLLALRERRMKVTHADFKKAKEKVMYKKKEGVPDGLYM

SEQ ID NO: 40161 - DNA, 703 bp, Panicum virgatum
  misc_feature: Ceres CLONE 2001642
  misc_feature: Encodes the peptide sequence at SEQ ID NO. 40162
gttcagaggagtcgcgtcgttttcctccatcttcttccgctctccgctctcctcttccgcccgccccgccccgcaccaccctcgccgccgccgcatcagccgccacgatgcacaagacggcgcaggcctggtttacaggcggcaccgccgcctcttccgcggccgccagcgagtcgcagccgtccctactcgccgactggaattcctacgccgccgcccgctccgacgcctcttcctcctcctccccgctctccttcgacatcgaggccgccgtccgctccgccaacgataccgtctccggaaccttcagctcggtgaccaagggcgtgcgggagctgccagggagcttccagagcgcgactagcagcttcccctcgggcagggcgctcatgtacttcagccttttcctcgccaccggcatcttcttcatcttcatcgccttcgcgctcttcctccccgtcatggtgctcatgccgcagaagttcgccctcagcttcacactcggatgcgcactcatcatcgcctcgctcttcgcgctcaaggggcctgccaaccagctcgcccacatgaccaccaaggagaggctaccattctcagtgggttttattggatgcatggttggtacgatttatgtttctatggtgcttcacagctatttcctctctgtgatcttctcagtccttcaggttctggccctgggata

SEQ ID NO: 40162 - protein, 198 aa, Panicum virgatum
  misc_feature: Ceres CLONE 2001642
  misc_feature (88)..(197): Pfam Name: SFT2 Pfam Description: SFT2-like protein
MHKTAQAWFTGGTAASSAAASESQPSLLADWNSYAAARSDASSSSSPLSFDIEAAVRSANDTVSGTFSSVTKGVRELPGSFQSATSSFPSGRALMYFSLFLATGIFFIFIAFALFLPVMVLMPQKFALSFTLGCALIIASLFALKGPANQLAHMTTKERLPFSVGFIGCMVGTIYVSMVLHSYFLSVIFSVLQVLALG

SEQ ID NO: 40163 - DNA, 715 bp, Panicum virgatum
  misc_feature: Ceres CLONE 2001643
  misc_feature: Encodes the peptide sequence at SEQ ID NO. 40164
gttcttccaaagaccatctctctctgatctgaccaccaccgactccgacgagctccggtcccgcgcgccggcgaccatggagttcgtcgacccctgggacacccagtcccgcgctcgcgtcgtccattccggcgcccactccaccccctcaccctcctccaccacggccggagcgcccccctccctcccccacgccgcatcttgcgccgccgcggccgtcgcgctcctcgccgccgcttactacttcccgccggcctaccagatcctctcctccctcctcgtgtgggccgcgtcctccctcctcctcgcccccttcgcgccctcctcggccaccggcggcgacatctccgtcggccgaggccgcctcctccccgctcaggaaccggccgaggacccggtcccggaccccgcacccgctccccgccgcgctcgtcggcagaacccggccccgacgcccgcgaagccctcagatccgatcgcggctcccgtccagccggttgcgtcgctgcagccgctgcagaaggcggcggctgcgtgtggggccggcgtggatggcagcgagaggaaggaggacgccggcgagtggaccgaccaagagctggagctcctccggcggcagatggtgaagcacccggcgggggagccccagcggtgggagaagatcgcggcggtgttcggcggccgccgcacgccggagagcgtcatccgcgcgggc

SEQ ID NO: 40164 - protein, 212 aa, Panicum virgatum
  misc_feature: Ceres CLONE 2001643
  misc_feature: Useful for making plants with altered alkaloid content
MEFVDPWDTQSRARVVHSGAHSTPSPSSTTAGAPPSLPHAASCAAAAVALLAAAYYFPPAYQILSSLLVWAASSLLLAPFAPSSATGGDISVGRGRLLPAQEPAEDPVPDPAPAPRRARRQNPAPTPAKPSDPIAAPVQPVASLQPLQKAAAACGAGVDGSERKEDAGEWTDQELELLRRQMVKHPAGEPQRWEKIAAVFGGRRTPESVIRA

SEQ ID NO: 40165 - DNA, 611 bp, Panicum virgatum
  misc_feature: Ceres CLONE 2001671
  misc_feature: Encodes the peptide sequence at SEQ ID NO. 40166
aaacgatagcagagcagcaccgagtcttcttcaacccattctcgctccccaacgaattcggtcagagatcttcgtgcttggccctcctgtcctgcacatggcatccgccgctgcccccgccgacgccgccgccggagccgggcgccgccgcatcgtggtggccgtggacgagggcgaggagagcgcgcacgcgctcgcctggtgcctcgccaacgtcgtctccccggcgggcggcgacacgctcgtgctcgtgcacgcgcgccgcccgccccccgtctacgccgccatggacagcgcagctgctcgatctgcagggtacatgctgacctcggacgtgcttgcgagcgtggagcggcacgccagcgccgtctcggcggcggccgtcgacaaagccaggcgcctctgcgccgggcacccgcacgtggcggtggagacgctggtggagagcggggacccgcgggacgtgatctgcgacgccgccggcaaggtgggcgccgacctgctcgtcatgggcagccatgggtacggcttcatccagaggtatcactcgttttcgttacgtttcattactaggagtacaagcatccatctcgatcacgcgaaagcgatgc

SEQ ID NO: 40166 - protein, 171 aa, Panicum virgatum
  misc_feature: Ceres CLONE 2001671
  misc_feature (15)..(167): Pfam Name: Usp Pfam Description: Universal stress protein family
MASAAAPADAAAGAGRRRIVVAVDEGEESAHALAWCLANVVSPAGGDTLVLVHARRPPPVYAAMDSAAARSAGYMLTSDVLASVERHASAVSAAAVDKARRLCAGHPHVAVETLVESGDPRDVICDAAGKVGADLLVMGSHGYGFIQRYHSFSLRFITRSTSIHLDHAKAM

SEQ ID NO: 40167 - DNA, 686 bp, Panicum virgatum
  misc_feature: Ceres CLONE 2001676
  misc_feature: Encodes the peptide sequence at SEQ ID NO. 40168
aaacaaccctagaaaccgcccctccgccgccggcgccgccgcaggccgctcgccggtcgcgccatgggtatccatctcgtcgccggcggccggaacaacaagaccaagcgcaccgcgcccaatgccgacgatgtctacctcaagctcctcgaccagctgtaccgcttcctggatcgcatgaccgagagcgacttcgacgccgtgatcctgaaacggctcttcgtgagcaagaccaaccgcccgccgctctcgctactccgcctcgtcaaattcatggagggcaaggagaaccagattgctgtgatcgtgggcagcgtgaccgatcaccagatggtctacgaggtcccaccgatgaacgcggctgcgctcatgttcactgacacggcgagagccccgatcgtgaatgctggtggcgagtgcctcacctttgaccggctggcgctccgagcgcctctgggacagaacacggttctgctgaggggacctaacaatgctagggaagctgtgaaacactttggcccagcacctggtgtgcctcacatccataccatgccatacgttcgctctaagggaaggaaatttgagaaggcactaggagggaggaacagcagacgcttcaaggtcttagtcgtgtctcattcctgtggtctcacctaatgggattaaataggtttttgctttgagcc

SEQ ID NO: 40168 - protein, 197 aa, Panicum virgatum
  misc_feature: Ceres CLONE 2001676
  misc_feature (12)..(185): Pfam Name: Ribosomal_L18e Pfam Description: Eukaryotic ribosomal protein L18
  misc_feature: Useful for making plants with modulated nitrogen use efficiency
MGIHLVAGGRNNKTKRTAPNADDVYLKLLDQLYRFLDRMTESDFDAVILKRLFVSKTNRPPLSLLRLVKFMEGKENQIAVIVGSVTDHQMVYEVPPMNAAALMFTDTARAPIVNAGGECLTFDRLALRAPLGQNTVLLRGPNNAREAVKHFGPAPGVPHIHTMPYVRSKGRKFEKALGGRNSRRFKVLVVSHSCGLT

SEQ ID NO: 40169 - DNA, 1059 bp, Panicum virgatum
  misc_feature: Ceres CLONE 2001684
  misc_feature: Encodes the peptide sequence at SEQ ID NO. 40170
agcccagcccacggccccccactctcccgtgagtcctgcacccctgcccgtgacggcggcgcatctcgtcctcgcgacggccaccgcgcagagccgcaaaccctttctttcttgctcgccgtcctcgagaggtttcagaaggaggcgccgccgctgaccgtgacgagagcgaggtatccgcggttgttagggtttggctcgagatggggaaggcgaagaacaagggccccaagttcgcggtgatgaaaaagatgatcaccaagaagagtgtcaacaagtacaagaaggatgtgctgaaccccaacaagaaggacgccgagaaggagaagctcggccgcaatgtaccgcaggtctcgtcggctctgttcttcagctacaacacggcactcgggccgccttatcgggtgattgtggacaccaacttcatcaacttctccatccagaacaagctggatttggagaaaggaatgatggactgcctttatgcaaaatgcaccccatgtatcacggactgtgttatggctgagcttgaaaaactgggacagaagtatcgtgtggccttgagaattgccaaggaccctaggttccaaagattagcctgcacacacaagggaacttatgcagatgactgcatcgtggacagggttactcagcacaaatgctacattgttgccacatgtgatagagatttgaaaaggaggataaggaaggttcctggtgttccaatcatgtatattactcgacaccagtactcgatagaacgactccccgaagccacagttggtggagcaccaagaatctaatgagcacatacatgagaagattgtgaatttcactgatgaactagtgcttgttcatgttgtcatagtttttgcctgaagctgctgcttggaccaatgacagaatcatggacaagaatgccgctgtgcttgttgagctagctgtagcaacttataaattttgtcccagtacatgatgttactcttattatcgaaatgtaatagtttctgtttacggtcttgcctgaactttagagtaatgtactactggttcagtttc

SEQ ID NO: 40170 - protein, 199 aa, Panicum virgatum
  misc_feature: Ceres CLONE 2001684
  misc_feature (90)..(188): Pfam Name: Fcf1 Pfam Description: Fcf1
MGKAKNKGPKFAVMKKMITKKSVNKYKKDVLNPNKKDAEKEKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVDRVTQHKCYIVATCDRDLKRRIRKVPGVPIMYITRHQYSIERLPEATVGGAPRI

SEQ ID NO: 40171 - DNA, 701 bp, Panicum virgatum
  misc_feature: Ceres CLONE 2001685
  misc_feature: Encodes the peptide sequence at SEQ ID NO. 40172
ttctgttagtgtttgctttcttggttgcacagctgatagctacattgattgctgtatatgctaactgggggttcacttcaatcaaaggcattggatggggctgggctggtgttgtgtggctctacaatctcgtcttttacttcccacttgatatcctcaagttcctcatccgatatgctctgagcgggaaagcttgggatcttgtcattgagcaaagaattgcatttactaggaagaaggactttggcaaggaagagagggagctcaagtgggcacacgcacagaggaccctccacggactgcagccaccagatgccaagccgttccccgagagggtgaccgagctaaatcaaatggctgaagaggcgaagcggagggctgagattgcaaggctgagagagcttcacacgctgaagggacatgtggagtcgatcgtgaagctcaagggcctggacatcgacaccatccagcagtcgtacacagtgtaacggccggactcatatatgccctgggttgagtatatttagtatctgtttctcgcagagtaatagctagttctggtagttggctgtcatcttttacttaccatagctgtggcaccagagcaatatagtacagtacataacgggaactgatgcttatctgtattgtcatatggggagagatgccgtcagatctcccctgcaaatgccgttctgctg

SEQ ID NO: 40172 - protein, 161 aa, Panicum virgatum
  misc_feature: Ceres CLONE 2001685
  misc_feature: SWISSPROT Homolog: EC 3.6.3.6 Proton-exporting ATPase
LLVFAFLVAQLIATLIAVYANWGFTSIKGIGWGWAGVVWLYNLVFYFPLDILKFLIRYALSGKAWDLVIEQRIAFTRKKDFGKEERELKWAHAQRTLHGLQPPDAKPFPERVTELNQMAEEAKRRAEIARLRELHTLKGHVESIVKLKGLDIDTIQQSYTV

SEQ ID NO: 40173 - DNA, 812 bp, Panicum virgatum
  misc_feature: Ceres CLONE 2001718
  misc_feature: Encodes the peptide sequence at SEQ ID NO. 40174
ccaaaggccaaaaggccacgaagactcgaagaagagaggaacactcgaggggaaactgctctctcggcgatcgctcgaggcggcctctcaagatggtggtgctgcaaccagatcggttcctgagcgagctgacgagcatgtacgagcggagcacggagaaaggctccgtgtgggtcaccatgaagcgatcgtctctcaagggcaaggcacagttgcagaaaatggagaagaaggggaaggaggtggagtaccggtgccttgtccgcgcctctgatggcaagaagagcatctccacctcggtctctctaaaggagtacgcaaagttccaagcttcatatgcaacagtgcttaaagcccatatgcatgctctgaagaaaagggagaggaaagacaggaagaaggcggcagatgctgagaaggcccccgagaccgtgcccaagaagcagaagaaatcatcctcaaagaaatcctcagggtccaagtcgtaaggcgcctgcaggactcactgtgccgtctgttgtctacagccagactaatctgagtgtcgtcaagatttcctcatccatttttattcgtgttcatgcctgggaggtgaagcctgtgaatacaccttgccgtcgatactagcatttttgaagatgcattttgaggtgaatctgagccgccatagtgttttttctgattggcatcaaaggaaagacgtgctctttgagtttctagatctgatcattgaattttggtgctatttgcgatggttcattgatattgacagagttctggttctatttggaattgttcactgatgttgccag

SEQ ID NO: 40174 - protein, 131 aa, Panicum virgatum
  misc_feature: Ceres CLONE 2001718
  misc_feature (4)..(93): Pfam Name: SRP14 Pfam Description: Signal recognition particle 14kD protein
MVVLQPDRFLSELTSMYERSTEKGSVWVTMKRSSLKGKAQLQKMEKKGKEVEYRCLVRASDGKKSISTSVSLKEYAKFQASYATVLKAHMHALKKRERKDRKKAADAEKAPETVPKKQKKSSSKKSSGSKS

SEQ ID NO: 40175 - DNA, 711 bp, Panicum virgatum
  misc_feature: Ceres CLONE 2001727
  misc_feature: Encodes the peptide sequence at SEQ ID NO. 40176
atttccctagcccctgtgccagcacacacacccacccggcagggagagagagcccctcggcggcggagaagatggtgtcgctcaagctgcagaagcgcctcgcctccagcgtgctcaagtgcggcaagggcaaggtctggctcgaccccaatgaagtcagcgagatctccatggccaactcccgccagaatatccgcaagttggttaaggatggttttatcatcaggaagcctcagaagatccactccaggtcccgtgcaaggagggcgcatgaggccaagcagaagggacgtcattctggatatggtaagcgcaggggtacgagggaggctaggctccccaccaagattctttggatgaggaggatgcgtgttctaaggcgcctgctgcgcaagtaccgtgaagccaagaagatcgacaagcacatgtaccatgacatgtacatgaaggtcaagggtaacagtttcaagaacaagagggtgctcatggagagtatccacaagtccaaggctgagaaggctagagagaagacactctctgatcagtttgaggccaagcgcgccaagagcaaggcaagccgtgagaggaagattgccaggagggaggagaggttggcccagggcccgagggaacctgcagcaccagcagctgcagctccagctccggctgcagcggccccaaagaaggcaaagaagtgaaggggttgatctg

SEQ ID NO: 40176 - protein, 208 aa, Panicum virgatum
  misc_feature: Ceres CLONE 2001727
  misc_feature (2)..(149): Pfam Name: Ribosomal_L19e Pfam Description: Ribosomal protein L19e
MVSLKLQKRLASSVLKCGKGKVWLDPNEVSEISMANSRQNIRKLVKDGFIIRKPQKIHSRSRARRAHEAKQKGRHSGYGKRRGTREARLPTKILWMRRMRVLRRLLRKYREAKKIDKHMYHDMYMKVKGNSFKNKRVLMESIHKSKAEKAREKTLSDQFEAKRAKSKASRERKIARREERLAQGPREPAAPAAAAPAPAAAAPKKAKK

SEQ ID NO: 40177 - DNA, 720 bp, Panicum virgatum
  misc_feature: Ceres CLONE 2001733
  misc_feature: Encodes the peptide sequence at SEQ ID NO. 40178
acccagcccctgagagaaccctacgcctcccctgctgcggccgccttctcatcgtggaacctcggtcacctcgcgaaaatgagccaggaggcggtgaatccgaaggcgtacccgctggcagacgcgcagctgacggttacgatcctcgaactcatccagcaggccgccaactacaagcagctcaagaagggcgccaacgaagcgacgaagactctgaacagggggatatcggagttcgtggtgatggcggcggatacggagccactcgagatcctcctccacctccccctgctagctgaggataagaacgtgccatatgtatttgttccttccaagcaagctcttggtcgtgcctgtggtgtgacaaggccagtcattgcttgctcagtgactagcaatgagggtagccagctgaaaaactcgatccagagtcttaaggatgctattgagaagcttctcatatgatttatcgaagacctttcagtgtgatgggcctccgagtgacacatttttcagaggcttggactggtgacagtgtcttgtttactagatttgcgttttctggacaatgtttaagttcccttaaagtcattatacttgcattgtgctgcactctgtgatctttaatgtgttgcaactgtcatgacatctgtatcatggtggtcaacttctcaggaagttggccactgttgtatggtggatggctatgtgtttgagaat

SEQ ID NO: 40178 - protein, 128 aa, Panicum virgatum
  misc_feature: Ceres CLONE 2001733
  misc_feature (20)..(114): Pfam Name: Ribosomal_L7Ae Pfam Description: Ribosomal protein L7Ae/L30e/S12e/Gadd45 family
MSQEAVNPKAYPLADAQLTVTILELIQQAANYKQLKKGANEATKTLNRGISEFVVMAADTEPLEILLHLPLLAEDKNVPYVFVPSKQALGRACGVTRPVIACSVTSNEGSQLKNSIQSLKDAIEKLLI

SEQ ID NO: 40179 - DNA, 707 bp, Panicum virgatum
  misc_feature: Ceres CLONE 2001746
  misc_feature: Encodes the peptide sequence at SEQ ID NO. 40180
acaaagagaatgcattgcagaacctaacccaggagaatgatgaattcaggatgcgagaagctgatgccatgaagaaaatagaggagctgtctgctcttcttgccgaagctatgataaagaagcatcctgaggaggaagagaagctagttgtcgtggatgaggcacacaattctgtgggtgaagaatttacccgttctattgcagaaaatgaagatacggaagaaattgatgataaaaagttgcacctggaagtcaacgtagatgatatgaagtacaacggaggcatggatcacgaagagaaagatgacagcaaggtcgaacaagaggaactgaagattgatcgcagtgtgcaggagagtgacaaagttgcagagaaggaagaacaggcagaaaacagaaagcaggagactgagtcgtcgaatgatgaattggattccaagaaggagggcagcagcaccgagaccgcaaatggaacgatggtaccagaagatacggcaagtaaagcggcaatgtccccgacgaaaccgcagcagcagcagaaaaagaacaagcctctgctgaagaagtttgggagcttactgaaaaagaaaaacagcaagtagccgaacagcgtctgtactattagtgtcgttttgatttttcttttctttttggttcgtttgacgcggtgttgtgcttcctatgcattttactgccgatgcctgtat

SEQ ID NO: 40180 - protein, 199 aa, Panicum virgatum
  misc_feature: Ceres CLONE 2001746
  misc_feature: SWISSPROT Homolog: EC 5.2.1.8 Peptidylprolyl isomerase
KENALQNLTQENDEFRMREADAMKKIEELSALLAEAMIKKHPEEEEKLVVVDEAHNSVGEEFTRSIAENEDTEEIDDKKLHLEVNVDDMKYNGGMDHEEKDDSKVEQEELKIDRSVQESDKVAEKEEQAENRKQETESSNDELDSKKEGSSTETANGTMVPEDTASKAAMSPTKPQQQQKKNKPLLKKFGSLLKKKNSK

SEQ ID NO: 40181 - DNA, 632 bp, Panicum virgatum
  misc_feature: Ceres CLONE 2001778
  misc_feature: Encodes the peptide sequence at SEQ ID NO. 40182
aaccaacccgcggcttctcccccgccgtcggcaaacgccggcctccgccgccacccgcctcagtccgttcgtccggcaaccacccgcgcgccgcccatgggctgctcctcctccctaccagccactaatgctggaggtggagggttgaacaatgtcaacagtgggagttctgatattgattcaaagaacttccgagtgaagttggtattacttggagactctggtgttgggaagagctgcatcgttcttcgctttgtccgtggtcagtttgaccctacttccaaggtaactgttggtgcatcatttttgtcacaaacattggcattagaggactccacaacagtgaagtttgaaatatgggatactgctggccaagagaggtatgctgccttggcgcctctttactaccggggagctggtgctgcaattgttgtctacgacataaccagttcagaatcatttaacaaagcacaatactgggtgaaggaacttcaaaaacatggtggtcctgatatgattatggctttggttggaaataaggctgatctacatgaaaatcgtattgtatcttctcaggaaatcgccaagaggttgcccaggccaacatcatcttaatgatacttgatcagtgt

SEQ ID NO: 40182 - protein, 172 aa, Panicum virgatum
  misc_feature: Ceres CLONE 2001778
  misc_feature (35)..(168): Pfam Name: Ras Pfam Description: Ras family
  misc_feature (35)..(150): Pfam Name: Miro Pfam Description: Miro-like protein
MGCSSSLPATNAGGGGLNNVNSGSSDIDSKNFRVKLVLLGDSGVGKSCIVLRFVRGQFDPTSKVTVGASFLSQTLALEDSTTVKFEIWDTAGQERYAALAPLYYRGAGAAIVVYDITSSESFNKAQYWVKELQKHGGPDMIMALVGNKADLHENRIVSSQEIAKRLPRPTSS

SEQ ID NO: 40183 - DNA, 693 bp, Panicum virgatum
  misc_feature: Ceres CLONE 2001797
  misc_feature: Encodes the peptide sequence at SEQ ID NO. 40184
atatcacaggttcccggccggcacagagcgagagagaccccggcacgtcgtccatcccatcgccatggcacggcacgctccgctgctcttcaccatcgcggccgtgctcgccatagccgcggcgtcggcgtcgtcctacgtgcgcgccgcggacaaggagctgatgatcatcggcggcgacgacgacgtgttcgggctgggcggcgtgatcggcggcaggcggcgtctggacgacctcaacggcacgagccccgacgcgaacgcgacgagcgccgacggcaactccacgagcaccgggtacatcagctacctcgcgctgtccagggacagcgtcccgtgctcgcagcgcggcgcgtcctactacaactgccgacccggcgcggaggccaacccctacagccgcggctgctcagcaatcacgcagtgccgcggctgaggtaggcggcagccgcagggcctattccacggcgtgctgtctccgctccgccattcgcgctgttccttttctttgcttattaatttgttgagatgcttctcttgggtgggtccgagctgctgaaaacgaattgaattgatgcttaccatttcttttgtaaatcgttgctattcttgtgctacgagtgacgtgtgtttgtgtgatgtatggcggtcgtataaccaaatatataactatataagtctactgattcttac

SEQ ID NO: 40184 - protein, 123 aa, Panicum virgatum
  misc_feature: Ceres CLONE 2001797
  misc_feature (39)..(123): Pfam Name: RALF Pfam Description: Rapid ALkalinization Factor (RALF)
MARHAPLLFTIAAVLAIAAASASSYVRAADKELMIIGGDDDVFGLGGVIGGRRRLDDLNGTSPDANATSADGNSTSTGYISYLALSRDSVPCSQRGASYYNCRPGAEANPYSRGCSAITQCRG

SEQ ID NO: 40185 - DNA, 707 bp, Panicum virgatum
  misc_feature: Ceres CLONE 2001810
  misc_feature: Encodes the peptide sequence at SEQ ID NO. 40186
atcagcctaagcgtccatccacaagaccttacatttgcagcactgcaacaaaatgagctcggtggcaaagatcgggccgtttggcagctcatcgaccgagggaaactgcgacatcacagtagcgcctctgctcctggagagtatcaccatccgccatgggtttatagtcgatgctctttccttcacctacaaggattgccatgggctggagcacaccacaggccaatggggcggcaatggcgggacggccaccacgatcactcttggtccaaatgagttcgtgacagaagttcacgggatgtacggccagtacattcatgggggagatggcatagccaacttcaccatcgtcaccaacctccaaacatatgggccttatggagatagtaataatctcaagaataccaagtccttccatatcccggtcaagaacaacggcagcatcgttggcttcttcgcccaccgtaacaatgtctacgtcactgccatcggtgtctatgtcaagcccttctgattgtccgacgttcgtcaaaatcatgaacccactggtttatgccatcatcctttgtgtttgcatgcaaaaataaattgggatcgtcgatcatccccactgttggagtagcgccacatactggtgtttaccatgtgtgcctgcagcttcatctgtatgtgtgtggtctctttgttttaataacgtttttatgtgc

SEQ ID NO: 40186 - protein, 153 aa, Panicum virgatum
  misc_feature: Ceres CLONE 2001810
  misc_feature (17)..(152): Pfam Name: Jacalin Pfam Description: Jacalin-like lectin domain
MSSVAKIGPFGSSSTEGNCDITVAPLLLESITIRHGFIVDALSFTYKDCHGLEHTTGQWGGNGGTATTITLGPNEFVTEVHGMYGQYIHGGDGIANFTIVTNLQTYGPYGDSNNLKNTKSFHIPVKNNGSIVGFFAHRNNVYVTAIGVYVKPF

SEQ ID NO: 40187 - DNA, 690 bp, Panicum virgatum
  misc_feature: Ceres CLONE 2001817
  misc_feature: Encodes the peptide sequence at SEQ ID NO. 40188
ctcgagtcctctttcttctccacttctccttcctgcggcggcggccgatttgggggcaattcgccatagcagattggcaacgaaggggaggaagcaaccggcgattcgctccgagccgatctgattcgccatgaagcctttcaagaaggaattcaccttcgatgagaggctccaggaatccgccgccatgatcgccaactaccccgccagggtccccgtcatcgttgaaaggtattcaaggagtaatttaccagaaatggagaagaggaagtacctggttccctgtgacatgccagttgggcagttcattttcatactacggtccaggttacacctatctccaggaacagcgctatttgtgtttgtaaacaacactttgccccaaacagctagcctgatgggaagtgtatacgactcgtacaaggacaaggacggcttcctttacatgtgctacagcagcgagaagacatttggctgctctgcccctggactgacctgacgtagaaattttgctttgcggccaggtagcccgtacatcacctctgtgcatatatcgtgctactccgtatgttatgtgatcaactctgtacatataatatcttgctactccttgtgttatgtgaataaactctgtacatatagatgcatcgtgctacatttgagaaatgatgtactacttgtgtatagctg

SEQ ID NO: 40188 - protein, 122 aa, Panicum virgatum
  misc_feature: Ceres CLONE 2001817
  misc_feature (12)..(115): Pfam Name: MAP1_LC3 Pfam Description: Microtubule associated protein 1A/1B, light chain 3
  misc_feature: Useful for making plants with modulated nitrogen use efficiency
MKPFKKEFTFDERLQESAAMIANYPARVPVIVERYSRSNLPEMEKRKYLVPCDMPVGQFIFILRSRLHLSPGTALFVFVNNTLPQTASLMGSVYDSYKDKDGFLYMCYSSEKTFGCSAPGLT

SEQ ID NO: 40189 - DNA, 649 bp, Panicum virgatum
  misc_feature: Ceres CLONE 2001834
  misc_feature: Encodes the peptide sequence at SEQ ID NO. 40190
agagaggcacgcgcagcatccattccttgccgctgccgctgccgctgccgccgcacactcccattgcagagccccaccgcgcgcaaaagcagagcagccactttcccctcccgctccccatcccccgtcctcctcccatggcgagatcgacgcgcggcgcgctcctcctcctcctcgcgctgctggcgctggcggcggcggcccgcgcgggcgacgtgccggcggcggcgctgggctgggagctcggggtggtgggcgccgcggtggacgaggagttcggcttccccgccggcggcgactccgtggcgcgccgggtgctgcagggcgggtccgggtacatcagctacggcgcgctgcggcgggacaacgtgccgtgctccgtgcggggggcctcctactacaactgccgccccggcgcgcaggccaacccctactcgcgcggatgctccgccatcgcccgctgccgcggctgatccctcgcccgcccgcccgcccgcctgcttcggcaccggcgaccgccgggaggaagaggagaaggttcatcccgttaatccctcgccgttcagcagaaaaaaaagggggaactgttcatctgccccttttaatcaattgttattgttattagtgctggtattatttgtcttgtcgt

SEQ ID NO: 40190 - protein, 111 aa, Panicum virgatum
  misc_feature: Ceres CLONE 2001834
  misc_feature (45)..(111): Pfam Name: RALF Pfam Description: Rapid ALkalinization Factor (RALF)
MARSTRGALLLLLALLALAAAARAGDVPAAALGWELGVVGAAVDEEFGFPAGGDSVARRVLQGGSGYISYGALRRDNVPCSVRGASYYNCRPGAQANPYSRGCSAIARCRG

SEQ ID NO: 40191 - DNA, 651 bp, Panicum virgatum
  misc_feature: Ceres CLONE 2001874
  misc_feature: Encodes the peptide sequence at SEQ ID NO. 40192
atcaaacagtaaatgtgaaggttataatggcaactaaccgggcagatactctagatcctgctctgctgcgtccaggtagacttgatagaaaaattgagttccctgttcctgaccgacggcagaagaggcttgtgttccaagtctgtactgccaagatgaacttgagtgatgaggttgatttggaagattttatatccagaccggataagatcagtgctgcagatattgctgctatatgtcaagaagctgggatgcatgctgtccgcaagaaccggtatgtcatcctccaaaaggacttcgagaagggctaccggaccaatgtgaagaagcctgagacggacttcgacttttataagtgaagaaagcatgagtgttagaatgcagtggttgactaattgctccatacacgacttctgccattttaactgaaaagcttggacatgctgtgtcggactcatactaggtagtagtaaagtaagcgacaatgaattcaattcaaacgggcatgatgccccggtgccttatgccgcctactggtgtgacgaatgacaaatccaccgaaccatagattacaatagatgatatgggtcactcgtgtggattttgtactaccagcagttttctgataatcgagtctggcatttgtcctcc

SEQ ID NO: 40192 - protein, 118 aa, Panicum virgatum
  misc_feature: Ceres CLONE 2001874
  misc_feature (1)..(88): Pfam Name: AAA Pfam Description: ATPase family associated with various cellular activities (AAA)
  misc_feature: SWISSPROT Homolog: EC 3.6.4.6 Vesicle-fusing ATPase
QTVNVKVIMATNRADTLDPALLRPGRLDRKIEFPVPDRRQKRLVFQVCTAKMNLSDEVDLEDFISRPDKISAADIAAICQEAGMHAVRKNRYVILQKDFEKGYRTNVKKPETDFDFYK

SEQ ID NO: 40193 - DNA, 714 bp, Panicum virgatum
  misc_feature: Ceres CLONE 2001885
  misc_feature: Encodes the peptide sequence at SEQ ID NO. 40194
attgtctctgctgtgcaaagagtatcgatggctatttctccctcgcggtctggcttgagcactaggccgaagataatttctggcttccctgaagctgcaacacttgttcgctggatttgccaaagctatcagtaccatttgggagtggatttggtcagccattcggatgaagctggagaatcattgttgagaatgttctgggatcatcaggatgctgtcttgtgctgctctttcaaggaaaagcctgtgtttacttttggcaaccagatgggaattgacatgttagaaacaactctaattgctctacaagatctcacattggataagatctttgatgaagctggtaggaaggcattgcatgcggagatccctaaactgatggaacaggggtacgcctacctgccggctggggtttgcttgtctggaatgggccgccatgtctcctatgagcaagctatcgcatggaaagttctcggcgaggacagcaacgtgcactgcctcgccttctgcttcgtcaactggtctttcgtgtgatccaatccaatatagcaagtgtatttctgatgagagatggttaaatgctcgctctgagcagcctccacatttgcattctctgtataagaggacggtaagccgtcgctgttagctaggtaatgtatgtttaactagttgtagacattgggaatgccagccgtgtaatgatgctgctgcctc

SEQ ID NO: 40194 - protein, 177 aa, Panicum virgatum
  misc_feature: Ceres CLONE 2001885
  misc_feature (30)..(177): Pfam Name: MEKHLA Pfam Description: MEKHLA domain
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
  misc_feature: The sequence is a functional homolog of SEQ ID NO 2 in US patent 7056739
  misc_feature: Useful for making plants with altered lignin content
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: Useful for making plants with altered carbohydrate content
IVSAVQRVSMAISPSRSGLSTRPKIISGFPEAATLVRWICQSYQYHLGVDLVSHSDEAGESLLRMFWDHQDAVLCCSFKEKPVFTFGNQMGIDMLETTLIALQDLTLDKIFDEAGRKALHAEIPKLMEQGYAYLPAGVCLSGMGRHVSYEQAIAWKVLGEDSNVHCLAFCFVNWSFV

SEQ ID NO: 40195 - DNA, 636 bp, Panicum virgatum
  misc_feature: Ceres CLONE 2001896
  misc_feature: Encodes the peptide sequence at SEQ ID NO. 40196
tcttgccaagatttatgctcattcatcaattggccagcttcaacgggcttttgggacactgcgtgaatttgaaaatgcctacgggaactctgaggacattgatccagagctcttctcgccatttacttccttgcatccgcttgttgttgcttgctgcaaagatggctttagcacactggattcggtgtatgttcaattggagaatctgactcgtgcggatccaccatacaaatctgttgctgcccttaactgtattatattaggctgtgcaaacatttgggatattgaccgagcatatgaaacttttgtggctatcaaggataagtttgaactcacacctgacatacattcatacaatgcccttctgtgtgcgtttggaaagaagaaagggacagaagaagcttgcaatgtgttcgagcatatattaactcttggtgttaagccaaatgcaacaacatactccctacttgtcgacgcccatcttgcaaataaagatccaaaagctgctcttgccgtaattgataagatggttgatgctggatttataccttcaaaggataccctgaagaaggttcgtagacgctgctctcgtgaatctgacttcgacagtgatgagaaggtgcaatccctggccta

SEQ ID NO: 40196 - protein, 211 aa, Panicum virgatum
  misc_feature: Ceres CLONE 2001896
  misc_feature (116)..(150): Pfam Name: PPR Pfam Description: PPR repeat
  misc_feature (151)..(185): Pfam Name: PPR Pfam Description: PPR repeat
LAKIYAHSSIGQLQRAFGTLREFENAYGNSEDIDPELFSPFTSLHPLVVACCKDGFSTLDSVYVQLENLTRADPPYKSVAALNCIILGCANIWDIDRAYETFVAIKDKFELTPDIHSYNALLCAFGKKKGTEEACNVFEHILTLGVKPNATTYSLLVDAHLANKDPKAALAVIDKMVDAGFIPSKDTLKKVRRRCSRESDFDSDEKVQSLA

SEQ ID NO: 40197 - DNA, 462 bp, Panicum virgatum
  misc_feature: Ceres CLONE 2001914
  misc_feature: Encodes the peptide sequence at SEQ ID NO. 40198
actctagggtttcctcgccaccgccgcttccgccttcgccgccgccgccgccgccgccgccgccgccgcagccatgccgtcccacaagaccttccggatcaagaagaagctggccaagaagcagcgccagaaccgccccatcccctactggatccgcatgcgcaccgacaacaccatcaggtacaacgcgaagcgcaggcactggcgccgcaccaagctcggattctgagcgggggaagagatgccgggcaccgatgcttggggaaactcgtgattacgagccggcctcgggacgcttccatgattccgcatgctaggaagctgcttgtttagattttgcttgtgttaaattgatcttatcagttgtttctgtagcgaactgagaataccatgttttgctgatggttggagaacatcatttataattatgccgaagctatcttgatctgccgtgcgttaatc

SEQ ID NO: 40198 - protein, 51 aa, Panicum virgatum; identical to SEQ ID NO: 9830
  misc_feature: Ceres CLONE 2001914
  misc_feature (9)..(51): Pfam Name: Ribosomal_L39 Pfam Description: Ribosomal L39 protein

SEQ ID NO: 40199 - DNA, 593 bp, Panicum virgatum
  misc_feature: Ceres CLONE 2001944
  misc_feature: Encodes the peptide sequence at SEQ ID NO. 40200
atttttaagcgttgggcgccgctcttatctctccacgttctcgtttctctgcctctcatctctctaccttatcctttggagtgtggggcgcgcgggccgccgccggtcgccgctgcggggcgcgccggccgccgccgcccgccgctgtcgggtgctgctgcgggccgtgccggccgctgctgcggggcgcttgccgggggttcgggtccgaccaagcaggcagcatggcggaggaggcgctgatggacgagctgggcctccgccgcggccacgtcgccctccttctcgcgcccagctcgctccacttccccgtcgtctccctcggcgtgctttccctcggcgccgtgctctccactgccaacccgctcctcacgccaggcgagctcgccgaccaggcccgcgactcggagcctttcctcgcgctcacaaccgccgagctcgcccccaagctcggctccctgctgcccgcctcgcgggtcgtcctggtcgaccagctcctcgccggcctcgacggccacgacgcgtgggcgggcgcgtccggcaccggcggcgacaacccgacgcaggatgccgccggccgccgctaccgggcg

SEQ ID NO: 40200 - protein, 122 aa, Panicum virgatum
  misc_feature: Ceres CLONE 2001944
  misc_feature: SWISSPROT Homolog: EC 6.2.1.12 4-coumarate--CoA ligase
  misc_feature: Useful for making plants with altered cell wall content and/or composition
  misc_feature: Useful for making plants with altered carbohydrate content
MAEEALMDELGLRRGHVALLLAPSSLHFPVVSLGVLSLGAVLSTANPLLTPGELADQARDSEPFLALTTAELAPKLGSLLPASRVVLVDQLLAGLDGHDAWAGASGTGGDNPTQDAAGRRYR

SEQ ID NO: 40201 - DNA, 386 bp, Panicum virgatum
  misc_feature: Ceres CLONE 2001950
  misc_feature: Encodes the peptide sequence at SEQ ID NO. 40202
aattatttaccccaaaggaggatgtgcttcatgcaagagtacggacaaatggtgtggtagaaattcagtttagcccgctaggagagagcaaaagaggtggagaggtctataggttatatgatgttggcggccaaagaaatgagagaaggaagtggattcatctttttgaaggtgttaatgctgtaatcttttgtgttgccattattgagtatgatcaggtgttatttgaggatgagactaacaacagaatgatggagaccaaataactctttgactggcacctaaagcaaatatgttttgagaaaacctcattcatgttgtttctcaactaattcgacattatttgagaggaaaatacaaaatgttcctttgattgtgtgtgagtg

SEQ ID NO: 40202 - protein, 87 aa, Panicum virgatum
  misc_feature: Ceres CLONE 2001950
  misc_feature (1)..(87): Pfam Name: G-alpha Pfam Description: G-protein alpha subunit
LFTPKEDVLHARVRTNGVVEIQFSPLGESKRGGEVYRLYDVGGQRNERRKWIHLFEGVNAVIFCVAIIEYDQVLFEDETNNRMMETK

SEQ ID NO: 40203 - DNA, 675 bp, Panicum virgatum
  misc_feature: Ceres CLONE 2001953
  misc_feature: Encodes the peptide sequence at SEQ ID NO. 40204
gattcacttctctcggactctctcctcccttgctctcccttccctggtggcggcggcgaccgagcggcggcgtcgtttgtcctgtcttcgcccaaccctttgctggcgacgagcgcatccttcagttttaacaatgaagatgatcgctgcctacctgctcgcggttctgggtggaaacacttccccaactgctgatgacgttaagaacattctggaatcagttggggctgaagctgatgaagagaaactggacttcctgctcacagaactcaaagacaaggacataacagaagtgattgcagctggaagggaaaagttcgcctccgtgccttcaggtggtggtgcaattgctgtgggagctccggctgctgcagctggtggtgctgcacctgctgaagaggcaaagaaggaagagaaggttgaagagaaggaggaatcagatgatgatatgggtttcagcttgttcgattaagcactgctgccccgcatatagtttcttctcacgtgtggtctgatacaccggcaccggtcggtatccgcaaaataaccatgccgagaactagtatcagtgtgctattttgcttgtgatgatggacatttctagtactcttttttgaacgtgaacatttctagtactgtggtatcatgatatggagtattgagaactactctgct

SEQ ID NO: 40204 - protein, 112 aa, Panicum virgatum; identical to SEQ ID NO: 26025
  misc_feature: Ceres CLONE 2001953
  misc_feature (17)..(111): Pfam Name: Ribosomal_60s Pfam Description: 60s Acidic ribosomal protein
  misc_feature: Useful for making plants with altered oil content
  misc_feature: Useful for making plants with modulated biomass

SEQ ID NO: 40205 - DNA, 661 bp, Panicum virgatum
  misc_feature: Ceres CLONE 2001964
  misc_feature: Encodes the peptide sequence at SEQ ID NO. 40206
aaaagaacccgcggcagggaagaggagaggagggggtcgtgaaaggaagaaaccaaacccagcccaagaacagaacaccaccgttccctcgccggggcgtccatccgcaacgatctgcagccatggcgatggcttacaagatggcgacggaggggatgaacgtgaaggaggagtgccagcgctggttcatggagatgaagtggaagaaggtgcaccgcttcgtggtgttcaagatcgacgagcggtcgcgcgccgtgctggtggacaaggtgggcggccccggcgaggggtacgaggagctcgtcgccgcgctgcccggcgacgactgccgctacgccgtcttcgacttcgacttcgtcaccgtcgacaactgccagaagagcaagatcttcttcatcgcctggtcgccggcggcgtcgaggatccgagccaagatcctgtacgcgacgtcgaagcaaggcctgcggcggctgctggacggggtccactacgaggtgcaggccaccgacccctccgagatgggcttcgacgtcatcagaggccgcgcgcaatgaagccgctcccggcctcccctacgtgtgtgtgtgtgtgcgcttgtgcccgtctcctgtcaccactactcactgctgcgtgtctgatcgatcggccggatgctaattgg

SEQ ID NO: 40206 - protein, 143 aa, Panicum virgatum; identical to SEQ ID NO: 18321
  misc_feature: Ceres CLONE 2001964
  misc_feature (16)..(143): Pfam Name: Cofilin_ADF Pfam Description: Cofilin/tropomyosin-type actin-binding protein
  misc_feature: Useful for making plants with modulated time to senescence

SEQ ID NO: 40207 - DNA, 701 bp, Panicum virgatum
  misc_feature: Ceres CLONE 2001972
  misc_feature: Encodes the peptide sequence at SEQ ID NO. 40208
acattccgccctcgcagacccgcgcctgaaacccttgcgcccaccgccgccacctcggccaccgccgccgccgcctcccacccgaaatccgcttcgccggtgcgcgcttgtagttgagggaactgctgcttccgtgaacaccggtcgaccatggcgacccgtattcagtttgagaacaattgtgaagttggtgttttttctaagctaacaaatgcctactgcctggtcgcaattggagggtcagagaacttctacagtgcatttgaggctgagcttgcagattccattcctgtggtcaagacctctataggtggcaccagaataatcggccgactctgtgttggaaacaagaatggacttctattgccacataccaccaccgaccaagagctgcagcatctgaggaactgcttgcctgatcaagtggttgtacagcgtattgatgagaggttatcagcccttggcaattgcatagcctgcaatgatcatgttgcacttacacatcctgacctcgacaaggagacggaggagtttattgcagatgtgcttggagttgaggtattcaggcagactattgctggaaatatcctcgtggggagctactgcgcattctctaacaggggtggcttggttcatcctcacacatccattgaagaccttgatgagctctccacactcttgcaagtcccgctcgtggctgg

SEQ ID NO: 40208 - protein, 183 aa, Panicum virgatum
  misc_feature: Ceres CLONE 2001972
  misc_feature (3)..(183): Pfam Name: eIF-6 Pfam Description: eIF-6 family
MATRIQFENNCEVGVFSKLTNAYCLVAIGGSENFYSAFEAELADSIPVVKTSIGGTRIIGRLCVGNKNGLLLPHTTTDQELQHLRNCLPDQVVVQRIDERLSALGNCIACNDHVALTHPDLDKETEEFIADVLGVEVFRQTIAGNILVGSYCAFSNRGGLVHPHTSIEDLDELSTLLQVPLVA

SEQ ID NO: 40209 - DNA, 558 bp, Panicum virgatum
  misc_feature: Ceres CLONE 2001977
  misc_feature: Encodes the peptide sequence at SEQ ID NO. 40210
caacggaggattgactttcaatttggatggttcctggacccaatatatttcggtgattacccagaaagcatgcgtgagcggctgggcagtgatcttccaacattctcagagaaagagaaagaattcattaggaacaaaattgattttattggactaaaccattatacttcgagactcattgcccatcgtcagaatccagaagatgtttatttctatcaagtacaacaagtggagagaatagaaaaatggaatagtggtgaaaagattggtgaaagggctgcatctgaatggcttttcatagttccttggggccttcataaattacttaattatatagcgaagaaatatgataatccagcaatttatattactgagaatggcatggatgaggaagatgatcagtccgcaacactagagcaggttttaaatgacacgacgagagtcggttacttcaaaggatatctggcttcagttgcacaagcaatcaaggatggagttgatgtccgaggatacttcgcgtggtcattcttggacaactttgagtgggctatgggctac

SEQ ID NO: 40210 - protein, 185 aa, Panicum virgatum
  misc_feature: Ceres CLONE 2001977
  misc_feature (1)..(185): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
QRRIDFQFGWFLDPIYFGDYPESMRERLGSDLPTFSEKEKEFIRNKIDFIGLNHYTSRLIAHRQNPEDVYFYQVQQVERIEKWNSGEKIGERAASEWLFIVPWGLHKLLNYIAKKYDNPAIYITENGMDEEDDQSATLEQVLNDTTRVGYFKGYLASVAQAIKDGVDVRGYFAWSFLDNFEWAMG

SEQ ID NO: 40211 - DNA, 693 bp, Panicum virgatum
  misc_feature: Ceres CLONE 2002016
  misc_feature: Encodes the peptide sequence at SEQ ID NO. 40212
aggccagcagcctgggcgtggtggcccttcgccgcggctcccggtggcggcgtcatcccggctctcccacgcggtggcggcgcgcctctcctgccgtgcccctgccgcctgcatccagatcacagaatttgtagctgagactttcttcgagaacaagcaagagctttgcctgtcttcacattaaaggagaactgaagcgaacaacagcgaagggaaaatggcgctatcacgtagtatgagaacatgtttgcacagtggaagacttgccctccttgccatattggtctctggtggaattgtgttgcagatcttggcttgtgctctctataacaactggtggccaatgctaacagttctgatgtaccttatcctaccaatgcccctcatacttttcctgggctctgatacttcctcgatgatgtctaatgggggagatggctgggtgaacttcacgaaattcttgacgggcgcatcaatagtggggagcatcgccattccgtcgatcctgaagcacgccggtatcattggatggggagctctgacaatggagctgtcatcgttcgtagtctttggcgtggcaatcatgtggtttctcccgatgaacagtaaagacgagtacagcagtgtgttctagacgtctattttcagttctcacatcctctttcccgagtgatcctttgcaaaatggccgtg

SEQ ID NO: 40212 - protein, 138 aa, Panicum virgatum
  misc_feature: Ceres CLONE 2002016
  misc_feature (16)..(134): Pfam Name: Vps55 Pfam Description: Vacuolar protein sorting 55
MALSRSMRTCLHSGRLALLAILVSGGIVLQILACALYNNWWPMLTVLMYLILPMPLILFLGSDTSSMMSNGGDGWVNFTKFLTGASIVGSIAIPSILKHAGIIGWGALTMELSSFVVFGVAIMWFLPMNSKDEYSSVF

SEQ ID NO: 40213 - DNA, 271 bp, Panicum virgatum
  misc_feature: Ceres CLONE 2002023
  misc_feature: Encodes the peptide sequence at SEQ ID NO. 40214
aaatcgctccctgcctccggtcgacctccccacccccctgcctgcctaatctctccggacatcccgccgccgttcgtccgctcgcgcgcgctcgcccgtcgctcggagagagaagaccggagaccatggcggaccacctcaccgacaaccagatcgctgagtccaaggaggccttcagcctcttcgtgtgtgacggcgaccgttgcatcacgcctaaggagctgggaactgtgatgcgctccttgggtcagaacccaactgaggctgagct

SEQ ID NO: 40214 - protein, 48 aa, Panicum virgatum
  misc_feature: Ceres CLONE 2002023
  misc_feature: Useful for making plants with modulated biomass
MADHLTDNQIAESKEAFSLFVCDGDRCITPKELGTVMRSLGQNPTEAE

SEQ ID NO: 40215 - DNA, 640 bp, Panicum virgatum
  misc_feature: Ceres CLONE 2002054
  misc_feature: Encodes the peptide sequence at SEQ ID NO. 40216
actagcacccgtcgccgccgccgccgccgccgtcaccgccgccgctgcggtcacacaacaatgggtatcgacctcgtcgccggcggccgcaacaagaagactaagcgcacagcgcctaagtccgacgatgtctacctcaagctcctcgtcaagctctaccgcttcctggttcgaaggacaaagagcaactttaacgccgtgatcctcaagcggctgttcatgagcaagaccaaccaaccgccgctctcgatgcgccgcctagtcaagttcatggagggcaagggtgaccagatcgctgtgatcgtgggcaccgtcaccgacgacaagaggatcactgaggtgccggcgatgaaggtgtgcgcgctcaggttcaccgagacggcgagggccaggatcatcaatgccggtggcgagtgcctcaccttcgaccaacttgcactccgtgcaccgctcggacaaaacacggtcctcctgaggggtcctaagaatgcgagggaagctgttaagcactttggccctgcgcctggagtcccacacagccacaccaagccttatgttcgctcaaagggacggaaatttgagaaggcgagagggaggaggaacagcaggggcttcaaggtctaagtggcggatatcagct

SEQ ID NO: 40216 - protein, 187 aa, Panicum virgatum
  misc_feature: Ceres CLONE 2002054
  misc_feature (12)..(185): Pfam Name: Ribosomal_L18e Pfam Description: Eukaryotic ribosomal protein L18
  misc_feature: Useful for making plants with modulated nitrogen use efficiency
MGIDLVAGGRNKKTKRTAPKSDDVYLKLLVKLYRFLVRRTKSNFNAVILKRLFMSKTNQPPLSMRRLVKFMEGKGDQIAVIVGTVTDDKRITEVPAMKVCALRFTETARARIINAGGECLTFDQLALRAPLGQNTVLLRGPKNAREAVKHFGPAPGVPHSHTKPYVRSKGRKFEKARGRRNSRGFKV

SEQ ID NO: 40217 - DNA, 674 bp, Panicum virgatum
  misc_feature: Ceres CLONE 2002055
  misc_feature: Encodes the peptide sequence at SEQ ID NO. 40218
acgcaacgcaatcttgcaatccagcccccgaaagagacctaaaaaccgccaccaggctttcgatcgcgccgagggaggaggacgagcaatggcggccgaggagggagtcgtgatcgcgtgccacaccaaggaggagttcaagagccagatgacaaaggccaaggatgccggcaagctggtgatcattgacttcactgcctcctggtgtggtccttgccgcatcatcgccccggtgtttgctgaattagccaagaagttcattgacactttcttcctgaaggtcgatgttgacgagctgaaggaagtagcctcagagtacgagatccaggcgatgccgaccttcctcttcatcaagaacggtgagaagatccacactgttgttggtgccaggaaggatgacctccagaccagcatcgagaagcacgcctccgccactgctgcttccgcctccgcctaaggcaatagcgccaccagttatcaataagggccagcccacggcgtggtagcagtgggcgtcgtaattttcagtttggtttgggtgaattgtgagctatgttcaaatatggagtcctgatatgtttggttcctgtgctggaccatagtcataaagtgactacccccgaccgggtcgaggaacagtgtcgagggtcgagggtagtcactttataaattgg

SEQ ID NO: 40218 - protein, 122 aa, Panicum virgatum; identical to SEQ ID NO: 14073
  misc_feature: Ceres CLONE 2002055
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase

SEQ ID NO: 40219 - DNA, 691 bp, Panicum virgatum
  misc_feature: Ceres CLONE 2002071
  misc_feature: Encodes the peptide sequence at SEQ ID NO. 40220
acgcacgcacaccaactccaaacccaactccactatccccatcgccgctgctccgcctcgcgcgcgacgagccatggctgccaggaagttcttcgtcggcggcaactggaaatgcaacggcaccggcgaggacgtgaagaagatcgtgaccgtgctcaacgaggctgaggtgccctccgaggacgtcgtcgaggtggtggtgagcccgccgttcgtcttcctgccccaggtcaaggggctgctgcgcctggactttgccgtcgccgcgcagaactgctgggtgcgcaagggcggtgccttcaccggcgagatcagtgctgagatgctggtgaacctgcaggtgccgtgggtcatcttggggcactcggagcgcagagctctgatgggcgaatccagtgatttcgttgccgaaaaagttgcatatgcactctcccaaggtctcaaggtaattgcttgcataggcgagacccttgagcagagggaagcaggaacaacaatggatgttgttgctgcgcaaacaaaggctatttctgagaaggtatcagattggacaaacattgtattggcctatgagccagtttgggctattgggaccggcaaggttgcaacccctgcccaggctcaggaggttcacgatggtctgagaaagtggctccactctaatgttagtcctgcagttgctgaatcgacc

SEQ ID NO: 40220 - protein, 205 aa, Panicum virgatum
  misc_feature: Ceres CLONE 2002071
  misc_feature (6)..(204): Pfam Name: TIM Pfam Description: Triosephosphate isomerase
  misc_feature: SWISSPROT Homolog: EC 5.3.1.1 Triose-phosphate isomerase
  misc_feature: Useful for making plants with modulated biomass
MAARKFFVGGNWKCNGTGEDVKKIVTVLNEAEVPSEDVVEVVVSPPFVFLPQVKGLLRLDFAVAAQNCWVRKGGAFTGEISAEMLVNLQVPWVILGHSERRALMGESSDFVAEKVAYALSQGLKVIACIGETLEQREAGTTMDVVAAQTKAISEKVSDWTNIVLAYEPVWAIGTGKVATPAQAQEVHDGLRKWLHSNVSPAVAES

SEQ ID NO: 40221 - DNA, 673 bp, Panicum virgatum
  misc_feature: Ceres CLONE 2002125
  misc_feature: Encodes the peptide sequence at SEQ ID NO. 40222
ggtcctccatttaagctccacacctacaacttctctctccctgtctctctcctgcctccattgggcaaagcgctgccaggccgcgtggctagccccgtggtgtgtgcgccggtgagaggcatagagggatgatgtcgagggaacgcaagaagcaggcggcagccgctcttcaggagaagctgaagatcctccgctccatcacccactcccacgctctgagcgacgcatccataatcatggacgcgtcggcgtacatcaaggagctgaagcagaaggtggtgaggctgaaccaggagatcgcctgcgcgcagcaggacgcgctgagacacggctcctcctacccgacggtgaccgtggaaaccctagtgggcgggcacggcgggttcctcatcaacgtcttctccgacaagagctgcccggggctgctcgtctccgtgctcgaggccttcgacgagctggggctcagcgtcctccaggccaccgcgtcctgcgccgacgactccttccgcctcgaggccgtgggtggggagaacgtggcggagaacgtggacgagcacgtcgtgaagcaggccgtgctgcaggccatcaggagctgctccgagggcggcagcgagcacgacgacgaggagtaggcggagctatagctagcgcctagcgcgtaagcgcacacgcc

SEQ ID NO: 40222 - protein, 167 aa, Panicum virgatum
  misc_feature: Ceres CLONE 2002125
  misc_feature: Useful for making plants with modulated biomass
MMSRERKKQAAAALQEKLKILRSITHSHALSDASIIMDASAYIKELKQKVVRLNQEIACAQQDALRHGSSYPTVTVETLVGGHGGFLINVFSDKSCPGLLVSVLEAFDELGLSVLQATASCADDSFRLEAVGGENVAENVDEHVVKQAVLQAIRSCSEGGSEHDDEE

SEQ ID NO: 40223 - DNA, 681 bp, Panicum virgatum
  misc_feature: Ceres CLONE 2002133
  misc_feature: Encodes the peptide sequence at SEQ ID NO. 40224
tgagatcgacttaggaattatgaggcaccggcagccggcaggctcgctcgagctcggctcatttaacagccctcccgctttactcaggagcaggagcaagagccggagtcgcagtcgcagcagaagcaggagccgcagtccccggcgaagagataggttgcgcagtgaacgtgcaccccgccgcagtcgcagtcgcagcaggagccgcagcccatgccgtcacagagaacgacgtggtcacagggatcttacgtgcaagaactgccggagacctgggcactttgctagggagtgcccatctgcggctacatgcaataactgtaatcttccaggccacttcgcagcagaatgcacttcagcaaccgtttgctggaactgcaaggaatctgggcatatcgccattgagtgcaagaatgaggccctgtgccacacatgcaataagacgggtcacttggcacgagattgtcctacttcagggtctaatgctaagctatgcaacaattgttttaagccaggccacatcgctgttgactgcaccaatgaacgggcttgcaacaactgccgtcaacctgggcacatagcttgggagtgcaagaacgacccggtttgcaacctgtgcaatgtctctggtcatgtagcccgtagctgtccaaaaacaactctggcttcagagatacaggg

SEQ ID NO: 40224 - protein, 226 aa, Panicum virgatum
  misc_feature: Ceres CLONE 2002133
  misc_feature (83)..(100): Pfam Name: zf-CCHC Pfam Description: Zinc knuckle
  misc_feature (140)..(157): Pfam Name: zf-CCHC Pfam Description: Zinc knuckle
  misc_feature (121)..(138): Pfam Name: zf-CCHC Pfam Description: Zinc knuckle
  misc_feature (102)..(119): Pfam Name: zf-CCHC Pfam Description: Zinc knuckle
  misc_feature (163)..(180): Pfam Name: zf-CCHC Pfam Description: Zinc knuckle
  misc_feature (182)..(199): Pfam Name: zf-CCHC Pfam Description: Zinc knuckle
EIDLGIMRHRQPAGSLELGSFNSPPALLRSRSKSRSRSRSRSRSRSPRRRDRLRSERAPRRSRSRSRSRSPCRHRERRGHRDLTCKNCRRPGHFARECPSAATCNNCNLPGHFAAECTSATVCWNCKESGHIAIECKNEALCHTCNKTGHLARDCPTSGSNAKLCNNCFKPGHIAVDCTNERACNNCRQPGHIAWECKNDPVCNLCNVSGHVARSCPKTTLASEIQ

SEQ ID NO: 40225 - DNA, 608 bp, Panicum virgatum
  misc_feature: Ceres CLONE 2002136
  misc_feature: Encodes the peptide sequence at SEQ ID NO. 40226
aatgtatgagaatgatttgactgttgacctgcgaacagctgttcactggtcaaaatggcttcacaagatcgagaggacgggaggggcactaacagaagcacttcagagaatatttccgcctgattggaattcatcagaaaatttggaggcttcaaattctgtaagtgatggagattctgagtcttgcagtgattcagactttagtgacaatgatgaagatcatgatattggtgaccactgacataatattgagacagtgctaacctttttgcaatccttcactactgcttcagggccagagttaagccatcaaggctatttgcttgtggactgccaaagaggagggtttggaatcttatcgtgttttaagcctcagctgtctggcctctgcggcatttcctcaagagttgcagacgctcagtaactgttctgctggggctgaaggcacaggctgtcaatgcaacagatgaaggtcactcagttatgtgtgttgctgtacagatcaatgactcgtagtacagcctgtgtggcgattgaatgggaggaattccctcttgaaactgaagtacaactccaatcaagtgatacatgatgactgttttctcatt

SEQ ID NO: 40226 - protein, 79 aa, Panicum virgatum
  misc_feature: Ceres CLONE 2002136
  misc_feature: Useful for making plants with modulated biomass
MYENDLTVDLRTAVHWSKWLHKIERTGGALTEALQRIFPPDWNSSENLEASNSVSDGDSESCSDSDFSDNDEDHDIGDH

SEQ ID NO: 40227 - DNA, 690 bp, Panicum virgatum
  misc_feature: Ceres CLONE 2002138
  misc_feature: Encodes the peptide sequence at SEQ ID NO. 40228
gccagttattaatctcaggttggggaaaaaagcctcgcaaacaaccctccgctgctgatttgggaggcgctcgagttttcaggtaaaccagacctttgggacacatggctcgcactaagcaaaccgctcgcaagtccactggagggaaggctcctaggaagcaactagccaccaaggctgcccgtaagtctgcgcccacaactgggggagtgaagaagcctcaccgttaccgccctgggactgttgctcttcgtgaaatccgcaagtaccagaagagcactgacctgctcataaggaagcttccattccagaggcttgttagggagattgcccaggatttcaagactgatcttcgtttccagagccatgcggtgcttgccctgcaggaggctgcggaagcatacctggtgggtctgttcgaggacaccaacctgtgcgccatccacgccaagcgcgtgacgatcatgcctaaggacattcagctggctaggaggattcgcggcgagagggcttagtttcactgctctggtgtgcatctgttcgatgcaactgcttttgcgatgttggtgctttaacatctgtcagtgttttgaactctgaactatagtgttcgttcgtggtgctaggttaggtgctgctgcaatcttattatgttttagagtttaatcgtttggtaccgaatacatctta

SEQ ID NO: 40228 - protein, 136 aa, Panicum virgatum; identical to SEQ ID NO: 9774
  misc_feature: Ceres CLONE 2002138
  misc_feature (58)..(132): Pfam Name: Histone Pfam Description: Core histone H2A/H2B/H3/H4

SEQ ID NO: 40229 - DNA, 669 bp, Panicum virgatum
  misc_feature: Ceres CLONE 2002156
  misc_feature: Encodes the peptide sequence at SEQ ID NO. 40230
ctcttccacctcggcctccaccccctgccgccgccgcgagccgatccaatggcgccgtcgtctaagctgtcgctgggcatcaagaaggcctcgcggtcccactcctaccaccgccgcgggctgtgggcgatcaaggccaagcacggcggcgccttccccaaggcggagaagcccgccgccgccggcgagcccaagttctaccccgccgatgacgtgaaaccgcgcaagcccagcacccgcaagccgaaacccaccaagctcaggtcgtccatcactccgggcaccgtgctgatcctgctcgccgggaggttcatggggaagagagttgttttcctcaagcagctcaagtctggcatgctccttgttactggacctttcaagatcaacggagtcccaatccgccgtgtgaaccagacctatgtcattgcaacctccacaaaggttgatgtctctggtgttaatgtggagaaatttgatgacagctactttgctagggaaaagaagaagaaggcaaagaagactgagggtgagcttttcgagacagagaaggaggcgactaaggacctgccacagttcaagaaggatgaccagaagtctctggatgccgcactgatcaaagctattgaggccgtgccagatctgaaaacctaccttggtgcacggttctcc

SEQ ID NO: 40230 - protein, 206 aa, Panicum virgatum
  misc_feature: Ceres CLONE 2002156
  misc_feature (112)..(206): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
  misc_feature: Useful for making plants with modulated nitrogen use efficiency
MAPSSKLSLGIKKASRSHSYHRRGLWAIKAKHGGAFPKAEKPAAAGEPKFYPADDVKPRKPSTRKPKPTKLRSSITPGTVLILLAGRFMGKRVVFLKQLKSGMLLVTGPFKINGVPIRRVNQTYVIATSTKVDVSGVNVEKFDDSYFAREKKKKAKKTEGELFETEKEATKDLPQFKKDDQKSLDAALIKAIEAVPDLKTYLGARF

SEQ ID NO: 40231 - DNA, 421 bp, Panicum virgatum
  misc_feature: Ceres CLONE 2002158
  misc_feature: Encodes the peptide sequence at SEQ ID NO. 40232
ggaagaagatccaggggattccccacctcaggcctgctgagtacaagaggtccaggttgcctaggaaccgcaggactgtgaaccgtccctatggtggagtgctctctggaactgcagttagggaaaggatcatccgtgctttcctggttgaagagcagaagattgtgaagaaggtgttgaaaatacagaagaccaaggacaaaaccgcctcaaagtaactctgaaatgggaatgggagtgaactgctgttctgtaaacaaggcgagatatttttgtcatggtgatgatcgatggcttagtctcttctagctaaatgttctagtatgtcgtggtggcaactgtttctaaggctcttaaaattctgtctaccattgtgatgttaaaggttatgagacaacagtgatccctgttacttttgttc

SEQ ID NO: 40232 - protein, 71 aa, Panicum virgatum
  misc_feature: Ceres CLONE 2002158
  misc_feature (1)..(55): Pfam Name: Ribosomal_L34e Pfam Description: Ribosomal protein L34e
  misc_feature: Useful for making plants with modulated nitrogen use efficiency
KKIQGIPHLRPAEYKRSRLPRNRRTVNRPYGGVLSGTAVRERIIRAFLVEEQKIVKKVLKIQKTKDKTASK

SEQ ID NO: 40233 - DNA, 592 bp, Panicum virgatum
  misc_feature: Ceres CLONE 2002190
  misc_feature: Encodes the peptide sequence at SEQ ID NO. 40234
atccaccaccgctcgatcagccgaacaatctccccggacacgcgcgcagaaccgaagatggccgcgtcggcgctgcaccagaccaccagcttcctcgggcaggccctggtaccccgccccgccggcgccggcggccgcatcaccatgcgccgcaccgtgaagagcgctccccagagcatctggtacgggcccgaccgccccaagtacctgggccccttctccgagcagacgccgtcgtacctgaccggcgagttccccggcgactacgggtgggacaccgcggggctttccgccgacccggagaccttcgcgcgcaaccgcgagctggaggtgatccactcgcggtgggcgatgctgggcgcgctggggtgcgtgttcccggagatcctggccaagaacggcgtcaagttcggcgaggcggtgtggttcaaggccggcgcgcagatcttctccgagggcgggttggactacctgggcaaccccaacctggtgcacgcgcagagcatcctggtcatctgggcgtgccagggggtgcttatgggcttcgtcgagggctaccgcgtcggcggcggggcctctcggcgaggggctc

SEQ ID NO: 40234 - protein, 178 aa, Panicum virgatum
  misc_feature: Ceres CLONE 2002190
  misc_feature (57)..(178): Pfam Name: Chloroa_b-bind Pfam Description: Chlorophyll A-B binding protein
MAASALHQTTSFLGQALVPRPAGAGGRITMRRTVKSAPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILVIWACQGVLMGFVEGYRVGGGASRRGA

SEQ ID NO: 40235 - DNA, 987 bp, Panicum virgatum
  misc_feature: Ceres CLONE 2002227
  misc_feature: Encodes the peptide sequence at SEQ ID NO. 40236
agccggccgagccgaggcccggcttttcctcttccccgacccctctccccacattggcggcggcggcggcggcgccatattgcccccattccccatgttctccagttgatgctctccgcctcagccccgaccgctgcggccgtctctcctgccacttcctctccgcttcccgccctaaccccccaaaccctagccccttctcccctcatgtggcgccgcctccccgcccgccgcctcgcctccgccctcctctcctccttcccagtcacgagcgccgctgccccgcgcgctcctcctctcaagcgtcgtcttctcccgcccccgcgctttccctcgttgcagcaggaaccgcgttcgttcgcctcctccgccgcagccgaggtggtgtccttggaggaggccgaagagctgcaccacgcgctcgagaacttccaggtgcagccgaaccagaatcaacctcctccgccggtggaggagcagcaggcatccgggagagaccaccgtagtcggcatcggcggaacaggcgcggacagcaagcacaagtggcggcggcggagcacgggatgacttaccacaaatacgcctccttgcgccgccgacagatccgcgtcgaaacggaggcgtgggagcaggccgcaaaggagtaccgcgagctccttgcggacatgtgtgagcagaagctcgcgcccaaccttccctatataaagtcgctcttcctgggctggtttgagccgctgcgggaccaaatcgctgcagagcaggagctcgtggcggaccgtgggtccagggcttcacatgggccgtacttcaacatgcttcctgcggatatgatggcggtcataactatgcacaagctcatgggactgctcatgactggcagtggggacgggagcgttcgagtcatccaggcagcatgtcagattggcgaggctatcgagcatgaggttcgaatccacagatttctagagaagacaaggaaaaaaagc

SEQ ID NO: 40236 - protein, 259 aa, Panicum virgatum
  misc_feature: Ceres CLONE 2002227
  misc_feature: SWISSPROT Homolog: EC 2.7.7.6 DNA-directed RNA polymerase
MWRRLPARRLASALLSSFPVTSAAAPRAPPLKRRLLPPPRFPSLQQEPRSFASSAAAEVVSLEEAEELHHALENFQVQPNQNQPPPPVEEQQASGRDHRSRHRRNRRGQQAQVAAAEHGMTYHKYASLRRRQIRVETEAWEQAAKEYRELLADMCEQKLAPNLPYIKSLFLGWFEPLRDQIAAEQELVADRGSRASHGPYFNMLPADMMAVITMHKLMGLLMTGSGDGSVRVIQAACQIGEAIEHEVRIHRFLEKTRKK

SEQ ID NO: 40237 - DNA, 684 bp, Panicum virgatum
  misc_feature: Ceres CLONE 2002244
  misc_feature: Encodes the peptide sequence at SEQ ID NO. 40238
atcaccccactcccgctcagcacggcatttgggcggaattctcgcgcccagattccccaattttccctcctccaaagctctcccgaagcgcggcagcggcgaccatggacgccagcggagccaccgggaaggtgaagaagggggcggccgggcgcaaggcgggtggccccaggaagaagtcggtgtcgcggtccgtgaaggccgggctccagttccccgtaggccgcatcgggcgctacctcaagaagggccggtacgcgcagcgcgtcggcaccggcgcccccatctacctcgcggccgtcctcgagtacctcgccgccgaggtgctggagctggccggcaacgcggcgagggacaacaagaagacgcgcatcatcccgcgccacgtgctccttgcgatccgtaacgacgaggagctcgggaagctgctggccggcgtcaccatcgcccacggcggcgtcctccccaacatcaacccggtgctgctgcccaagaaggccgcggagaaggcggccagcggcggcgccaaggaggccaagtcgcccaagaagggcgccaaatccccgaagaaggcttagacagtagagactccagtagcactgtggtgtaacatgttggtgtttagatttgtggatgggttgtgttctggtctaatttcgtcgtggcttgggatctgtggtcatc

SEQ ID NO: 40238 - protein, 157 aa, Panicum virgatum
  misc_feature: Ceres CLONE 2002244
  misc_feature (29)..(102): Pfam Name: Histone Pfam Description: Core histone H2A/H2B/H3/H4
MDASGATGKVKKGAAGRKAGGPRKKSVSRSVKAGLQFPVGRIGRYLKKGRYAQRVGTGAPIYLAAVLEYLAAEVLELAGNAARDNKKTRIIPRHVLLAIRNDEELGKLLAGVTIAHGGVLPNINPVLLPKKAAEKAASGGAKEAKSPKKGAKSPKKA

SEQ ID NO: 40239 - DNA, 651 bp, Panicum virgatum
  misc_feature: Ceres CLONE 2002247
  misc_feature: Encodes the peptide sequence at SEQ ID NO. 40240
gccatttcctcaaccgaagccctacccacccatccaccccggcggcggcgtagcagtagcagaagcacccgaagatggtgaagttcctgaagcccggcaaggccgtgatcctcctccagggccggttcgccggccgcaaggcggtgatcgtgcgcgtgttcgaagagggtacccgcgaccgcccctacggccactgcctcgtcgccggcctggccaagtaccccaagaaggtgatccgcaaggactccgccaagaagaccgccaagaagtcccgcgtcaagtgcttcatcaagctcgtcaacttcacccacatcatgcccacccgctacacgctcgacgtcgacttcaaggacgtcgcctcgggcgggcccgacgcgctctctacccgggacaagaaggtcgccgcttgcaaggccgccaaggcgcgcctcgaggagaggttcaagaccggcaagaacaggtggttctttaccaagctccgcttctagatgcttggcgtcccgcatagtgcctgctttaggtgtcagtttcttgtatcggacactctttaagctatctctgctttggtattgccatgaagactttgtgcttagtattacggatctcggagataattttattaagacatgtcgttgatgtgctaaatgttgt

SEQ ID NO: 40240 - protein, 137 aa, Panicum virgatum; identical to SEQ ID NO: 33860
  misc_feature: Ceres CLONE 2002247
  misc_feature (52)..(137): Pfam Name: Ribosomal_L27e Pfam Description: Ribosomal L27e protein family
  misc_feature (7)..(40): Pfam Name: KOW Pfam Description: KOW motif

SEQ ID NO: 40241 - DNA, 657 bp, Panicum virgatum
  misc_feature: Ceres CLONE 2002267
  misc_feature: Encodes the peptide sequence at SEQ ID NO. 40242
aagacatctccatcacccaaacgatatacacacaatggctttctcttcttccaccaagcttctcctcatcacggccttcttcgcactggcctcgtggcaacaggtcatcgcctttgatcctagccctctccaagacttctgtgtggctgacatgaaatcgcctgtgcgtgtgaatgggtttccatgcaaggacccgatggccgtcaccccggacgacttcttcaacgcggccatgctcgaccagccacggaacaccatgaacaagttcggctccctcgtcaccaacatcaacgtcacgcagttcccgggcctcaacaccctcggcatctcgtacgcgcgcatcgactacgcgccactgggcgtcaacacgccccacctccacccccgcgccaccgagctcctcaccgtgctcgaggggacgctctacctcggcttcgtcacctccaaccctaacaggctcttctccaaggtggtcaagaagggtgacgtgttcgtgttccccaaggcgatgatccacttccagatgaacctggaccatgagaagcctgcggcagcgctgtcctcgctcagcagccagaacccaggggttattaccattgccagtgcggtctttggatcgaacccgcccatctcggacgatgttttggccaaggcgtt

SEQ ID NO: 40242 - protein, 207 aa, Panicum virgatum
  misc_feature: Ceres CLONE 2002267
  misc_feature (66)..(207): Pfam Name: Cupin_1 Pfam Description: Cupin
  misc_feature: SWISSPROT Homolog: EC 1.15.1.1 Superoxide dismutase
  misc_feature: Useful for making plants with modulated nitrogen use efficiency
MAFSSSTKLLLITAFFALASWQQVIAFDPSPLQDFCVADMKSPVRVNGFPCKDPMAVTPDDFFNAAMLDQPRNTMNKFGSLVTNINVTQFPGLNTLGISYARIDYAPLGVNTPHLHPRATELLTVLEGTLYLGFVTSNPNRLFSKVVKKGDVFVFPKAMIHFQMNLDHEKPAAALSSLSSQNPGVITIASAVFGSNPPISDDVLAKA

SEQ ID NO: 40243 - DNA, 658 bp, Panicum virgatum
  misc_feature: Ceres CLONE 2002276
  misc_feature: Encodes the peptide sequence at SEQ ID NO. 40244
aaaccgaagctctctggaactactccggcgagcatcggaagcacacgcacgaggccgcggaaccttccggaaccttcgctaggatgctctccaggttctcggcgtggttcgtgaacccgcgccggaacccgctggcgcgcctccaccggaacgccgtcgccgcccgcctccgcaaatacgggctccggtacgacgacctgtacgacccgtaccacgacctggacatcaaggaggcgctggcgcggctgccgcgggaggtggtggacgcccgcaaccagcgcctgaagcgggccatggacctctccatgaagcaccagtacctccccgacgacgtccaggcaatacgggtgccattcagaagctacctttctgacatgcttgctcttgtgaaaaaggagaaagcagagcgtgaagctctgggagcacttcccctgtaccagagaaccatcccataatgtgctttcttcattatgatctaacaatgagtggcaataagatacagcagatgatactatagtgtgcattatgtgtaatcaaagacattgccagcccaattcccactgtcttagcgcaatgtaatgattgatggagccatgtatatttgtgaacgcttcaacattcagtgcgttttgtgaactggaatatattgttactgaag

SEQ ID NO: 40244 - protein, 123 aa, Panicum virgatum
  misc_feature: Ceres CLONE 2002276
  misc_feature (8)..(111): Pfam Name: UCR_14kD Pfam Description: Ubiquinol-cytochrome C reductase complex 14kD subunit
MLSRFSAWFVNPRRNPLARLHRNAVAARLRKYGLRYDDLYDPYHDLDIKEALARLPREVVDARNQRLKRAMDLSMKHQYLPDDVQAIRVPFRSYLSDMLALVKKEKAEREALGALPLYQRTIP

SEQ ID NO: 40245 - DNA, 678 bp, Panicum virgatum
  misc_feature: Ceres CLONE 2002285
  misc_feature: Encodes the peptide sequence at SEQ ID NO. 40246
ctcaattgtttctgatatgctccagtggccacacaggctagttgttccccttggtgttaatggtgatacaagtgacctggaacttaaacctcaaggaagactttctgttactgggggaaaagccacttctttgaaaaacaaggagttgattggtaaatcaaatccttacctgagactggatgtgccaccaatgtttaaagtcaaaacaaaagtcataaatgaccacctgaatccagaatggaatgaaacatttgaactgattggccaaaaccaaaaaaccccatctgtcattcttgaggtttaccaagaaaaccaacttccacaagacaaaagacttggtggggctaaactaacattgaaccatcttgaacctgaaatcccccctgaagtccctctgaagctgctgcattccgtaaatccacttaaaaatagggataccaaggatagaggcaccttgcatcttaagggcatgtatcctccgtttacaaaaaaagaacaatttgaagccctagaagcggaaaagtgggccataaaagaaaagaagcctctgaaggaagctgggataattggtaacaccatggatgctggtggtggcgctgcatcactagttgggtctggtattggtgctggcgtccggcttggtggctctggtattggtgctggcgtccggcttgtaag

SEQ ID NO: 40246 - protein, 225 aa, Panicum virgatum
  misc_feature: Ceres CLONE 2002285
  misc_feature (34)..(116): Pfam Name: C2 Pfam Description: C2 domain
  misc_feature: SWISSPROT Homolog: EC 3.1.1.4 Phospholipase A(2)
SIVSDMLQWPHRLVVPLGVNGDTSDLELKPQGRLSVTGGKATSLKNKELIGKSNPYLRLDVPPMFKVKTKVINDHLNPEWNETFELIGQNQKTPSVILEVYQENQLPQDKRLGGAKLTLNHLEPEIPPEVPLKLLHSVNPLKNRDTKDRGTLHLKGMYPPFTKKEQFEALEAEKWAIKEKKPLKEAGIIGNTMDAGGGAASLVGSGIGAGVRLGGSGIGAGVRLV

SEQ ID NO: 40247 - DNA, 409 bp, Panicum virgatum
  misc_feature: Ceres CLONE 2002299
  misc_feature: Encodes the peptide sequence at SEQ ID NO. 40248
cttcgtgctctctcggaggtgggttggcttctcctccccctccggttcgcggttcggttctgtccgggttcgtgaggttcttgggggtgagaggaagagatggcggcgtcggatgttgagtaccgctgcttcgtcggcggccttgcctgggccaccgacgacaactcgctccacgacgccttcagccccttcggcgaggtcctcgagtccaagatcatcctcgatcgtgagacccagaggtcccgcggcttcggcttcgtcaccttctcgagcgagcaggcgatgcgctatgccatcgaggggatgaaccgccaggacctggacggccgctgcatcaccgatctcgaggcccactcccgcggcggcctgcgctccggccgccgcggttgcgctcggtacgggcgctcgc

SEQ ID NO: 40248 - protein, 103 aa, Panicum virgatum
  misc_feature: Ceres CLONE 2002299
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAASDVEYRCFVGGLAWATDDNSLHDAFSPFGEVLESKIILDRETQRSRGFGFVTFSSEQAMRYAIEGMNRQDLDGRCITDLEAHSRGGLRSGRRGCARYGRS

SEQ ID NO: 40249 - DNA, 712 bp, Panicum virgatum
  misc_feature: Ceres CLONE 2002301
  misc_feature: Encodes the peptide sequence at SEQ ID NO. 40250
agcgaaacctgaaggctaccgccgctacaagaccccaacacacaaaattgccggagcagcagccgacgccggcgacagcagagagccccggtgtactcgtcgtcgcaagaatggccaagggtggcatcgagtatgccgtggtggacgccttcacggcggagccgttcaagggcaacccggccgcggtctgcctcctccaggacgccgccaaggccgcggacgagcggtggatgcagtccgtcgccgccgagttcaacctctccgagaccgccttcctgctccgcgactcctccccagccgccgccgccgccccgcggttccagctccgatggttcaccgccgccgccgaggtcgagctctgcggccacgcgacgctggcctccgcccacttcctcttcacatccgttctcgcggagcacgagactctcgtcgaattcgcgaccaagtcgggggttctcaccgccaagaaggtagctgcaccggcgagtgcggcggttgcaggtgaggggaaactgttcatcgagctggatttccccatgattgaccttgtcgattgccatcctgccgagctgccgtccatccccgagaccctgaacggagcctctgttgtcagcgtccacaaatcggcgacagctggtgacctcattgtaattcctctactccttacttcagttgttacctgcttcagtgtctatgactgtagatgtaacat

SEQ ID NO: 40250 - protein, 200 aa, Panicum virgatum
  misc_feature: Ceres CLONE 2002301
  misc_feature (5)..(199): Pfam Name: PhzC-PhzF Pfam Description: Phenazine biosynthesis-like protein
MAKGGIEYAVVDAFTAEPFKGNPAAVCLLQDAAKAADERWMQSVAAEFNLSETAFLLRDSSPAAAAAPRFQLRWFTAAAEVELCGHATLASAHFLFTSVLAEHETLVEFATKSGVLTAKKVAAPASAAVAGEGKLFIELDFPMIDLVDCHPAELPSIPETLNGASVVSVHKSATAGDLIVIPLLLTSVVTCFSVYDCRCN

SEQ ID NO: 40251 - DNA, 588 bp, Panicum virgatum
  misc_feature: Ceres CLONE 2002305
  misc_feature: Encodes the peptide sequence at SEQ ID NO. 40252
gtagcagaagcaccaaatcaccagtcgctgggtttcagcaagtgaggtcttcaaaatgagcacacgacttgtcaaggttggacaatggggcggtcagggaggtgattatcatgatattagtcatcaacctcaacgcctaaccaaaatcacaattcgcagcgggtgggcaattgattcgatttcatttagctacgttgatataaatgggactcctcacatagccggtccttggggtggcaatggtggaagctctagggagattaccttcgttgaaggtgagtacgtgcaggaagtttctggtacacatggctattgccaacctgcgaacaacgtaataacatcgcttaatattgtcaccaacatgactacgcattcatatggaaaagccgaaggaaagactttcagcctcccagtggatcatcctgcccaaattgtcggtttctacgtgcgatcagggtggtttgttgatgcaattggcgtctacattcggccttgaaaaaccaatggagccacacgtgcaataagatggcttaatgtcctgccttgtcatgaaaagtgctgcaatatatgcttatttctcacctctgc

SEQ ID NO: 40252 - protein, 146 aa, Panicum virgatum
  misc_feature: Ceres CLONE 2002305
  misc_feature (16)..(146): Pfam Name: Jacalin Pfam Description: Jacalin-like lectin domain
MSTRLVKVGQWGGQGGDYHDISHQPQRLTKITIRSGWAIDSISFSYVDINGTPHIAGPWGGNGGSSREITFVEGEYVQEVSGTHGYCQPANNVITSLNIVTNMTTHSYGKAEGKTFSLPVDHPAQIVGFYVRSGWFVDAIGVYIRP

SEQ ID NO: 40253 - DNA, 860 bp, Panicum virgatum
  misc_feature: Ceres CLONE 2002323
  misc_feature: Encodes the peptide sequence at SEQ ID NO. 40254
atcccctctccggccaaccttgcgcttcccactctctcttcccttagaccattcgacacctgcctaggcgtcgtgcccctgtgcttttctttcttccgacaggaccgatatcctttccgaattttccccaaaatggcggacgaggagcatgctttcgacatggaggctggcggcgacgccggtgcctccgccaccttccccatgcagtgctctgccctgcggaagaacggtcacgtcgtgatcaagggacgcccctgcaagatcgtcgatatgtcgacctctaagaccggcaagcacggtcacgccaaggtccaccttgtcgcgatcgatatctttactggcaagaagctcgaggatctgtctccttcgacccacaacatggacgtcccgaacgtcaaacgcagcgaataccagctggtcaacatcgatgacggcttcctcaacctgatggacgaccagggcaactccaaggacgatgtcaaggtgcccgagagcgacttgggtaaacaaatcgaggcagatttcgaggcggggaaggatctcctggttaccatccaggctgccatgggagaggaggccgccatctccttcaaggagagcggcaaataaagggccgcaccttaatgggaggagaggggagaaggggccggggaccaaggattggagtgacccggttcccccacggcggtagcaatatgatatttgttctcgctgggtttcctttggccgactcagacatatcggttgatgttttcgggaatcatcgtgtccgctggttgcctggaagtttacttcggtacctcgtgcccggcacaagacgggagtcttgacgcccttgcatggtatggaactaacgtctg

SEQ ID NO: 40254 - protein, 158 aa, Panicum virgatum
  misc_feature: Ceres CLONE 2002323
  misc_feature (87)..(154): Pfam Name: eIF-5a Pfam Description: Eukaryotic initiation factor 5A hypusine, DNA-binding OB fold
  misc_feature (31)..(63): Pfam Name: KOW Pfam Description: KOW motif
MADEEHAFDMEAGGDAGASATFPMQCSALRKNGHVVIKGRPCKIVDMSTSKTGKHGHAKVHLVAIDIFTGKKLEDLSPSTHNMDVPNVKRSEYQLVNIDDGFLNLMDDQGNSKDDVKVPESDLGKQIEADFEAGKDLLVTIQAAMGEEAAISFKESGK

SEQ ID NO: 40255 - DNA, 681 bp, Panicum virgatum
  misc_feature: Ceres CLONE 2002337
  misc_feature: Encodes the peptide sequence at SEQ ID NO. 40256
ctccaaacccttgcgccggcgcctccacttcgcttcctcacctcatctcctcgcgctcaggtatctacccgtctccatctccgccccctccggatccaccgccggtctcgcgcctctgattgttatcttccctcgagcgcttgttgctgatctgcgtcgtgctgttcgaatctcctggcggcagggtccggcgccgaagggaggcaagatgtacaccgcgaggaagaagatccagaaggagaagggcctcgagccctccgagttcgaggactccgtcgctcaggccttctttgacctggagaatagcaaccaggagctcaagagcgacctcaaggacctctacatcaacaatgctatccagatggacgttgccgggaacaggaaggctgttgtgatccacgtcccataccgcctgcgcaaggccttcaggaagatccacgtcaggcttgtcagggagctggagaagaaattcagtggcaaggatgtagtagttgttgccacaagaaggattgtgaggccgccaaagaagggttcagctgttcagcgccctcgcaccaggactctaactgctgttcatgatggaatcttggaggatgttgtgtacccagccgagatagttgggaagcgtgtcagataccgtttggatggtgccaagatcatcaagatcttcttggacccgaa

SEQ ID NO: 40256 - protein, 157 aa, Panicum virgatum
  misc_feature: Ceres CLONE 2002337
  misc_feature (6)..(156): Pfam Name: Ribosomal_S7e Pfam Description: Ribosomal protein S7e
  misc_feature: Useful for making plants with modulated biomass
MYTARKKIQKEKGLEPSEFEDSVAQAFFDLENSNQELKSDLKDLYINNAIQMDVAGNRKAVVIHVPYRLRKAFRKIHVRLVRELEKKFSGKDVVVVATRRIVRPPKKGSAVQRPRTRTLTAVHDGILEDVVYPAEIVGKRVRYRLDGAKIIKIFLDP

SEQ ID NO: 40257 - DNA, 711 bp, Panicum virgatum
  misc_feature: Ceres CLONE 2002340
  misc_feature: Encodes the peptide sequence at SEQ ID NO. 40258
accagcttctgctgatatatgaattcttggaaaataacagtgttggtcgtgcactttttggtcgtgcagagcatcagttgaaattagattggacaacaaggtacaacatctgccttggaactgcgaaaggcctggcctatctccacgaagaatctacattaaaaatcgtccacagagatattaaaccatcaaatattcttcttgatgaaaagctgcagccaaaaatatcggattttggcttggctaaactgaatgatgactgtggccgcgtgagcactcggattgctggaactgttggttatatggcacctgaatatgccacaagaggatgcttgacacgcaaagcggatgtctacagctatggagtggtggcactagagattgttagtggcatgagcaatataaatagcatgtctaatgaagaatatctgcatcttcttgattgggccgaaaggttgaatcagcaagggaagctgctagaattggtggaccagcgtctcggttctgactactcgcaagagcaggcactgaggctgctgaacatagctctcctttgtacaaaaacgtcaccgactcagcggccaagaatgtcttcagtggtgaagatgctttgcggtcagatccccatcgaagttgtacctgataacgacaatctaagtgaggacttgcgattcgacattgcccgatcccagtgctccatgaatgatagca

SEQ ID NO: 40258 - protein, 236 aa, Panicum virgatum
  misc_feature: Ceres CLONE 2002340
  misc_feature (2)..(203): Pfam Name: Pkinase_Tyr Pfam Description: Protein tyrosine kinase
  misc_feature: SWISSPROT Homolog: EC 2.7.11.1 Non-specific serine/threonine protein kinase
QLLLIYEFLENNSVGRALFGRAEHQLKLDWTTRYNICLGTAKGLAYLHEESTLKIVHRDIKPSNILLDEKLQPKISDFGLAKLNDDCGRVSTRIAGTVGYMAPEYATRGCLTRKADVYSYGVVALEIVSGMSNINSMSNEEYLHLLDWAERLNQQGKLLELVDQRLGSDYSQEQALRLLNIALLCTKTSPTQRPRMSSVVKMLCGQIPIEVVPDNDNLSEDLRFDIARSQCSMNDS

SEQ ID NO: 40259 - DNA, 703 bp, Panicum virgatum
  misc_feature: Ceres CLONE 2002354
  misc_feature: Encodes the peptide sequence at SEQ ID NO. 40260
agatgagtgccaacagaaagaaagtgctcttaaaagtcatcattctgggtgattcaggagtcgggaagaccagtttaatgaaccaatacgtaaacagaaagtttagcaaccaatacaaagccacaattggtgccgactttcttaccaaagaagtgatggtcgacgatcgtcttgtgacaatgcaaatctgggacactgctggacaagaaagatttcagtcgttgggtgttgcattctaccgaggatctgactgttgtgttctctgttttgatgtaaacaatgctcaaagttttgaacatcttgaacattggagggatgaattcttagctcaagcatcaccagactctgaaaactttccttttgtttgccttggtaacaaaattgatcttgagcaacgtgcagttgcaacaaaacgggcaaaatcatggtgtacatctaaaggtgatattccttatttcgagacctccgcaaaagaagcaatccatgtcgatcaagcatttcaacaagtcgcaaaattagccctccaacaagaaaaaattgatccgccagaaatctatcaaccaaaaggtctcgatttaaaccaagccaaaactgaaaacgatgattgtccatgttaagaacttggcctccctcttaataagcaaacccggccatttttattctgcatttgcctttttttgctttgataaacataattattttc

SEQ ID NO: 40260 - protein, 204 aa, Panicum virgatum
  misc_feature: Ceres CLONE 2002354
  misc_feature (11)..(175): Pfam Name: Ras Pfam Description: Ras family
  misc_feature (11)..(128): Pfam Name: Miro Pfam Description: Miro-like protein
  misc_feature: SWISSPROT Homolog: EC 2.7.11.1 Non-specific serine/threonine protein kinase
  misc_feature: Useful for making plants with modulated water use efficiency
MSANRKKVLLKVIILGDSGVGKTSLMNQYVNRKFSNQYKATIGADFLTKEVMVDDRLVTMQIWDTAGQERFQSLGVAFYRGSDCCVLCFDVNNAQSFEHLEHWRDEFLAQASPDSENFPFVCLGNKIDLEQRAVATKRAKSWCTSKGDIPYFETSAKEAIHVDQAFQQVAKLALQQEKIDPPEIYQPKGLDLNQAKTENDDCPC

SEQ ID NO: 40261 - DNA, 1346 bp, Panicum virgatum
  misc_feature: Ceres CLONE 2002363
  misc_feature: Encodes the peptide sequence at SEQ ID NO. 40262
agaatcaccgcgaaatcggcaagcaagcacatctcaaggacagccatcgagggatcggaggagcaaaactgaccgagcagcaaagacagttgccagaaagttcgtggtgcttgcattctggggttttcttctcgttacagtgcttcgtcttctcaccacaggtgcggtcgtcgatttcatgcttgcaggacgatcggcaattttggcagcttggcaggacattcgaattggacagtcgtttctctcatcgatggcagcactcatcactccttcttcttcttcttcttcttctgaatacccagctactttgccggacgaagagaccggagttttgctaatcaagccggacgatcttgtcgaccatttcatcaatcactgcattccgccgttatcgccgtcgaagcataaaggccagtcggggaaagtgggcatccttggaggcagcgaagagtacacaggtgcgccgtactttgcgggtatctctgcactgcgtgccggcgccgacttgtcatttatcttctgccacccggatgcctcgatcgcgatcaagagctacagccccgagctgatcgtccatccgctgccgatggaactcaacggaaccagagtgtcaacagctgtgccggatttgatgtcgcggctggactcgctcgtggtcggtcctggccttggccggcgtaaggacatgggcgagctggtgtcggcggtcattgcgagcgcacgagcccggcgcacaccaatcgtcgtcgatggggatgcactctggttcgttgcccaagatccctcgatcgttcgagcccatccaactgctgtgctcacacccaacgccatggagttctcgcgactctacgatgcaatctttcctccgtcgtcggcagtggcaaagccgcaggctcccacgttcgaggaaaaacagaagcccgcacgagtcgttgaacttgcacgggcgctcggcaacgtgacaattcttcgcaagggcaacgtcgactttgccaccgatggcaccgtagggtttgtctgttcggtgagtgggtcgctccgccgctgcggtggacagggcgatgtgacagctggctcgatcggcacgtttttgcgttggactttctccagtggaaatcaagagagaccgccgctcctggttgcagcatacgccggtgtggctctgaccaagtggtgcagcgacgctgcctttcaaaaacattctcgggcgatggtcgcctcggatatgattcaagaaattggaccacagtttctcgaacatttcggtcaataggcccaatggaaactctccaaatctcagcacaagcattccttcctcctgtaaatgccctcaggcaaaagctgac

SEQ ID NO: 40262 - protein, 340 aa, Panicum virgatum
  misc_feature: Ceres CLONE 2002363
  misc_feature (59)..(332): Pfam Name: Carb_kinase Pfam Description: Carbohydrate kinase
MAALITPSSSSSSSEYPATLPDEETGVLLIKPDDLVDHFINHCIPPLSPSKHKGQSGKVGILGGSEEYTGAPYFAGISALRAGADLSFIFCHPDASIAIKSYSPELIVHPLPMELNGTRVSTAVPDLMSRLDSLVVGPGLGRRKDMGELVSAVIASARARRTPIVVDGDALWFVAQDPSIVRAHPTAVLTPNAMEFSRLYDAIFPPSSAVAKPQAPTFEEKQKPARVVELARALGNVTILRKGNVDFATDGTVGFVCSVSGSLRRCGGQGDVTAGSIGTFLRWTFSSGNQERPPLLVAAYAGVALTKWCSDAAFQKHSRAMVASDMIQEIGPQFLEHFGQ

SEQ ID NO: 40263 - DNA, 749 bp, Panicum virgatum
  misc_feature: Ceres CLONE 2002366
  misc_feature: Encodes the peptide sequence at SEQ ID NO. 40264
attctctttctctgccaagaacaccggccggctagcagctcgtgctcccatggagatcgacgccgacaacctcagcgccaccgagctccgcctcggcctgccgggaaccagcagcggcgacgccgaccgcccgaagaggccggcgccctccgtcggcgccaagcgcgcgctcgacgacaccaggagcgaggcctcgggcaccagcccggccgccgggggcgaccacgacgccgccacgcctgccaaagcgcaagtggtggggtggccgccggtgagggcgtacaggaagaacaccttccaggcggcggcggcggcgaagaaggccgagcagccgggagggctgtacgtgaaggtgagcatggacggggcgccgtacctcaggaaggtggacctccggatgtataaggggtaccgggagctcagggaggcgctggacgccctcttcaccaagtccttctccgcctccgccggagcggagggcggcgacggccagcacgccctcgcctacgaggacaaggacggcgacctcatgctcgtcggagatgtgccctgggacatgttcatctcttcgtgcaagaagctcaagataatgaatggttctgaggccaggtgaccgctgatgcacaggcagaggctgcaactcatggggtgaatcgaggagcacaggtcgtgcaaaggagctgtgtggcttggactctccagtgctgtacaaagagatgggtgtttctgaaaccaaggagaggatctac

SEQ ID NO: 40264 - protein, 187 aa, Panicum virgatum
  misc_feature: Ceres CLONE 2002366
  misc_feature (7)..(187): Pfam Name: AUX_IAA Pfam Description: AUX/IAA family
  misc_feature: The sequence is a functional homolog of SEQ ID NO 648 in the 11/479,226 US patent application
  misc_feature: The sequence is a functional homolog of SEQ ID NO 636 in the 11/479,226 US patent application
  misc_feature: The sequence is a functional homolog of SEQ ID NO 652 in the 11/479,226 US patent application
MEIDADNLSATELRLGLPGTSSGDADRPKRPAPSVGAKRALDDTRSEASGTSPAAGGDHDAATPAKAQVVGWPPVRAYRKNTFQAAAAAKKAEQPGGLYVKVSMDGAPYLRKVDLRMYKGYRELREALDALFTKSFSASAGAEGGDGQHALAYEDKDGDLMLVGDVPWDMFISSCKKLKIMNGSEAR

SEQ ID NO: 40265 - DNA, 729 bp, Panicum virgatum
  misc_feature: Ceres CLONE 2002371
  misc_feature: Encodes the peptide sequence at SEQ ID NO. 40266
attgacttcatccgtgcggttgagcgctctatagctggaatagagaaaaagcatgcaaaattgaagggtaatgaaaaagctgttgtcgcgcggcatgaagttggacatgcacttgttgggactgctgtagcaaatcttctgcctgggcagccacgtgtggagaaattgagtatattgccaagatcaggaggtgcattaggcttcacttacacccctcccaccacagaggatagatatttgctcttcgttgatgaactacgtggtcgtctagtaacacttctgggcggtcgggcagcagaggaagttgttttagaaggacgagtttctactggtgcgcttgatgacataaggcatgctactgacatggcctacaaagctgtagcagaatatggtcttaatcagcgcattggcccaatatcagttgctactctgtcaaatggtgggctagatgactctgggggatctccatggggaagggatcagggccatctagttgatctcgtccagcgggaagtaaaagcacttttacaatctgcacttgaagtagctctttcagttattcgtgctaatcctgcagttttggaaggtcttggagcatatttagaagagaatgaaaaagttgaaggcgaggagcttcaagagtggctaaagtcagtcgttgcaccaaaggagttgacttcttttatcagaggacagcaagagcaagttcttcagctgggaagcaggctc

SEQ ID NO: 40266 - protein, 242 aa, Panicum virgatum
  misc_feature: Ceres CLONE 2002371
  misc_feature (2)..(215): Pfam Name: Peptidase_M41 Pfam Description: Peptidase family M41
IDFIRAVERSIAGIEKKHAKLKGNEKAVVARHEVGHALVGTAVANLLPGQPRVEKLSILPRSGGALGFTYTPPTTEDRYLLFVDELRGRLVTLLGGRAAEEVVLEGRVSTGALDDIRHATDMAYKAVAEYGLNQRIGPISVATLSNGGLDDSGGSPWGRDQGHLVDLVQREVKALLQSALEVALSVIRANPAVLEGLGAYLEENEKVEGEELQEWLKSVVAPKELTSFIRGQQEQVLQLGSR

SEQ ID NO: 40267 - DNA, 864 bp, Panicum virgatum
  misc_feature: Ceres CLONE 2002383
  misc_feature: Encodes the peptide sequence at SEQ ID NO. 40268
cctctctctccctgctgtatcggccatcgtccccttgttcgacagggccttcctcctcaatctaatctccaaagatgccgcgcaagcctcacgcccccagaaatcatgacctcgtccgtggtgtctcgcgctactcgcgcagcgccatgttccgccgcagcggtaaggccgccgtgaagaagtcgggccaccaatggaaggatgttgccgccgtcaagaaggcccccaagagcgtggagaagaccttcaacaagaccgagaagaggaccgtggtcaccaaggctacgcgcttctacccggctgagaacatccccaggcccattccctcgaggaagagccaccacaagcccgcccacctgaggtcctcgatcacccctggcaccgtcctgatcgtcctctccggccgcttcaggggcaagcgcgtgatcttcctcaagcagctccagccctctggccttctgctcgtcactggccccttcaaggtcaacggtgtgcccgtccgccgcatcaaccaggcctacaccatcgccacctcgaccaaggtcgacatctccggccttgaggtgcccgagaagttcaacgacgcttacttcaagaagggtaaggcccctaagaaggagaagtccgaggaggagttcttcgccgctggttctcagcagaagaagaccatcgatgctcacaggatcgccgatcagaaggcgttcgacgccaaggtgctcgaggtcgtgagcaaggtccccaacctcgctgcttacctcaacgccaagttctcgctcaccaagggtcagttcccccacctcatcaagttctaagcggactgtttgggtatataaaacataaaaaggccaaggcggcttgcaaagc

SEQ ID NO: 40268 - protein, 245 aa, Panicum virgatum
  misc_feature: Ceres CLONE 2002383
  misc_feature (137)..(245): Pfam Name: Ribosomal_L6e Pfam Description: Ribosomal protein L6e
  misc_feature (1)..(71): Pfam Name: Ribosomal_L6e_N Pfam Description: Ribosomal protein L6, N-terminal domain
MPRKPHAPRNHDLVRGVSRYSRSAMFRRSGKAAVKKSGHQWKDVAAVKKAPKSVEKTFNKTEKRTVVTKATRFYPAENIPRPIPSRKSHHKPAHLRSSITPGTVLIVLSGRFRGKRVIFLKQLQPSGLLLVTGPFKVNGVPVRRINQAYTIATSTKVDISGLEVPEKFNDAYFKKGKAPKKEKSEEEFFAAGSQQKKTIDAHRIADQKAFDAKVLEVVSKVPNLAAYLNAKFSLTKGQFPHLIKF

SEQ ID NO: 40269 - DNA, 647 bp, Panicum virgatum
  misc_feature: Ceres CLONE 2002385
  misc_feature: Encodes the peptide sequence at SEQ ID NO. 40270
aaatttcatcgtgatggggatagaatcgtcatccatcactagctcggatcggagcagaatctgttcgtcccttccccgagaggcaacctaccacgctagctagcgagcgagctgccgggatgctgatgcagctctccggcggcggccgccggagcatggtcctgccgtggctcgccgtggtggcggccgcggccgcgctggccgccgccccgcgcggggcggaggcgtaccggaactacaccgtcggcgacgacaagggctggtacgacggcctcaccctgcccggggtcgactaccaggcctgggccgacggcatcaagaacttcagcctcggggacttcctcatcttcaacacggacaagaaccactcggtggtgcagacgcggaacgggacgctgtacaagagctgcgactacaacgactcgggccccgacgacaccctcgagtggtccgccgccgcgccggagttcacaaaggacgccgtcaccgtcgccgtgccgctcctcagggagggccgcacctacttcttctcgggcaactacgacggcgagcagtgcgagaacggccagcgcttcgccatcgacgtcgcgcacggccagggcctgccgccggacctcaggccgcccgccgccgccgccgcgcccgcg

SEQ ID NO: 40270 - protein, 175 aa, Panicum virgatum
  misc_feature: Ceres CLONE 2002385
  misc_feature (48)..(150): Pfam Name: Cu_bind_like Pfam Description: Plastocyanin-like domain
MLMQLSGGGRRSMVLPWLAVVAAAAALAAAPRGAEAYRNYTVGDDKGWYDGLTLPGVDYQAWADGIKNFSLGDFLIFNTDKNHSVVQTRNGTLYKSCDYNDSGPDDTLEWSAAAPEFTKDAVTVAVPLLREGRTYFFSGNYDGEQCENGQRFAIDVAHGQGLPPDLRPPAAAAAP

SEQ ID NO: 40271 - DNA, 653 bp, Panicum virgatum
  misc_feature: Ceres CLONE 2002386
  misc_feature: Encodes the peptide sequence at SEQ ID NO. 40272
agagagagagagagaggcgggcgtcgcggcatccccccgattcccaattccccctctcggccggccgcgaccggattcgttccgccgtccctcgcagccttcgatccgagccgcgggaggtgcgcccgccgatcgagcggtagggcagggcggagggaggaggaggaggaggatgagcttccaggacctggaggcgggcaacgtccgcggggcgccgctgggcggcgcgcggcggaacggccggggggcccccgcggcgggcggcgccggcgcgtcgcaggccgtcgcgtcgggcgtcttccagatcaacaccgccgtcgccacgttccagcgcctcgtcaacacgctcggcacgcccaaggacacccccgacctgcgcgacaggatacataaaacacggcaacacataacacaactagttaaggatacatcggacaagcttaaacaagctagtgaggcggatcatcgtgtcgaagtcagcgctaccaagaagattgctgatgcaaagctagctaaggatttccaagcagtccttaaagaattccagaaagctcaacggttagcagttgagagagaagctgcatatgcaccttttatttctccaggcgggtctgccacagagctacaattcaagcgaggggaataatgggtgc

SEQ ID NO: 40272 - protein, 157 aa, Panicum virgatum
  misc_feature: Ceres CLONE 2002386
  misc_feature (26)..(125): Pfam Name: Syntaxin Pfam Description: Syntaxin
MSFQDLEAGNVRGAPLGGARRNGRGAPAAGGAGASQAVASGVFQINTAVATFQRLVNTLGTPKDTPDLRDRIHKTRQHITQLVKDTSDKLKQASEADHRVEVSATKKIADAKLAKDFQAVLKEFQKAQRLAVEREAAYAPFISPGGSATELQFKRGE

SEQ ID NO: 40273 - DNA, 857 bp, Panicum virgatum
  misc_feature: Ceres CLONE 2002387
  misc_feature: Encodes the peptide sequence at SEQ ID NO. 40274
agcagagcttagttttagacacgcctgccaattagttaccaagtagtgcccaaagggtcaatctcgtggtgatctgacgatgaagatagtgctcaaagtggcgatcacctgcaagaagtgcaaaacctgcgtcctggggatctcatcaaaaattaaagggatcaagtcgctgacatatgacgacgagaagagcactctgacggttgtgggcgaggtggacgtggtggagatcgtggcggcgctgcgcaaggcaaagcacccggcggaggtggtgtcggtgaccgacgagaagaaggaggccgaggagaagaagaagaaggaggaggaagagaagaagaaaaaggaggaagagaagaagaaggaggaagcagccaagaagaagtgctgctgtcccctgccgtgcccgatatgccccaaggcgtgccctccgccgccgtgccccctgccgtgccccccgccgtacatgaagcagtgccagccatgctacatccccatcgaggacgagtaccccggcccctgcaccatcgtctgagagagcgacgccatggccacctataccagtaccagtttgttgccgatgaaaaaatgtcgcatcctcttccagcaggcgcttgaattagctcgcgcgatcggttccaaagatttggtttacatggacattctctttctgaattctgaatcttttcattcttgagtgatcttccatgattagcactttagcagccgagaccgacaggtgcctgaaggatatcatgtagtggcaattgtcaacattccagtaagtactatctatagctttgtaataacttgcatcctttgctccaagaaaaaaaaacatccaatcgaatgccaagatc

SEQ ID NO: 40274 - protein, 150 aa, Panicum virgatum
  misc_feature: Ceres CLONE 2002387
  misc_feature (3)..(64): Pfam Name: HMA Pfam Description: Heavy-metal-associated domain
MKIVLKVAITCKKCKTCVLGISSKIKGIKSLTYDDEKSTLTVVGEVDVVEIVAALRKAKHPAEVVSVTDEKKEAEEKKKKEEEEKKKKEEEKKKEEAAKKKCCCPLPCPICPKACPPPPCPLPCPPPYMKQCQPCYIPIEDEYPGPCTIV

SEQ ID NO: 40275 - DNA, 664 bp, Panicum virgatum
  misc_feature: Ceres CLONE 2002399
  misc_feature: Encodes the peptide sequence at SEQ ID NO. 40276
gtccagagggtggccatggcaatagctccctctcgtcttggtggacagcttgaaatgaagcaaactcctggatctcctgaggcgcacacgcttgcaaggtggatcggcaggagctacaggttccacactggagctgaactacttcgtgctgacacccaatgcacggatgcttccttgaaagcactctggcaacactcggactctatcatgtgctgttccctgaaggctgctcctgtgtttaccttcgccaaccaagccggccttgacatgctggagacgaccctgattgctctccaggacatctcactggagaagatcctggacgatgacggccggaaggcactttgcaccgaataccccaagattatgcaacagggcttcgcatacctccctggcggtgtctgcgtgtcgagcatgggtcggcctgtgtcgtacgagcaagcggtggcgtggaaggtcctgagcgacgacgacaccccgcactgccttgccttcatgttcgtgaactggtccttcgtgtgagaaaaaccctagtcgagtctgccatttctcaagaacttgtctgtatccatgtaccgtcgcttttgcctgtgtcatgagtcatgacaaactatgaaacgcatctccccagttcatcctgtggacacaaactgcttgtagctgt

SEQ ID NO: 40276 - protein, 173 aa, Panicum virgatum
  misc_feature: Ceres CLONE 2002399
  misc_feature (26)..(173): Pfam Name: MEKHLA Pfam Description: MEKHLA domain
  misc_feature: Useful for making plants with altered carbohydrate content
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 2 in US patent 7056739
  misc_feature: Useful for making plants with altered lignin content
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
VQRVAMAIAPSRLGGQLEMKQTPGSPEAHTLARWIGRSYRFHTGAELLRADTQCTDASLKALWQHSDSIMCCSLKAAPVFTFANQAGLDMLETTLIALQDISLEKILDDDGRKALCTEYPKIMQQGFAYLPGGVCVSSMGRPVSYEQAVAWKVLSDDDTPHCLAFMFVNWSFV

SEQ ID NO: 40277 - DNA, 653 bp, Panicum virgatum
  misc_feature: Ceres CLONE 2002403
  misc_feature: Encodes the peptide sequence at SEQ ID NO. 40278
acaggccccagagcgctccattccgaaggcgtgtagccgaagccccacctgtagcggcaaatagctagctggtctgcctccctctctgttctgctgctgccgccttcctcctgctgctcggagtcgggggctcggctcagcgagctcgcggtggtggtaggcattctccggcaatggggtgcaaggcgtgcgacaagcccaagcccaactaccgcaagggcctgtggtcgccggaggaggacgagaagctccgcgactacatcctccgccacggccacggctgctggagcgcgctccccgccaaagccgggctccaccggaacggcaagagctgcaggctgcggtggatgaactacctgcgcccggggctgaagcacggcatgttctcgccggaggaggaggagacggtgatgagcctccacgccacgctcggcaacaagtggtcgaggatcgcacggcacctgcctggcaggaccgacaacgaggtcaagaactactggaactcgtacctcaagaagagggtcgaggcaggcgccaaggagggcccgggcacgcccgcgccggccgcgaccagctccggcgccgacgacacggaggactcgcgtcagagcgccaagcccggggaagacggcgcggcggcggccgacgggccg

SEQ ID NO: 40278 - protein, 159 aa, Panicum virgatum
  misc_feature: Ceres CLONE 2002403
  misc_feature (15)..(62): Pfam Name: Myb_DNA-binding Pfam Description: Myb-like DNA-binding domain
  misc_feature (68)..(113): Pfam Name: Myb_DNA-binding Pfam Description: Myb-like DNA-binding domain
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: Useful for biocontainment applications
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Useful for making plants with modulated biomass
  misc_feature: The sequence is a functional homolog of SEQ ID NO 1917 in the 10/374,780 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: Useful for making plants with altered cell wall content and/or composition
  misc_feature: Useful for making plants with altered lignin content
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 442 in the 10/412,699 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: Useful for making plants with altered alkaloid content
  misc_feature: Useful for making plants with modulated nitrogen use efficiency
  misc_feature: Useful for making plants with altered terpenoid content
  misc_feature: The sequence is a functional homolog of SEQ ID NO 1073 in the 10/374,780 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 1010 in the 11/435,388 US patent application
  misc_feature: The sequence is a functional homolog of SEQ ID NO 271 in the 11/479,226 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1002 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 58 in the 10/666,642 US patent application
  misc_feature: Useful for making plants with modulated low light sensitivity
  misc_feature: The sequence is a functional homolog of SEQ ID NO 794 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 822 in the 10/412,699 US patent application
  misc_feature: The sequence is a functional homolog of SEQ ID NO 36 in US patent 7193132
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 824 in the 10/412,699 US patent application
  misc_feature: The sequence is a functional homolog of SEQ ID NO 446 in the 10/412,699 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 790 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 126 in the 10/412,699 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 743 in the 10/666,642 US patent application
MGCKACDKPKPNYRKGLWSPEEDEKLRDYILRHGHGCWSALPAKAGLHRNGKSCRLRWMNYLRPGLKHGMFSPEEEETVMSLHATLGNKWSRIARHLPGRTDNEVKNYWNSYLKKRVEAGAKEGPGTPAPAATSSGADDTEDSRQSAKPGEDGAAAADG

SEQ ID NO: 40279 - DNA, 698 bp, Panicum virgatum
  misc_feature: Ceres CLONE 2002409
  misc_feature: Encodes the peptide sequence at SEQ ID NO. 40280
gcgtcagcaacttcagctgcaagaagcttgagtacctgctatcctttgcaaagattccaccggcagcaaaccaggtggaggtgcacccatactgccggcagaacaagttaagagcgttctgcagggataaggggatccagctctgcgcctactctccactgggcggcaagggaacaccatgggccaacaactctgtcatggactgccctgtccttaagcagatcgcccgtgaaaggggcaaaacagtcgcccaggtgtgcattaggtgggtgtatgagcagggagattgcgtgatcgctaaaagcttcaacaggcagcggatgcgagagaacctcgacatcttcggctgggagctcaccgatgacgacagacgccggatcagctccctgccagaatcaaggggcacctacaatttcttcgtccatgaatccggcccctacaaaaccgctgaagaattctgggacggtgagattgtgtatggccagtcgacttaccacattgcatcttgatccgaccaactgatcaattgctggctagaggttgctagtcaagaaaactctccatctaaagcacaatgtaatttgcgcttgcctcatctaagaataaacatggtaaacttaggactatgagaccactttctcaccattgtgtaagttgttgttgccatgcaactcactatatttcccttttcatgcata

SEQ ID NO: 40280 - protein, 168 aa, Panicum virgatum
  misc_feature: Ceres CLONE 2002409
  misc_feature (1)..(131): Pfam Name: Aldo_ket_red Pfam Description: Aldo/keto reductase family
  misc_feature: SWISSPROT Homolog: EC 2.3.1.170 6'-deoxychalcone synthase
  misc_feature: The sequence is a functional homolog of SEQ ID NO 26 in US patent 7193127
VSNFSCKKLEYLLSFAKIPPAANQVEVHPYCRQNKLRAFCRDKGIQLCAYSPLGGKGTPWANNSVMDCPVLKQIARERGKTVAQVCIRWVYEQGDCVIAKSFNRQRMRENLDIFGWELTDDDRRRISSLPESRGTYNFFVHESGPYKTAEEFWDGEIVYGQSTYHIAS

SEQ ID NO: 40281 - DNA, 690 bp, Panicum virgatum
  misc_feature: Ceres CLONE 2002418
  misc_feature: Encodes the peptide sequence at SEQ ID NO. 40282
caccaactttctttcgcaacatccacgccagcacgatcgtcaaattcatccaagacttctagtcgcatcgcatacttttcatcgtcaattcaatcccaaacattcaaaatggcccccaaagctgccgacaagaagcccgcctccaaggctccggctactgcctccaaggcccccgagaagaaggatgccggcaagaagaccgcgccctcgggcgacaagaagaagcggaccaaggcccggaaggagacttactcctcctacatctacaaggtcctgaagcaggttcatcccgacaccggtatttccaaccgtgccatgtctatcctgaactcttttgtcaacgacatcttcgagcgcgtcgccaccgaggcttccaagctcgctgcctacaacaagaagtcgaccatctcatcgcgcgagatccagacatccgtccgcctcattcttcccggcgagctggccaagcacgccgtgtcggaaggcaccaaggccgtcaccaagtactcgtccagcacgaaataaacgacgggctcggggttttgcttttctcgttttctcttagggcacatggattgcttggcatttgggagtcatgacgaggctggccaaggcacacatgccctttggagtctcttaatgcaatgcgttacggatggtctgctttttgggggcaatgtttttcatggttat

SEQ ID NO: 40282 - protein, 137 aa, Panicum virgatum
  misc_feature: Ceres CLONE 2002418
  misc_feature (42)..(112): Pfam Name: Histone Pfam Description: Core histone H2A/H2B/H3/H4
  misc_feature: Useful for biocontainment applications
  misc_feature: Useful for making plants with modulated flowering time
MAPKAADKKPASKAPATASKAPEKKDAGKKTAPSGDKKKRTKARKETYSSYIYKVLKQVHPDTGISNRAMSILNSFVNDIFERVATEASKLAAYNKKSTISSREIQTSVRLILPGELAKHAVSEGTKAVTKYSSSTK

SEQ ID NO: 40283 - DNA, 594 bp, Panicum virgatum
  misc_feature: Ceres CLONE 2002420
  misc_feature: Encodes the peptide sequence at SEQ ID NO. 40284
cggataagttgatggagagaaggcagaagaggatgataaagaatagggagtcagctgctcgttcaagggctaggaagcaggcctacactaatgaactggaaaacaaggtatctcgattagaagaggagaatgggaggctaaagaggcaaaaggagttggagaagatacttttctctgcgcctatgccggaacccaaatatcaactcaggagaacaggctcggcggctttctgatcatgtccaggatatctagttttgtttctctgagtgctgtggcttgtaagattttgcctcttcggcttagaatcatttgctagcttgggagtttttggcttatcctagctcgatggtttgctctctagattagcaggagcctagcatgtgctgtctgagcaccgctgtctctcctctgaggccttgctactagcctagtatgtaaatttaaatctgcaggactcatttaggtggtcgtacctttctttacatggtgacttaaccactgctcttccatgtgtgatattctgtgcttgcgaaactgcattgtggcagatggatacatataactctgagcagtatgaacttttttcttttttgt

SEQ ID NO: 40284 - protein, 76 aa, Panicum virgatum
  misc_feature: Ceres CLONE 2002420
  misc_feature (2)..(61): Pfam Name: bZIP_1 Pfam Description: bZIP transcription factor
  misc_feature: The sequence is a functional homolog of SEQ ID NO 1836 in the 10/412,699 US patent application
  misc_feature: The sequence is a functional homolog of SEQ ID NO 2524 in the 10/374,780 US patent application
  misc_feature: The sequence is a functional homolog of SEQ ID NO 60 in the 10/286,264 US patent application
  misc_feature: The sequence is a functional homolog of SEQ ID NO 706 in the 10/412,699 US patent application
  misc_feature: The sequence is a functional homolog of SEQ ID NO 916 in the 10/225,066 US patent application
  misc_feature: The sequence is a functional homolog of SEQ ID NO 1540 in the 10/412,699 US patent application
  misc_feature: Useful for making plants with altered alkaloid content
  misc_feature: The sequence is a functional homolog of SEQ ID NO 1539 in the 10/412,699 US patent application
  misc_feature: The sequence is a functional homolog of SEQ ID NO 1541 in the 10/412,699 US patent application
  misc_feature: The sequence is a functional homolog of SEQ ID NO 1537 in the 10/412,699 US patent application
  misc_feature: The sequence is a functional homolog of SEQ ID NO 2542 in the 10/374,780 US patent application
  misc_feature: The sequence is a functional homolog of SEQ ID NO 268 in the 10/225,066 US patent application
  misc_feature: The sequence is a functional homolog of SEQ ID NO 750 in the 10/412,699 US patent application
  misc_feature: The sequence is a functional homolog of SEQ ID NO 1538 in the 10/412,699 US patent application
  misc_feature: The sequence is a functional homolog of SEQ ID NO 1542 in the 10/412,699 US patent application
  misc_feature: The sequence is a functional homolog of SEQ ID NO 114 in the 10/374,780 US patent application
  misc_feature: The sequence is a functional homolog of SEQ ID NO 36 in the 10/225,066 US patent application
  misc_feature: The sequence is a functional homolog of SEQ ID NO 2034 in the 10/374,780 US patent application
  misc_feature: The sequence is a functional homolog of SEQ ID NO 38 in the 10/225,066 US patent application
  misc_feature: The sequence is a functional homolog of SEQ ID NO 382 in the 10/412,699 US patent application
  misc_feature: Useful for making plants with modulated drought sensitivity
  misc_feature: Useful for making plants with modulated water use efficiency
  misc_feature: The sequence is a functional homolog of SEQ ID NO 338 in the 10/374,780 US patent application
  misc_feature: The sequence is a functional homolog of SEQ ID NO 770 in the 10/225,066 US patent application
  misc_feature: The sequence is a functional homolog of SEQ ID NO 1762 in the 10/374,780 US patent application
  misc_feature: The sequence is a functional homolog of SEQ ID NO 374 in the 10/412,699 US patent application
  misc_feature: The sequence is a functional homolog of SEQ ID NO 867 in the 11/479,226 US patent application
  misc_feature: The sequence is a functional homolog of SEQ ID NO 1761 in the 10/374,780 US patent application
  misc_feature: The sequence is a functional homolog of SEQ ID NO 1481 in the 11/479,226 US patent application
  misc_feature: The sequence is a functional homolog of SEQ ID NO 710 in the 10/412,699 US patent application
  misc_feature: The sequence is a functional homolog of SEQ ID NO 352 in the 10/666,642 US patent application
  misc_feature: The sequence is a functional homolog of SEQ ID NO 140 in the 10/286,264 US patent application
  misc_feature: The sequence is a functional homolog of SEQ ID NO 364 in the 10/412,699 US patent application
  misc_feature: The sequence is a functional homolog of SEQ ID NO 851 in the 11/479,226 US patent application
  misc_feature: Useful for making plants with altered lignin content
  misc_feature: Useful for making plants with modulated nitrogen use efficiency
  misc_feature: The sequence is a functional homolog of SEQ ID NO 933 in the 10/374,780 US patent application
  misc_feature: The sequence is a functional homolog of SEQ ID NO 1120 in the 11/479,226 US patent application
  misc_feature: The sequence is a functional homolog of SEQ ID NO 486 in the 10/412,699 US patent application
  misc_feature: The sequence is a functional homolog of SEQ ID NO 410 in the 10/412,699 US patent application
  misc_feature: The sequence is a functional homolog of SEQ ID NO 960 in the 11/479,226 US patent application
  misc_feature: The sequence is a functional homolog of SEQ ID NO 100 in the 10/286,264 US patent application
  misc_feature: The sequence is a functional homolog of SEQ ID NO 378 in the 10/412,699 US patent application
  misc_feature: The sequence is a functional homolog of SEQ ID NO 614 in the 11/435,388 US patent application
  misc_feature: The sequence is a functional homolog of SEQ ID NO 874 in the 11/479,226 US patent application
  misc_feature: The sequence is a functional homolog of SEQ ID NO 1232 in the 10/412,699 US patent application
  misc_feature: The sequence is a functional homolog of SEQ ID NO 926 in the 10/374,780 US patent application
  misc_feature: The sequence is a functional homolog of SEQ ID NO 2140 in the 10/374,780 US patent application
  misc_feature: The sequence is a functional homolog of SEQ ID NO 286 in the 10/666,642 US patent application
  misc_feature: Useful for making plants with altered terpenoid content
  misc_feature: The sequence is a functional homolog of SEQ ID NO 366 in the 10/412,699 US patent application
  misc_feature: The sequence is a functional homolog of SEQ ID NO 855 in the 11/479,226 US patent application
  misc_feature: Useful for making plants with modulated endosperm cell number
  misc_feature: Useful for making plants with modulated endosperm size
  misc_feature: The sequence is a functional homolog of SEQ ID NO 186 in the 10/225,068 US patent application
  misc_feature: The sequence is a functional homolog of SEQ ID NO 2802 in the 10/374,780 US patent application
  misc_feature: The sequence is a functional homolog of SEQ ID NO 908 in the 10/225,066 US patent application
  misc_feature: The sequence is a functional homolog of SEQ ID NO 1342 in the 10/374,780 US patent application
  misc_feature: The sequence is a functional homolog of SEQ ID NO 1343 in the 10/374,780 US patent application
  misc_feature: The sequence is a functional homolog of SEQ ID NO 1112 in the 11/479,226 US patent application
  misc_feature: The sequence is a functional homolog of SEQ ID NO 912 in the 10/374,780 US patent application
  misc_feature: The sequence is a functional homolog of SEQ ID NO 913 in the 10/374,780 US patent application
  misc_feature: The sequence is a functional homolog of SEQ ID NO 110 in the 10/374,780 US patent application
  misc_feature: The sequence is a functional homolog of SEQ ID NO 1104 in the 10/225,066 US patent application
  misc_feature: The sequence is a functional homolog of SEQ ID NO 362 in the 10/412,699 US patent application
  misc_feature: The sequence is a functional homolog of SEQ ID NO 847 in the 11/479,226 US patent application
  misc_feature: The sequence is a functional homolog of SEQ ID NO 911 in the 10/374,780 US patent application
  misc_feature: The sequence is a functional homolog of SEQ ID NO 910 in the 10/374,780 US patent application
  misc_feature: The sequence is a functional homolog of SEQ ID NO 1225 in the 10/412,699 US patent application
  misc_feature: The sequence is a functional homolog of SEQ ID NO 922 in the 10/374,780 US patent application
DKLMERRQKRMIKNRESAARSRARKQAYTNELENKVSRLEEENGRLKRQKELEKILFSAPMPEPKYQLRRTGSAAF

SEQ ID NO: 40285 - DNA, 744 bp, Panicum virgatum
  misc_feature: Ceres CLONE 2002421
  misc_feature: Encodes the peptide sequence at SEQ ID NO. 40286
gtctcctccgcctccggcctccctgtctgtcccctccccacccccatcccgtaaaagcaccggccattgccgcaccaagcttccctcccctcaaatgcccgagaccccaccgccgcgacgcgccccaccgtccgcacatggctaacgggctcctcctccgcgccgcctccccgggcctccgccccgccgccagctcctccgctgactccggccggggacatggcgtggtgacgatcggcgattcgaggccgcgcggtgctgctctgcgggtgggaggacctagccggagagaattctcatttatcacaacagccgccaaagatcattctgtcttgacccggcaacttctagattcgcgacatgatacagtagatgaggttggtacagaacatgatccgttcattgagttgaaagcaaggttcatggacttcaaacagcgaaactatgtggaaaaattttcaaattaccaaagtttggcgcaacagcaaacaccaaagttcatggtgattgcttgtgctgactccagggtctgccctaccagtattttggggtttcagcctggggaagcatttacagttcgtaatgtggcaaatttggtaccaccatatgagcatgggggttcagagactagtgcagcactagagtttgctgtcaatacactccaggtagaaaatgtattggtggtaggtcacagccgatgtggtggcatccaggcactaatgagtatgaaagatgaccccacct

SEQ ID NO: 40286 - protein, 202 aa, Panicum virgatum
  misc_feature: Ceres CLONE 2002421
  misc_feature (114)..(202): Pfam Name: Pro_CA Pfam Description: Carbonic anhydrase
  misc_feature: SWISSPROT Homolog: EC 4.2.1.1 Carbonate dehydratase
MANGLLLRAASPGLRPAASSSADSGRGHGVVTIGDSRPRGAALRVGGPSRREFSFITTAAKDHSVLTRQLLDSRHDTVDEVGTEHDPFIELKARFMDFKQRNYVEKFSNYQSLAQQQTPKFMVIACADSRVCPTSILGFQPGEAFTVRNVANLVPPYEHGGSETSAALEFAVNTLQVENVLVVGHSRCGGIQALMSMKDDPT

SEQ ID NO: 40287 - DNA, 619 bp, Panicum virgatum
  misc_feature: Ceres CLONE 2002422
  misc_feature: Encodes the peptide sequence at SEQ ID NO. 40288
catcttctcagtagtacactcgctagctagctaagctgctatataaattaaattaaagctagtagtactgatcgatcggcatcgccggccggagatcgacatgacgacgatgatgaagaagcagcagcaagctgtggtgctgctgctgctgctgctggtggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagcttatcactacatgcacgcgtgtatctatacatacatgcatacatacatatatatgatcgctcgctcgctggatcgatcttagtcgtctacgtgtggcttgctgctgttcatccagccgctcgctacgtgtgtcacacgacggataaataaaagatgcatgggttgcctccgggccgctccctatatagct

SEQ ID NO: 40288 - protein, 95 aa, Panicum virgatum
  misc_feature: Ceres CLONE 2002422
  misc_feature (30)..(95): Pfam Name: Tryp_alpha_amyl Pfam Description: Protease inhibitor/seed storage/LTP family
  misc_feature: Useful for making plants with modulated biomass
MTTMMKKQQQAVVLLLLLLVAAGGASAASCNAGQLTVCASALTSGGKPSAACCSNLKAQQGCFCQFAKNPAFARYINSPTARKVVASCGVALPRC

SEQ ID NO: 40289 - DNA, 629 bp, Panicum virgatum
  misc_feature: Ceres CLONE 2002432
  misc_feature: Encodes the peptide sequence at SEQ ID NO. 40290
gtccttcgtagagtacactacactacaccttgtacccgccaagtcaccaacaccggcttttgtgctatcggcggcatcgaccgacgagcggaggcgacgactccgatccatggggcggccgccgtgttgcgacaaggagggcgtgaagaaggggccgtggacgcccgaggaggacctcgtcctcgtctcctacgtccaggagcacggccccggcaactggcgcgccgtccaggccaccacggggctcgcgcggtgcggcaagagctgccgcctgcgctggaccaactacctccgcccgggcatccgccgcggcggcttctccgaccacgaggacaggctcatcgcccacctccaggcgctcctcggcaaccgctgggccgccatcgcctcctacctccccgaccgcaccgacaacgacgtcaagaactactggaacacgcacctcaagaagaagctgctgctcctccaccagcacgcgccccccgccaccccctcgccgccgcccaacaagaacaaggggcagtgggagctcaggctgcagaccgacatcgacctcgccaggcgcgccctgcgcgacgcgctcgccagcccgccggcggggacgaagatgaccagcggcgccactgccc

SEQ ID NO: 40290 - protein, 173 aa, Panicum virgatum
  misc_feature: Ceres CLONE 2002432
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 794 in the 11/435,388 US patent application
  misc_feature: The sequence is a functional homolog of SEQ ID NO 792 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 788 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 790 in the 11/435,388 US patent application
  misc_feature: The sequence is a functional homolog of SEQ ID NO 796 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 743 in the 10/666,642 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 824 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 569 in the 10/374,780 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 271 in the 11/479,226 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1002 in the 11/435,388 US patent application
  misc_feature: Useful for making plants with altered carbohydrate content
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1004 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: Useful for making plants with modulated biomass
  misc_feature: The sequence is a functional homolog of SEQ ID NO 836 in the 10/412,699 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 126 in the 10/412,699 US patent application
  misc_feature: Useful for making plants with altered cell wall content and/or composition
MGRPPCCDKEGVKKGPWTPEEDLVLVSYVQEHGPGNWRAVQATTGLARCGKSCRLRWTNYLRPGIRRGGFSDHEDRLIAHLQALLGNRWAAIASYLPDRTDNDVKNYWNTHLKKKLLLLHQHAPPATPSPPPNKNKGQWELRLQTDIDLARRALRDALASPPAGTKMTSGATA

SEQ ID NO: 40291 - DNA, 674 bp, Panicum virgatum
  misc_feature: Ceres CLONE 2002440
  misc_feature: Encodes the peptide sequence at SEQ ID NO. 40292
aagcacccacaccacgcgcggggagggaaggagagagaagctaggcggagcagcagctgcagcagcggctgcgattaacgccagacagataggtggcagaggaagaaagggggagaggggaggaagggctagctgagaggcgaactcaaggagagggcagctgcagcagcaagtataggtagctagcttgctcggaggcaatgaggtcgtcgttgcggcggagcgtggttgcggcggccgtagtggcgctggcggcggcgtggtgcgcggcggcgcagctgaaccagagctactacgcgtcgacgtgccccaacgtggagaccctggtccgcggcgccgtcacccagaagctgcaggagaccttcaacgccgcgccgggcacgctccgcctcttcttccacgactgcttcgtcaggggctgcgacgcctcggtgctgctgtcgggccccggcgacgagcacagcgccggcgccgacacgacgctgtccccggacgcgctggacctcgtcacccgcgccaaggccgccgtcgacggcgacccgcgctgcgccaacaaggtctcctgcgccgacatcctcgcgctcgccgcccgcgacgtcgtctcgcagacgggcgggccgtactacccggtggagctgggtcggctggacggcaaggtgggcacgcgcgccgtg

SEQ ID NO: 40292 - protein, 157 aa, Panicum virgatum
  misc_feature: Ceres CLONE 2002440
  misc_feature (43)..(157): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MRSSLRRSVVAAAVVALAAAWCAAAQLNQSYYASTCPNVETLVRGAVTQKLQETFNAAPGTLRLFFHDCFVRGCDASVLLSGPGDEHSAGADTTLSPDALDLVTRAKAAVDGDPRCANKVSCADILALAARDVVSQTGGPYYPVELGRLDGKVGTRA

SEQ ID NO: 40293 - DNA, 671 bp, Panicum virgatum
  misc_feature: Ceres CLONE 2002451
  misc_feature: Encodes the peptide sequence at SEQ ID NO. 40294
aaagggggaagagacaagagagcgaggcgaagcgccgcgctgaagcccagtagcagagcagcagcagcagctgaatccagcggggcatggcggccaagggcgccgcgccggcggtggcgctgagcagcggccaccggatgcccgcggtggggctgggcgtctggcggatggagaagcccgccatccgcagcctcgtccactccgcgctccgcatcggctaccgccacctcgactgcgccgctgactaccagaatgaagctgaagttggtgaggcacttgcagaggcattccaaactggacttgtcaagagggaggatctgttcatcacaaccaagctatggaattcagatcacggtcatgtgattgaagcctgtaaggatagcttgaagaagctgcagctagattatcttgatctctatcttgttcacttcccagtagctactagacatactggagttggtacaacttcgagtgctcttggtgatgatggtgtgcttgacattgataccactatctcattagaaacaacatggcatgcgatggaagaacttgtttctatgggactggtccgcagcattgggatcagcaactatgacatcttcctcaccagagactgcttggcctatgctaagataaagcctgcagtgaacccaattgagacgcaccccttc

SEQ ID NO: 40294 - protein, 194 aa, Panicum virgatum
  misc_feature: Ceres CLONE 2002451
  misc_feature (12)..(194): Pfam Name: Aldo_ket_red Pfam Description: Aldo/keto reductase family
  misc_feature: SWISSPROT Homolog: EC 1.1.1.200 Aldose-6-phosphate reductase (NADPH)
MAAKGAAPAVALSSGHRMPAVGLGVWRMEKPAIRSLVHSALRIGYRHLDCAADYQNEAEVGEALAEAFQTGLVKREDLFITTKLWNSDHGHVIEACKDSLKKLQLDYLDLYLVHFPVATRHTGVGTTSSALGDDGVLDIDTTISLETTWHAMEELVSMGLVRSIGISNYDIFLTRDCLAYAKIKPAVNPIETHP

SEQ ID NO: 40295 - DNA, 582 bp, Panicum virgatum
  misc_feature: Ceres CLONE 2002458
  misc_feature: Encodes the peptide sequence at SEQ ID NO. 40296
gccgttcagtgcgccactccttgcgcctcgtctctccctctctcgtggcggcgacgactcggcgaactgcgccgcccttccccacgccttcgccaggcccaatcgccggcgacgagcacccaccagggatcagctgagccttgagcaacgacagtcatcaatcagccatgttgttcttctcctacttcaaggagctcgtggggaaggaggtgacggtggagctgaagaatgacctggccatccgcgggatgctccactcggtcgaccagtacctcaacatcaagctcgagaacactcgcgtcgttgaccaggacaagtatccccacatgttatcagttcgaaactgcttcatcaggggctcagtggtgcggtatgtcctgcttccgcaggatggagtggacatcgacattctccatgatgccacgaggagggaggcacgcggaggctgatcctcaatcctcgtccccaataggatccccgatgatatgtgaaacatgtatggtgcgatagatactggtactgactggctgaactcttatctgttcctcatggtacttgcagtgacaggcattccaaggtttc

SEQ ID NO: 40296 - protein, 93 aa, Panicum virgatum
  misc_feature: Ceres CLONE 2002458
  misc_feature (5)..(72): Pfam Name: LSM Pfam Description: LSM domain
MLFFSYFKELVGKEVTVELKNDLAIRGMLHSVDQYLNIKLENTRVVDQDKYPHMLSVRNCFIRGSVVRYVLLPQDGVDIDILHDATRREARGG

SEQ ID NO: 40297 - DNA, 548 bp, Panicum virgatum
  misc_feature: Ceres CLONE 2002468
  misc_feature: Encodes the peptide sequence at SEQ ID NO. 40298
ctttccccgcatcgaacccaacatgcttatttccaaggagaacagaaaggctgtctactcagctcttttcaaggatggtgcccttgtcgcccctaaggattacaaccttcccaagcacgccgacattgacgtccccaacctcgaagtcattaagctcatgcaatctttgacttccaagggtttcgtcaagacccaattctcctggcaatggtactactataccctcactgacgagggtattgactacctccgtgaattccttcacttgcctcaagaaatcgttcccgctaccttgaagaagtctgctcgtcctgccgctccccgtcgtgctttcggtggtgagggtcgtgaaaaccgtggtccccgtggtgaccgtggtgattaccgtcgcaaggaaggtgctaacggtgacttcaagcccgagttccgtggtggtctcggtcgtggtaaccgcgagtaaattttattttagcattcgacttgatattgctttctcttttgttaaaaaaaatttacattgcagcaaaaacattaaatgttggttttat

SEQ ID NO: 40298 - protein, 145 aa, Panicum virgatum
  misc_feature: Ceres CLONE 2002468
  misc_feature (3)..(98): Pfam Name: S10_plectin Pfam Description: Plectin/S10 domain
  misc_feature: Useful for making plants with modulated nitrogen use efficiency
MLISKENRKAVYSALFKDGALVAPKDYNLPKHADIDVPNLEVIKLMQSLTSKGFVKTQFSWQWYYYTLTDEGIDYLREFLHLPQEIVPATLKKSARPAAPRRAFGGEGRENRGPRGDRGDYRRKEGANGDFKPEFRGGLGRGNRE

SEQ ID NO: 40299 - DNA, 959 bp, Panicum virgatum
  misc_feature: Ceres CLONE 2002472
  misc_feature: Encodes the peptide sequence at SEQ ID NO. 40300
tgattagttgaaaaactgccaccagtcaatgatccctgttattgatattcgctctttatggacagatgacgaagctgccaaaacagaagtagccaataaaatcgtcaaagcagcatcaacatctggcttcttccaaattacaaactgtggaattcctccggaaacattccaaaagcttctttctcactcttatgcgttttttgaggatttaagtgtagaggaaaagaaaaaactgtggaagaggaaatggaatccagataatacaaatacatatcggggactttttcctgctgaggttaatggaaaagaaggttttgatcttgggaatccaaatataaatactcgtctttcatcaagccatctccatgaactcaacgaatggccatccgaagaaactctccctggatggaaggaattcttttgtcattattatgatacattgcttgatattggacgacgacttctgatagcaaccgaacaaggactcaagctgaaagcaggaaccctcgtaaatgcacttaactttgaatcatcagtttcaacactcagactcaactactacccattccacgaaaatccgctcccaatcgaaacaaccccggatggaaccaaattgtcttgtgaaacacataccgacggatctttgtacactttgctatacgctcctgaacctggcttgcaagttgaacacgaaggaaaatggcttgaagttgatcctgcccctgatgccttaattgttaatacaggtgattgtatggtaaaatggacaaatggtgcactaaaatctgcaaatcatcgagttagacttctctctgtccgaagagtctccgttccattcttctttgaaccagacgcagaatgtctcatctcccctgatctgtcatacgctgatttttgtaaccaaaatatgcaaaaattcaaagaatacaaactagacccacaacaatctatcgtccgtt

SEQ ID NO: 40300 - protein, 310 aa, Panicum virgatum
  misc_feature: Ceres CLONE 2002472
  misc_feature (169)..(274): Pfam Name: 2OG-FeII_Oxy Pfam Description: 2OG-Fe(II) oxygenase superfamily
  misc_feature: SWISSPROT Homolog: EC 1.21.3.1 Isopenicillin-N synthase
MIPVIDIRSLWTDDEAAKTEVANKIVKAASTSGFFQITNCGIPPETFQKLLSHSYAFFEDLSVEEKKKLWKRKWNPDNTNTYRGLFPAEVNGKEGFDLGNPNINTRLSSSHLHELNEWPSEETLPGWKEFFCHYYDTLLDIGRRLLIATEQGLKLKAGTLVNALNFESSVSTLRLNYYPFHENPLPIETTPDGTKLSCETHTDGSLYTLLYAPEPGLQVEHEGKWLEVDPAPDALIVNTGDCMVKWTNGALKSANHRVRLLSVRRVSVPFFFEPDAECLISPDLSYADFCNQNMQKFKEYKLDPQQSIVR

SEQ ID NO: 40301 - DNA, 744 bp, Panicum virgatum
  misc_feature: Ceres CLONE 2002478
  misc_feature: Encodes the peptide sequence at SEQ ID NO. 40302
acctcttatggtctgatcctacagagaatgatagcgtcgagggtttgagaccaaatgcacgaggacctggcttagtgacatttgggcctgatcgagtaacagagttctgtaagcgaaacaaattgcaattgatcataagagcccatgagtgtgttatggatgggtttgagcgttttgctcatgggcaattgatcactttgttttcagcaactaattattgtggtactgcgaacaatgctggggccatacttgtggttggcaggggcttagttgttgtaccaaagttaattcatccacttccaccgcctgttaattcacctgagtcctcccctgaacgtggggatgccacatggatgcaggaacttaatattcagcggccacctactccaaccagagggcggccacaagctgccggtgacaggaattctcttgcttacatatgatacatgacacagccaccccaggcttctggatctgttgtttgtaatcagaaatttgttggcagtttcaaggtacatataagaacaatcaaccaaccaacaggacgtcatggatacaactgtgaaaagtttcctgatagtccattgtgatgcatcggtgttaactgtagttgatgtggtaccattgatttgatctcctcattgggaagctacataataacagttcacatcggcaagtggcattaatacattattatgcttcccaacctgattcggtctttctgtactacattgtttgggatag

SEQ ID NO: 40302 - protein, 146 aa, Panicum virgatum
  misc_feature: Ceres CLONE 2002478
  misc_feature: SWISSPROT Homolog: EC 3.1.3.16 Phosphoprotein phosphatase
LLWSDPTENDSVEGLRPNARGPGLVTFGPDRVTEFCKRNKLQLIIRAHECVMDGFERFAHGQLITLFSATNYCGTANNAGAILVVGRGLVVVPKLIHPLPPPVNSPESSPERGDATWMQELNIQRPPTPTRGRPQAAGDRNSLAYI

SEQ ID NO: 40303 - DNA, 735 bp, Panicum virgatum
  misc_feature: Ceres CLONE 2002482
  misc_feature: Encodes the peptide sequence at SEQ ID NO. 40304
aaaaaatgatcgcagctcgcagcagcagcaccaccaccaccaaacagctagagcagcagcaacactagcaaggaagctagagagatcgtcgagatggcgaggaagggcggtgcggcggcggcggcggtcgtggtgctggcggcgctcctggtcctggcggcggcgaggccggccgagggcgccgtgacgtgcgcggaggtggacttgaacctgcgcccctgcgtcgggtacgtgacggggaaggacgcggcgccgcccgccgagtgctgcgccggcgtgcggcggatccgggcgctgccgtcgggcacggcggagcggcggcaggcgtgcgagtgcgtgaagcaggcggcggcgaggttcccggggctcaacgccgatgccatccgcgtcctcccggcgcagtgcggctcgccgctgccgttcccgctcaccctcaacttcgactgcaccacaattccatgagctaatgatgaacaacacatgaagcaaagaggccatcctgaaaatggagagagatctgctagacgggttcactctgaatgaactagttgcttgctagctcttgcaataaggcccttgctttgcaagctagtttctatctaatgcactattgaaataatgtattggtccccccatgcttttgtggtgtggtttcgcatctctccctgcgtggagaggagttgtcattctcgagttgttgttcatcaacactggtgatgatcttcagtttgttgc

SEQ ID NO: 40304 - protein, 122 aa, Panicum virgatum
  misc_feature: Ceres CLONE 2002482
  misc_feature (33)..(118): Pfam Name: Tryp_alpha_amyl Pfam Description: Protease inhibitor/seed storage/LTP family
MARKGGAAAAAVVVLAALLVLAAARPAEGAVTCAEVDLNLRPCVGYVTGKDAAPPAECCAGVRRIRALPSGTAERRQACECVKQAAARFPGLNADAIRVLPAQCGSPLPFPLTLNFDCTTIP

SEQ ID NO: 40305 - DNA, 670 bp, Panicum virgatum
  misc_feature: Ceres CLONE 2002505
  misc_feature: Encodes the peptide sequence at SEQ ID NO. 40306
atcccatgcattagcagagcattcacctgacgaaaccatggagatggagatctcacaccccttgctcttagcctctcttcttctgcccttcacatggctactcttgcgcctgctctcggtttcacctcgcgagcgcagtggtggccatggccggcgcatcccgagcccgccggcgctccccgtctccggccacctccacctcctcaagaagccgctgcaccgcagcctcgccgcgctggccgcccgctacggcgccggcgccggtctcctccacctccggttcggcgccaagccggttgtcctcgtcatctccccggccgtcgccgacgagtgcttcaccgcccacgacgtcgcgctggcgggccgcccggggctcgcgtcgcggcggctcctcaccgacgactgccccgccatcggcatgtgcaactacggcccgctctggcgccagctccgccgcctcgccaccgtgcacgcgctctgtgcgcactgcctggccgccaccgccgccgcgcgcgacgccgaggcgcgcgctatggcggccaggctctggcgcgccgggcccggcggcgcggtcgccatgaaggcgacggcctaccagttcgtggccaacgccatcatggccatggtcgccggacagcgcatgccggaggaacaggtcctccggttcagg

SEQ ID NO: 40306 - protein, 210 aa, Panicum virgatum
  misc_feature: Ceres CLONE 2002505
  misc_feature: SWISSPROT Homolog: EC 1.14.13.89 Isoflavone 2'-hydroxylase
MEMEISHPLLLASLLLPFTWLLLRLLSVSPRERSGGHGRRIPSPPALPVSGHLHLLKKPLHRSLAALAARYGAGAGLLHLRFGAKPVVLVISPAVADECFTAHDVALAGRPGLASRRLLTDDCPAIGMCNYGPLWRQLRRLATVHALCAHCLAATAAARDAEARAMAARLWRAGPGGAVAMKATAYQFVANAIMAMVAGQRMPEEQVLRF

SEQ ID NO: 40307 - DNA, 702 bp, Panicum virgatum
  misc_feature: Ceres CLONE 2002510
  misc_feature: Encodes the peptide sequence at SEQ ID NO. 40308
acagttcacgcacgagacaatcacagctccactagtccactactacgagacgcttcctcgccggccgcgccgctcccaagcccgcacgcttctcttccccctctcctccgatggcgacgctgcagctcaaccacatcgcgcgggagacctccgacgtggcccgcctcgcggccttctacgaggccgtgctggggttcgagcgcgtgccgtccccgacctactcgggcttccaggtcgcctggctccgcctcccgggctcccccgacgtcgcgctccacctcatcgagcgggacccggccgcgggccccgtcgcggtggggcccggcgccgagggcgagccgccgtcgcagctgccccggcgccaccacctggccttctccgtcgccgactacgacgggttcgtgaccgggctcaaggcgcgcgggaccgagctgttcgagaagacgcagcccgacggccgcacgcgccaggttttcttcttcgaccccgacggcaatggcctagaagttactagcgcagctgcaggcagtgataagtaattagagagcatgatgtggtagctacttctgctttagcctgcaatgtaaattgaagatgttaccagaccaagcttcgttgcgataaataaatccgaagcttacaaagcaatgtatatttgcttttatccgaagcttatgaagcaatgtattttttctatgttgc

SEQ ID NO: 40308 - protein, 142 aa, Panicum virgatum
  misc_feature: Ceres CLONE 2002510
  misc_feature (5)..(133): Pfam Name: Glyoxalase Pfam Description: Glyoxalase/Bleomycin resistance protein/Dioxygenase superfamily
  misc_feature: SWISSPROT Homolog: EC 2.5.1.18 Glutathione transferase
  misc_feature: Useful for making plants with modulated nitrogen use efficiency
MATLQLNHIARETSDVARLAAFYEAVLGFERVPSPTYSGFQVAWLRLPGSPDVALHLIERDPAAGPVAVGPGAEGEPPSQLPRRHHLAFSVADYDGFVTGLKARGTELFEKTQPDGRTRQVFFFDPDGNGLEVTSAAAGSDK

SEQ ID NO: 40309 - DNA, 637 bp, Panicum virgatum
  misc_feature: Ceres CLONE 2002519
  misc_feature: Encodes the peptide sequence at SEQ ID NO. 40310
cctgccttccaaattcgactgtgattatgcttatgttcttgggcatgtgtgttatcacatcctagcggctggtctgaatggttacatggccactgtgacaaatctcaagagcccagtaaacaagtggaaatgtggtgctgctcctattacgtctatgatgactgtaaaaagatggtcccgtggtcctgctgccagccaaattggcaagcctgctgtccacatggccagtgtcgacttgaaaggaaaagcatacgaactgttgcgacaaaattcttccagcttcttgatggaagacatctaccgaaaccctgggccacttcagtttgaaggatcgggtgctgagacaaagccgatttcactgtgtgttgaagaccaagactacatgggaagaatcaaacaattgcaggagtacttggaggaggtgaaaagcattgtgaagcctgggtgttcacaggatgtcctcaaagcagcgttaagcgccatggcttctgtgacggagatgctgacaatcatgtcttccccggctttcagtggccaggcaaccatctgaacaccatgcaaagactgtaccgtctgaatgctggtctcgtgtactcggtctcagacatattttggttgtctgtatcatctgtctatc

SEQ ID NO: 40310 - protein, 182 aa, Panicum virgatum
  misc_feature: Ceres CLONE 2002519
  misc_feature: SWISSPROT Homolog: EC 2.7.1.90 Diphosphate--fructose-6-phosphate 1-phosphotransferase
LPSKFDCDYAYVLGHVCYHILAAGLNGYMATVTNLKSPVNKWKCGAAPITSMMTVKRWSRGPAASQIGKPAVHMASVDLKGKAYELLRQNSSSFLMEDIYRNPGPLQFEGSGAETKPISLCVEDQDYMGRIKQLQEYLEEVKSIVKPGCSQDVLKAALSAMASVTEMLTIMSSPAFSGQATI

SEQ ID NO: 40311 - DNA, 1313 bp, Panicum virgatum
  misc_feature: Ceres CLONE 2002520
  misc_feature: Encodes the peptide sequence at SEQ ID NO. 40312
cgaaaaaggcggagaaactgcttgaactggacgcgacccgagtccaaaccacgccgcaccgcaccgccgccgcctctctcgctcccctcgtctcccgactcccgcccgcacgccggcgccgagcgcgcggaggcgagcatgcatcacgaccccaaccccttcgacgagggcagcgccaacgacaaccccttctccaatggaggaggcggaggcggcaagcagcagtatgggttccggccgaccgagcccgtcggcttcgggggcgccggcaggggcgacgccgtcgtcgacgtcccgctagacaacatgggggactccaagggcaaggcgagggagctttcgtcgtgggaatcagatctgaagcggcgagaggcggatatcaagagaagggaggaggcgttgaagaatgctggagtgccgatggaggagaagaactggcctccattcttcccgatcatccaccatgatattgccaatgagataccagccaatgtgcagaggttgcagtatcttgcatttgcaagctggcttgggattgtgctttgcctgtcgtggaatttcattgctgttatagtctgctggatcaaggagggagattcaaaactgtttttccttgcaactatctatgctttgcttggaattcccctgtcatatttgatatggtacaggcccctctatcgtgcaatgaggactaacagtgctttcagtttcggatggtttttcctctgttacctgatacacattggtttttgcataattgctgccattgctccacccattgtatttcatgggaaatcattaaccggtatactggctgcgatcgacaccttctctgagcatatcataattgggatcttctactttgtggggtttgggctgttctgtttggagacgctgctgagcattgcagttcttcagagagtgtacatgtacttcagagggaacaagtgatgccagccatgattgaaaactacatttgtgaaaaaaatgtggtggagaattacttatgcatgctagtagcacctgtttgtgcgacggttttgtgcatacctgccaaatacaccttgagtcttgcgttttagtatgtcagtggtggtgtgcttttttaagctggtatggagtaggatggtagccctgtcattataggttggcttgccgaacggggtgttttatttgttcattagctatgcccatatttcatctagttaatgtagtctcaagtttgccatgttggcgaccgttatgggcttatggcatgcagtactatttattcttgaaacgcagaagagaactgccctatgggctgaattctt

SEQ ID NO: 40312 - protein, 270 aa, Panicum virgatum
  misc_feature: Ceres CLONE 2002520
  misc_feature (96)..(270): Pfam Name: SCAMP Pfam Description: SCAMP family
  misc_feature: Useful for biocontainment applications
MHHDPNPFDEGSANDNPFSNGGGGGGKQQYGFRPTEPVGFGGAGRGDAVVDVPLDNMGDSKGKARELSSWESDLKRREADIKRREEALKNAGVPMEEKNWPPFFPIIHHDIANEIPANVQRLQYLAFASWLGIVLCLSWNFIAVIVCWIKEGDSKLFFLATIYALLGIPLSYLIWYRPLYRAMRTNSAFSFGWFFLCYLIHIGFCIIAAIAPPIVFHGKSLTGILAAIDTFSEHIIIGIFYFVGFGLFCLETLLSIAVLQRVYMYFRGNK

SEQ ID NO: 40313 - DNA, 609 bp, Panicum virgatum
  misc_feature: Ceres CLONE 2002536
  misc_feature: Encodes the peptide sequence at SEQ ID NO. 40314
gttgaaattgatccttatgctgttccaaagagcatgggtatttttaagacaatcatgagcccaaaatctattacatcagtctcggtagcgacaagaatagttgacaatcatgaagcttacaagaaaaggaacttgaaaaagaaggctagtgaagacagatactatacacaaaagaaatttgtttctggagactagttctgcataaggagagtatatttttttgcgaccaaggaaattgatgtggccaccctgtattgatgttattctacagcagagagtggaacagataattggctatagacaggtcatagtgataggttggcagccattcaacggtgatgattggctggtggagctgaattaggggggaaagagaacggtcacattcttctgctatggcccttttaggaaggaacgctcacttgacatgaaaagttcatacatgattcttttttattgttatccctggacctggaggggatatatatatatatatatatatatatatatatatatatatatatatatatatatatatatatatatatatatatatatatatatatatatatatatatatatatatatatatatatatatatatagtat

SEQ ID NO: 40314 - protein, 64 aa, Panicum virgatum
  misc_feature: Ceres CLONE 2002536
  misc_feature: SWISSPROT Homolog: EC 2.7.7.14 Ethanolamine-phosphate cytidylyltransferase
VEIDPYAVPKSMGIFKTIMSPKSITSVSVATRIVDNHEAYKKRNLKKKASEDRYYTQKKFVSGD

SEQ ID NO: 40315 - DNA, 655 bp, Panicum virgatum
  misc_feature: Ceres CLONE 2002548
  misc_feature: Encodes the peptide sequence at SEQ ID NO. 40316
acagcatccaatccaagaaaaagaaagagagcagctattgctatttgctagccgatcgagccgctggcagcaatggcggaggagaagaacgagggcctggtgctgctggacttctgggtgagcccgttcgggcagcgctgccgcatcgcgctggcggaaaagggcatcccctacgagtactcggagcaggagctcctcggcaccaagagcgacctcctcctccgctccaaccccgtccacaagaagatccccgtcctcctccacgacggccgccccgtctgcgagtccctcatcatcctcaactacctcgacgaggccttccggccgggcccggcctcctcctccggcaagctcctcctcccctccgacccatacgcgcgcgcgcgggcccgcttctgggccgcctactccgacaagatctacgagctcggcacgcggctgtggaagctcgggggcgaggcgcgggcgcaagcgcgcgccgagctcctgcaggtgctcaccaacctcgacggcgagctcggggacaagccgttcttcggcggcgaggagttcgggttcgtggacgacgcgctcgtgcccttcgtgccgtggctgcccagctacgagaggtacgggggagttccgcgtggaggaggccgcgccgaggctggcggcg

SEQ ID NO: 40316 - protein, 194 aa, Panicum virgatum
  misc_feature: Ceres CLONE 2002548
  misc_feature (7)..(81): Pfam Name: GST_N Pfam Description: Glutathione S-transferase, N-terminal domain
  misc_feature: SWISSPROT Homolog: EC 4.4.1.5 Lactoylglutathione lyase
MAEEKNEGLVLLDFWVSPFGQRCRIALAEKGIPYEYSEQELLGTKSDLLLRSNPVHKKIPVLLHDGRPVCESLIILNYLDEAFRPGPASSSGKLLLPSDPYARARARFWAAYSDKIYELGTRLWKLGGEARAQARAELLQVLTNLDGELGDKPFFGGEEFGFVDDALVPFVPWLPSYERYGGVPRGGGRAEAGG

SEQ ID NO: 40317 - DNA, 336 bp, Panicum virgatum
  misc_feature: Ceres CLONE 2002555
  misc_feature: Encodes the peptide sequence at SEQ ID NO. 40318
aaaaagtaattgacaagaagctagatgagcgcttacgtcgagttggttgtgctggcaatttggttggttctcggttttattggaacaatcttcactccaggtgaagacaaagcacttggtcgtgttttagtttggacaactgtcatctgtacgtttacatattggttaatcgtgtatcaatctcaaaaaaatccaattcaactcccgatggatgctcgatacacaactgctgaaaactgggacaccgttgttgctgcagcagaaagatgggctcgccgtggtcattaaatttttctctctaatttcaatgaaataaaagaaatccttttttctttc

SEQ ID NO: 40318 - protein, 87 aa, Panicum virgatum
  misc_feature: Ceres CLONE 2002555
  misc_feature (5)..(64): Pfam Name: ATP_synt_H Pfam Description: ATP synthase subunit H
  misc_feature: SWISSPROT Homolog: EC 3.6.3.14 H(+)-transporting two-sector ATPase
MSAYVELVVLAIWLVLGFIGTIFTPGEDKALGRVLVWTTVICTFTYWLIVYQSQKNPIQLPMDARYTTAENWDTVVAAAERWARRGH

SEQ ID NO: 40319 - DNA, 553 bp, Panicum virgatum
  misc_feature: Ceres CLONE 2002564
  misc_feature: Encodes the peptide sequence at SEQ ID NO. 40320
agctagcagtcggttcttcttcgtcaaccttcgatccagccagccagtcgatctcactcacctcacctgcagccagcgaggcagcggcttatcatcaccggcagcccggcagccatgtggacggggaaggcggcggcgcgggcggccgtgctgctcctgctgctcattgtcgtcgcgcaggagtggtcgccggcgccggcggcggaggcgcgcgtgtgccggcggcggagcgcggggttccatgggctctgcgtctccgaccgcaactgcgcgcaggtgtgcctgcaggaggggtggggcggcggcaactgcgacggattcaggcgacagtgcaagtgcgtcaggcagtgctagctagctactatagcctctgccgaacctgtacgtccatgatcgaggtgtgtgtatgtacgtacgtgcgtacgtatactactagcactatgtgtacgtatgtgtggtgtacgtacgtgcccgaaggccgccaaagctgctggctttgatgatgatgatcagaataaaagatggataatatatatagcaaattaaaatcgtt

SEQ ID NO: 40320 - protein, 79 aa, Panicum virgatum
  misc_feature: Ceres CLONE 2002564
  misc_feature (33)..(79): Pfam Name: Gamma-thionin Pfam Description: Gamma-thionin family
MWTGKAAARAAVLLLLLIVVAQEWSPAPAAEARVCRRRSAGFHGLCVSDRNCAQVCLQEGWGGGNCDGFRRQCKCVRQC

SEQ ID NO: 40321 - DNA, 765 bp, Panicum virgatum
  misc_feature: Ceres CLONE 2002569
  misc_feature: Encodes the peptide sequence at SEQ ID NO. 40322
gagccaaccgaaccattcgccccgcccccgatcgatctcttccccccgtagcgattccctcgtagcatccccttacgcgcgcatcgaccatgtcggcctactgcggaaagtacaaggatgagctcatcaaggacgctgcctacattggcacccctggcaagggtatccttgctgctgacgagtccactggcaccattggcaagcgcctttcaagcatcaatgttgagaacattgaggagaaccggcgtgccctccgtgagctcctcttctgcgcccctggtgccctccagtacctcagtggtgtgatcctctttgaggagaccctctaccagaagaccaaggacggcaagcccttcgttgatgttcttaaggagggaggtgtcctccctggcatcaaggtcgacaagggtaccatcgaggtcgctggcaccaacaaggagaccaccacccagggccatgatgaccttgggaagcgctgcgctaagtactatgaggctggtgcccgctttgccaagtggcgtgctgtcctcaatatcggccccaatcagccatcacagcttgccattgacctgaatgctcagggtcttgctcgttacgccatcatctgccaggagaatggtctggtaccaattgttgagcctgagatccttgtcgatggtcaacatgacattgagcgctgcgcttatgtcaccgagatggtccttgctgcctgctacaaggctctgaatgagcaccatgtcctcctcgagggtaccctcctggagc

SEQ ID NO: 40322 - protein, 225 aa, Panicum virgatum
  misc_feature: Ceres CLONE 2002569
  misc_feature (11)..(224): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated phosphate use efficiency
  misc_feature: Useful for making plants with modulated biomass
MSAYCGKYKDELIKDAAYIGTPGKGILAADESTGTIGKRLSSINVENIEENRRALRELLFCAPGALQYLSGVILFEETLYQKTKDGKPFVDVLKEGGVLPGIKVDKGTIEVAGTNKETTTQGHDDLGKRCAKYYEAGARFAKWRAVLNIGPNQPSQLAIDLNAQGLARYAIICQENGLVPIVEPEILVDGQHDIERCAYVTEMVLAACYKALNEHHVLLEGTLLE

SEQ ID NO: 40323 - DNA, 315 bp, Panicum virgatum
  misc_feature: Ceres CLONE 2002571
  misc_feature: Encodes the peptide sequence at SEQ ID NO. 40324
accattacagtacgcactccggctgacgcgccccgcactcacaaagctcaagcctttcgctcgctcgctcgctcgcggctacatctacaatggcgcgattccagctcgcggccctggccatggccatgctcttcgccgcggcggcggcgcacgccccggccgccaccccgacgccggcgcccagggcgtcccccccgccggcgactcctccgccgaccccggcgccggtgtctccgcccgcgcaggcccccgccgctccacccgcgggcccggcgcccgggactgaagcccccgacccacaggctcgctgccgag

SEQ ID NO: 40324 - protein, 75 aa, Panicum virgatum
  misc_feature: Ceres CLONE 2002571
  misc_feature: Useful for making plants with altered carbohydrate content
  misc_feature: Useful for making plants with altered cell wall content and/or composition
MARFQLAALAMAMLFAAAAAHAPAATPTPAPRASPPPATPPPTPAPVSPPAQAPAAPPAGPAPGTEAPDPQARCR

SEQ ID NO: 40325 - DNA, 662 bp, Panicum virgatum
  misc_feature: Ceres CLONE 2002573
  misc_feature: Encodes the peptide sequence at SEQ ID NO. 40326
ctcttctctcaccccggcgtcgctagggttttgagttttgactcctaaaccgcgacgccatgatgcagccgccgccgccggcacagcagcaggtatgggcaatggcgcccccgcccccgccgcagtactaccaggcggggcaccccccaccgccgcccccgcagttctaccaggcggggcctccgccgcccgccatgtgggcgcccgcgccggcaccgtccggaggcgcgggaggggacgaggccaggaccctctggatcggggacttgcagtactggatggacgagaactacctctacagctgcttctcccaggccggcgaggttatttcagtgaagataattcggaacaagcagactgggcaacctgagggttatggttttattgaatttggcaaccatgctttagctgaacaagttctccagaattataatggtcaaatgatgcctaatggcaaccaacctttcaaattgaattgggctacaagtggggctggtgagaaacgtggagatgatggttcagattatactatatttgttggggatctggcctcggatgttacagatttcattctacaagatacattcaagagtcgttatccatcagttaacggcgcataagttgtctttgacagaactaccggccgctcaaaaggctatggt

SEQ ID NO: 40326 - protein, 141 aa, Panicum virgatum
  misc_feature: Ceres CLONE 2002573
  misc_feature (20)..(92): Pfam Name: RRM_1 Pfam Description: RNA recognition motif. (a.k.a. RRM, RBD, or RNP domain)
  misc_feature: The sequence is a functional homolog of SEQ ID NO 536 in the 10/666,642 US patent application
  misc_feature: Useful for making plants with altered terpenoid content
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
MWAPAPAPSGGAGGDEARTLWIGDLQYWMDENYLYSCFSQAGEVISVKIIRNKQTGQPEGYGFIEFGNHALAEQVLQNYNGQMMPNGNQPFKLNWATSGAGEKRGDDGSDYTIFVGDLASDVTDFILQDTFKSRYPSVNGA

SEQ ID NO: 40327 - DNA, 683 bp, Panicum virgatum
  misc_feature: Ceres CLONE 2002591
  misc_feature: Encodes the peptide sequence at SEQ ID NO. 40328
cgtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctcgacgccatcgaagccatgaacggcaaggatctcgacggccgcaacatcaccgtcaaccaggctcagtcccgcggcggcggcggcggcggcggctacggcggcggtcgtcagggtggctacggcggcggcggcggctacggaggcggtggtggctacggcggtggtcgccgtgagggcggctacggcggaggcggtggcggcggtcgccgcgagggtggctacggcagccgcggtgactccggtggtaactggaggaactgatggggtggccctcccgtgctggcagccaagttatcctatatatctattagtgttcgtgtcactgtttgatccgagttacccctgagttttgttcgtgtgttaccgttcgattaggtgttggttcccatgtttaccgttcccgagttgtttccgc

SEQ ID NO: 40328 - protein, 149 aa, Panicum virgatum
  misc_feature: Ceres CLONE 2002591
  misc_feature (10)..(81): Pfam Name: RRM_1 Pfam Description: RNA recognition motif. (a.k.a. RRM, RBD, or RNP domain)
  misc_feature (48)..(141): Pfam Name: GRP Pfam Description: Glycine rich protein family
  misc_feature: SWISSPROT Homolog: EC 5.2.1.8 Peptidylprolyl isomerase
  misc_feature: Useful for making plants with modulated flowering time
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with modulated biomass
MAAADVEYRCFVGGLAWATDNASLQQAFASYGDVLDSKVITDRETGRSRGFGFVTFSSEQSMLDAIEAMNGKDLDGRNITVNQAQSRGGGGGGGYGGGRQGGYGGGGGYGGGGGYGGGRREGGYGGGGGGGRREGGYGSRGDSGGNWRN

SEQ ID NO: 40329 - DNA, 673 bp, Panicum virgatum
  misc_feature: Ceres CLONE 2002595
  misc_feature: Encodes the peptide sequence at SEQ ID NO. 40330
ccaaacccttgcgccggcgcctccacttcgcttcctcaccccatctcctcgcgctcaggtatctacccgtctccatctccgcccgcctccggatccaccgccggtctcgcgcctctgattgttatcttccctcgagcgcttgttgctgatctgcgtcgtgatgttcgaatctcctggcggcagggtccggcgccgaagggaggcaagatgtacaccgcgaggaagaagatccagaaggagaagggcctcgagccctccgagttcgaggactccgtcgctcaggccttctttgacctggagaatagcaaccaggagctcaagagcgacctcaaggacctctacatcaacaatgctatgtaagagcctcgtttcttcatgtacaatatcgcttgttgagatgtcgttgcctgttttgtatggatgtacctttggtgatgatgcttgttgtggctttgcagccagatggacgttgccgggaacaggaaggctgttgtgatccacgtcccataccgcctgcgcaaggccttcaggaagatccacgtcaggcttgtcagggagctggagaagaaattcagtggcaaggatgtagtagttgttgccacaagaaggattgtgaggccgccaaagaagggttcagctgttcagcgacctcgcaccaggactctaactgctg

SEQ ID NO: 40330 - protein, 70 aa, Panicum virgatum
  misc_feature: Ceres CLONE 2002595
  misc_feature: Useful for making plants with modulated biomass
MDVAGNRKAVVIHVPYRLRKAFRKIHVRLVRELEKKFSGKDVVVVATRRIVRPPKKGSAVQRPRTRTLTA

SEQ ID NO: 40331 - DNA, 755 bp, Panicum virgatum
  misc_feature: Ceres CLONE 2002603
  misc_feature: Encodes the peptide sequence at SEQ ID NO. 40332
ggaggaagtgagactgagggagagagaccaagatagaaggaaaggtggaaatggtgtggagagagactacaaacgaaaactagaagatgatcggtatgacccgaactcaagtagagttagagaagagggatacagaggccaccagaacagaggtgatgagagaatgcatgaagagcatggccgtcgcggagctagagatctggatatccatgattccaagaggtcaaggcatgatgatggctcatattacaattcaaggagggatcgtgaagatcgctattctagagatgaacatagagacagaaggcgtcactgaatgcaaaatgtatctacaactccatatcatgtccttcatacgaagtaaaaaagcttcggcatctcctcgaccaatgccagccagttccaggtggacgttctccacgcaaggctcggttgcctagcaggctagcagatctctggctgtggcagcaaaatttggaccgcccagaaagaattcccattgcagcattaagctttgttttctttgtatcgacttttttcagtcacctagcaggctagcagatctctggtttgtgtcagtaaaatatcggccgcctggaaagaactccccattacaacattaagctttgcttagtttgtatcgactttttcactgtgcaaactttactatattatgtaatagggcagcacagagatgtattgcatactccctccgtcccaaaataattgcatatctagagtttaaaatttgtccc

SEQ ID NO: 40332 - protein, 104 aa, Panicum virgatum
  misc_feature: Ceres CLONE 2002603
  misc_feature: SWISSPROT Homolog: EC 2.1.1.56 mRNA (guanine-N(7)-)-methyltransferase
EEVRLRERDQDRRKGGNGVERDYKRKLEDDRYDPNSSRVREEGYRGHQNRGDERMHEEHGRRGARDLDIHDSKRSRHDDGSYYNSRRDREDRYSRDEHRDRRRH

SEQ ID NO: 40333 - DNA, 674 bp, Panicum virgatum
  misc_feature: Ceres CLONE 2002605
  misc_feature: Encodes the peptide sequence at SEQ ID NO. 40334
gttgggctacgcccgcgcaggttcgaaccctgctgtcgaaccctaagcgtggcacggcaggactccaaatccaatccaatccggcacgcatcgccaacccagccaatcccacagggattgaatattcgtagcaagcagcctccggcccccgcccctttttagttcctttgctgctcctcgatttgattgcttgcgttcatcctcgattgattcctccctgaggcgaaggcaggctggtcaccatgggatctaaggcacctttcttcctcttgctcctcttgctgctcgtcgcccgggcacctgcacaagccagggatcctgctgttttaattgatcatcatgcaattgagctcccagatcacagccctgtcgacaaggaacatattcctgcccatctcaagagcagcagcccgatatgctctgcttgtgaaaacttagcgagtggtgctgtcacttatctaagtgagaaacaaacacaagataagatcatggaattacttcatcatgcttgttcgcagtcattctccttggaacagaagtgtgttgaattgatggactcctatgtaactctgctgtttgccaagatttcggagatcaagccagaagagttctgcaaacagtatggcctgtgcagggataccacctttttctctggtgtgggtagtgacagcact

SEQ ID NO: 40334 - protein, 143 aa, Panicum virgatum
  misc_feature: Ceres CLONE 2002605
  misc_feature (56)..(95): Pfam Name: SapB_1 Pfam Description: Saposin-like type B, region 1
  misc_feature (97)..(130): Pfam Name: SapB_2 Pfam Description: Saposin-like type B, region 2
MGSKAPFFLLLLLLLVARAPAQARDPAVLIDHHAIELPDHSPVDKEHIPAHLKSSSPICSACENLASGAVTYLSEKQTQDKIMELLHHACSQSFSLEQKCVELMDSYVTLLFAKISEIKPEEFCKQYGLCRDTTFFSGVGSDS

SEQ ID NO: 40335 - DNA, 702 bp, Panicum virgatum
  misc_feature: Ceres CLONE 2002609
  misc_feature: Encodes the peptide sequence at SEQ ID NO. 40336
gacatctccactccgcgtctatttagccatcagtactgaccagccccggcacacaggaggaggccgcaggctggaagtgaaacggcaagcctctccacagctctccagaaagctctagtccaggctccggccggcgtcgatggcgcccagcaagctcgcagtggccgtcgccatggtggcgactctcctcctgctcagcaacagcaacatcaaggctgctcccggcggcggcggctacccgccggcccctcccgtcgggcctccgccgcaccagatcgtcgaccctgccaaagactgcggcggcgcctgcgacgtgcggtgcggcgagcactcgcgcaagaaccggtgcacccgggcgtgcctcacgtgctgccgcacctgccgctgcgtgccggcgggcacggccggcaaccaggagacctgcggcaagtgctacacgggctggaccacgcacggcaacaggaccaaatgcccgtgagaggcggcgcgcggccggcgactggggggggtggccggcggtggcaccgtgttcggtgttccccggccgagagcagccagagagagaggcgggcgcactactggcccgtcttgtactgtgatccatcggctttagatgtaggctgtgtgcgctctgctgtttctttcttgtgttctttctgatgttgcgggctggttgtttcctggggaaaaaaaaaagaggga

SEQ ID NO: 40336 - protein, 112 aa, Panicum virgatum
  misc_feature: Ceres CLONE 2002609
  misc_feature (4)..(112): Pfam Name: GASA Pfam Description: Gibberellin regulated protein
MAPSKLAVAVAMVATLLLLSNSNIKAAPGGGGYPPAPPVGPPPHQIVDPAKDCGGACDVRCGEHSRKNRCTRACLTCCRTCRCVPAGTAGNQETCGKCYTGWTTHGNRTKCP

SEQ ID NO: 40337 - DNA, 659 bp, Panicum virgatum
  misc_feature: Ceres CLONE 2002640
  misc_feature: Encodes the peptide sequence at SEQ ID NO. 40338
gcaccaggccgccatccaccgccagccaattcgaaaactccgccaaatctctcgcagcagcagagtcttctccctctccgtcgtcggcgatgtctgggcgcggcaagggcggcaaggggctgggcaagggcggcgccaagcgccaccgcaaggtgctccgcgacaacatccagggcatcaccaagccggcgatccggaggctggcgaggaggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggattcggcggctgagcgcgccctctccctcgtatgcagctgctggcggtggtgcttgcttgcttgttcgtttgggttacccgtgctgggcgttccgtttggtgatgtagagatactatcagattcgtatctgtgctgtcttttgttcttagtaggtggatgtgaagtacgggtctagaaattccaactgccagttgtatctcagttccgtttcctttgcaacaatgaaatgttaaccccggtctgctaccaattgccgtggttcttttggca

SEQ ID NO: 40338 - protein, 103 aa, Panicum virgatum; identical to SEQ ID NO: 12044
  misc_feature: Ceres CLONE 2002640
  misc_feature (25)..(94): Pfam Name: Histone Pfam Description: Core histone H2A/H2B/H3/H4

SEQ ID NO: 40339 - DNA, 701 bp, Panicum virgatum
  misc_feature: Ceres CLONE 2002642
  misc_feature: Encodes the peptide sequence at SEQ ID NO. 40340
gagaccacagaccagtagcagcagcgagcgagcgcgcccacgccacgctaccccgccgccgcggccactgcgaggtgcgagctgctgccgccggatcgggggcggaggaggagggaggcagtaccgcggcgtgcggatgcggaagtggggcaagtgggtggccgagatccgggagcccaacaagcggtcgcggatctggctcgggtcctactccaccgctgtggcggcggcgcgggcctacgacaccgcggtcttctacctccgcggccgctccgcgcggctcaacttccccgaccagctcgacggcgccgcggtggccgagcgccccgagggccacaaggacggcggcgcggggctcaccgccgccgccatccgcaagaaggcggccgaggtcggcgcacgcgtcgacgcgctccactgcggcggcgtcgctcacccgcctccgccgctgtcgtcccaccgccgccgcgccaagaaccccgacctcaaccgggagccgaccccggacacctccgacgacgagtgaagcgcgctgattttgtcttctcttcctcctccgcctccatctactagtctctagtccttaggcaacaactactcacccgaggagtagctagctagctagccagccagtagtagcagtaagcaagcaaccagatagcgtggcgccaggccaaacggatgggcgtgggcggatgcaa

SEQ ID NO: 40340 - protein, 174 aa, Panicum virgatum
  misc_feature: Ceres CLONE 2002642
  misc_feature (39)..(90): Pfam Name: AP2 Pfam Description: AP2 domain
  misc_feature: The sequence is a functional homolog of SEQ ID NO 489 in the 10/374,780 US patent application
  misc_feature: The sequence is a functional homolog of SEQ ID NO 682 in the 10/666,642 US patent application
  misc_feature: The sequence is a functional homolog of SEQ ID NO 989 in the 10/412,699 US patent application
  misc_feature: The sequence is a functional homolog of SEQ ID NO 198 in the 11/375,241 US patent application
  misc_feature: The sequence is a functional homolog of SEQ ID NO 806 in the 11/435,388 US patent application
  misc_feature: The sequence is a functional homolog of SEQ ID NO 1350 in the 10/666,642 US patent application
  misc_feature: The sequence is a functional homolog of SEQ ID NO 202 in the 11/375,241 US patent application
  misc_feature: The sequence is a functional homolog of SEQ ID NO 30 in the 10/412,699 US patent application
  misc_feature: The sequence is a functional homolog of SEQ ID NO 420 in the 11/435,388 US patent application
  misc_feature: The sequence is a functional homolog of SEQ ID NO 468 in the 10/225,066 US patent application
  misc_feature: The sequence is a functional homolog of SEQ ID NO 8 in the 10/374,780 US patent application
  misc_feature: Useful for making plants with altered alkaloid content
  misc_feature: The sequence is a functional homolog of SEQ ID NO 1848 in the 10/412,699 US patent application
  misc_feature: The sequence is a functional homolog of SEQ ID NO 204 in the 11/375,241 US patent application
  misc_feature: The sequence is a functional homolog of SEQ ID NO 2090 in the 10/374,780 US patent application
  misc_feature: The sequence is a functional homolog of SEQ ID NO 630 in the 10/225,066 US patent application
  misc_feature: The sequence is a functional homolog of SEQ ID NO 648 in the 11/435,388 US patent application
  misc_feature: The sequence is a functional homolog of SEQ ID NO 810 in the 10/412,699 US patent application
  misc_feature: Useful for making plants with altered lignin content
  misc_feature: Useful for making plants with modulated flowering time
RPQTSSSSERARPRHATPPPRPLRGASCCRRIGGGGGGRQYRGVRMRKWGKWVAEIREPNKRSRIWLGSYSTAVAAARAYDTAVFYLRGRSARLNFPDQLDGAAVAERPEGHKDGGAGLTAAAIRKKAAEVGARVDALHCGGVAHPPPPLSSHRRRAKNPDLNREPTPDTSDDE

SEQ ID NO: 40341 - DNA, 706 bp, Panicum virgatum
  misc_feature: Ceres CLONE 2002645
  misc_feature: Encodes the peptide sequence at SEQ ID NO. 40342
tctcaatccctcaccagtcaccccccccccccctccacttcctcctccccagaccccagcctctgctcgtgccgccgccggccatggcctgcctcaccgacctcgtcaacctcaacctctcggacaccacggagaagatcatcgccgagtacatatggatcggtggatctggcatggatctcaggagcaaggccaggaccctctccggaccggtgaccgatcccagcaagctgcccaagtggaactacgacggctccagcaccggccaggcccccggcgaggacagcgaggtcatcctgtacccgcaggctatcttcaaggacccattcaggaagggcaacaacatccttgtcatgtgcgattgctacattcttgagaggatcaccgagatcgccggagtggtggtgacattcgacccgaagcccatcccgggcgactggaacggtgccggtgcccacacgaactacagcaccaagtccatgaggaacgagggcgggtacgaggtgatcaaggccgcgatcgagaagctgaagctgcggcacaaggagcacatcgccgcctacggcgagggcaacgagcgccggctgaccggcaggcacgagaccgccgacatcaacaccttcagctggggagtggccaaccgtggcgcgtcggtgcgcgtgggccgggagacggagcagaacggcaagggctacttcgaggaccg

SEQ ID NO: 40342 - protein, 207 aa, Panicum virgatum
  misc_feature: Ceres CLONE 2002645
  misc_feature (17)..(97): Pfam Name: Gln-synt_N Pfam Description: Glutamine synthetase, beta-Grasp domain
  misc_feature: SWISSPROT Homolog: EC 6.3.1.2 Glutamate--ammonia ligase
MACLTDLVNLNLSDTTEKIIAEYIWIGGSGMDLRSKARTLSGPVTDPSKLPKWNYDGSSTGQAPGEDSEVILYPQAIFKDPFRKGNNILVMCDCYILERITEIAGVVVTFDPKPIPGDWNGAGAHTNYSTKSMRNEGGYEVIKAAIEKLKLRHKEHIAAYGEGNERRLTGRHETADINTFSWGVANRGASVRVGRETEQNGKGYFED

SEQ ID NO: 40343 - DNA, 1301 bp, Panicum virgatum
  misc_feature: Ceres CLONE 2002657
  misc_feature: Encodes the peptide sequence at SEQ ID NO. 40344
gaggcgaggcaaattcaccggcgaaacaccaacacgtcacctccattgatcagtagacgtcctacggaaacacgctgcgtcccccgccgctcagacagagggagagatcaatcatggtcatggagacaagatctcctctccctgtttcctcccctccttcctcctcgtcctcctccatctccaccgaggaaattcctcaacgcaagagggcgagggccaggacccaggccaagggcgctgacaagcccaagaggccccgcaaagaggcgccccgccagacccagagcaaggacgaccccgccgaccctgctgctcccaatgccgccgccaagaggagctccgtctacaggggagtcaccaggcacaggtggacaggcaggttcgaggcccatctctgggacaagcactgcctcacctccctccagaacaagaagaaaggcaggcaagtctatttgggggcctatgatactgaggaggcagctgctcgtgcatatgaccttgcagctctcaaatactggggtcctgaaacagtcctgaatttcccagcggaggattactcgggcgagatgtctgagatggagggggtgtcgcgggaggagtacctggcctccctccgccgccggagcagcggcttctccagaggggtctccaagtacagaggcgtcgccaggcatcaccacaacgggaggtgggaggcgcggattgggcgagtctttgggaacaagtacctctacttaggaacattcgacactcaagaggaggcagccaaggcctatgatcttgcagccattgaataccgaggtgccaatgctgtaaccaacttcgacattagctgctacctggaccacccgctgttactggcacagctccaacaggagccgcaggtggtgccagcactcaaccaagaacctcaacctgatcagagcgaaactacagtccaagagtctgactcaagcgaagtgaagacacctgatgataatgcagagcctgatgataatgctgagcctgatgctaatgcacaggctgatggcagtgcagagcccctcgcactcaatgacagcatcgatgagagcttatggagcccttgcatggattacgagctggatatcatgtcaatatctaactttggcagctcaatcaacctgagcgagtggttctttgatgcagactttggtagcgacattgggtgtctgttcgatgggtgttctgcagttgatgaaggcagcaaagatggtgtaggtctggcagatttcagcttgtttgaagaaggtgatggtaagcaaaaggatgttatttcagat

SEQ ID NO: 40344 - protein, 395 aa, Panicum virgatum
  misc_feature: Ceres CLONE 2002657
  misc_feature (179)..(231): Pfam Name: AP2 Pfam Description: AP2 domain
  misc_feature (76)..(137): Pfam Name: AP2 Pfam Description: AP2 domain
  misc_feature: Useful for making plants with altered lignin content
  misc_feature: Useful for making plants with modulated drought sensitivity
  misc_feature: The sequence is a functional homolog of SEQ ID NO 320 in US patent 7157621
  misc_feature: The sequence is a functional homolog of SEQ ID NO 1311 in the 10/374,780 US patent application
  misc_feature: The sequence is a functional homolog of SEQ ID NO 1456 in the 10/412,699 US patent application
  misc_feature: The sequence is a functional homolog of SEQ ID NO 104 in the 10/286,264 US patent application
  misc_feature: The sequence is a functional homolog of SEQ ID NO 202 in the 10/374,780 US patent application
  misc_feature: The sequence is a functional homolog of SEQ ID NO 524 in the 11/435,388 US patent application
  misc_feature: The sequence is a functional homolog of SEQ ID NO 574 in the 10/225,066 US patent application
  misc_feature: The sequence is a functional homolog of SEQ ID NO 650 in the 10/412,699 US patent application
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: The sequence is a functional homolog of SEQ ID NO 1313 in the 10/374,780 US patent application
  misc_feature: The sequence is a functional homolog of SEQ ID NO 1458 in the 10/412,699 US patent application
  misc_feature: The sequence is a functional homolog of SEQ ID NO 1900 in the 10/412,699 US patent application
  misc_feature: The sequence is a functional homolog of SEQ ID NO 358 in the 10/666,642 US patent application
  misc_feature: The sequence is a functional homolog of SEQ ID NO 676 in the 11/435,388 US patent application
  misc_feature: The sequence is a functional homolog of SEQ ID NO 1314 in the 10/374,780 US patent application
  misc_feature: The sequence is a functional homolog of SEQ ID NO 1459 in the 10/412,699 US patent application
  misc_feature: The sequence is a functional homolog of SEQ ID NO 1310 in the 10/374,780 US patent application
  misc_feature: The sequence is a functional homolog of SEQ ID NO 1312 in the 10/374,780 US patent application
  misc_feature: The sequence is a functional homolog of SEQ ID NO 1455 in the 10/412,699 US patent application
  misc_feature: The sequence is a functional homolog of SEQ ID NO 1457 in the 10/412,699 US patent application
  misc_feature: The sequence is a functional homolog of SEQ ID NO 1014 in the 10/225,066 US patent application
  misc_feature: The sequence is a functional homolog of SEQ ID NO 2496 in the 10/374,780 US patent application
  misc_feature: Useful for biocontainment applications
  misc_feature: Useful for making plants with modulated biomass
  misc_feature: The sequence is a functional homolog of SEQ ID NO 400 in the 10/374,780 US patent application
  misc_feature: The sequence is a functional homolog of SEQ ID NO 592 in the 10/225,066 US patent application
  misc_feature: The sequence is a functional homolog of SEQ ID NO 346 in the 10/374,780 US patent application
  misc_feature: The sequence is a functional homolog of SEQ ID NO 382 in the 10/225,066 US patent application
  misc_feature: Useful for making plants with altered alkaloid content
MVMETRSPLPVSSPPSSSSSSISTEEIPQRKRARARTQAKGADKPKRPRKEAPRQTQSKDDPADPAAPNAAAKRSSVYRGVTRHRWTGRFEAHLWDKHCLTSLQNKKKGRQVYLGAYDTEEAAARAYDLAALKYWGPETVLNFPAEDYSGEMSEMEGVSREEYLASLRRRSSGFSRGVSKYRGVARHHHNGRWEARIGRVFGNKYLYLGTFDTQEEAAKAYDLAAIEYRGANAVTNFDISCYLDHPLLLAQLQQEPQVVPALNQEPQPDQSETTVQESDSSEVKTPDDNAEPDDNAEPDANAQADGSAEPLALNDSIDESLWSPCMDYELDIMSISNFGSSINLSEWFFDADFGSDIGCLFDGCSAVDEGSKDGVGLADFSLFEEGDGKQKDVIS

SEQ ID NO: 40345 - DNA, 679 bp, Panicum virgatum
  misc_feature: Ceres CLONE 2002682
  misc_feature: Encodes the peptide sequence at SEQ ID NO. 40346
gtcaccaagaataacccacccaaagcatataatttggcggaggagagagacctctcgatctaggcacctgctatggccggaggcgacgacctgaagctgctctgcttgtgggcgagcccgttcgtgctgctggtgaatctcgcgctcagcctccggggcctgagctacgagtacgtcgaggaggacctcggcgacaagagcgagctcctgctccgctcctgccccgtgcacaaggcggtgcccgtgctcatccacggcgggaagcccgtctgcgagtcgtcggtcatcctgcaatacatcgaccaggccttcgccggcgccggcccctccctcctccccgcctacccctacgaccgcaccgtcgctcgcttctggggtgcctacatcaactactagatgctggccgcctggaaccacgcgtcgaggggcaagacggaggacgagagggccgagggaatgaagcagtctctcgccacggtggacaccctggagggagccctgagggatgattgcggcaagggctagcccttcttcagcggcgacagcgccgggtacatcgacatcgtgctcggcggcctgctcggatgggtgcgggcacacatggatctccacggcgtcaactccttgtatcgcgatcgtactcctctcgtggcggcgtgcgcggagcgcttctggtcgc

SEQ ID NO: 40346 - protein, 107 aa, Panicum virgatum
  misc_feature: Ceres CLONE 2002682
  misc_feature (5)..(78): Pfam Name: GST_N Pfam Description: Glutathione S-transferase, N-terminal domain
  misc_feature: SWISSPROT Homolog: EC 4.4.1.5 Lactoylglutathione lyase
  misc_feature: Useful for making plants with modulated biomass
MAGGDDLKLLCLWASPFVLLVNLALSLRGLSYEYVEEDLGDKSELLLRSCPVHKAVPVLIHGGKPVCESSVILQYIDQAFAGAGPSLLPAYPYDRTVARFWGAYINY

SEQ ID NO: 40347 - DNA, 1130 bp, Panicum virgatum
  misc_feature: Ceres CLONE 2002689
  misc_feature: Encodes the peptide sequence at SEQ ID NO. 40348
gtccagacactccacctccacctgacccaaacccaacccgttgccgtccttacccgccgccaccggtcaccgctccgtcccaatggccgcccccgccgccgccgctcgccgcctactgcgtccgtcgtcctccgtctccgtatccaacactagccggctcctctccacggcttcgccgcctcctcaccgcagccccaacactaactcacccgtcgccttcgattggtccgatgacgacgccgacaaccccacgatacctccaccgccgtccccggcaaagaatcccgagctgcctcccccgtacgacccctttagcaagaagcccgccctctctgagccttccgaccccaccaatctacaggagatcttccaccggatgcgcaccgagggcctcaccgactacgccatcaagatgttcgatggattgtccaaggacgggctgacccacgaggcgctcgcgctcttcgcggtcatcaaggacaagggcaccatgcccgacgtcgtcgcacatactgccgtcctcgaggcctacgtcaacgccggccccgctcactggcgcgacgccgtgcgcacctacgaccgcatgctcgcgaacggcgtcaagcccaacgcctacacgcttgccgtgctcgccagggggctcgcggccagcgaccggttctcggaggccgggaggtacctggtagatatgctcgaccgcgggatgcggccgaatgtggcgacgtacctggccgtgttcgaggcgtacgtgaggatggaaaaggtggaggaggggcagctgctgctggagacgatgaagggaaagggcttcatgccagacgaggaggcggtgcgcaggggcacggtgaagcgcgggcatgtgttcaggggtgtcatgaatttactctttggcaagggattgtggtacgtattgcttcctcatgttggaaacgtttcagtcaaagcgtttggtaatgattcttcaagatttcagatgcaatgaaagtatgatgctagccttttgttaccttgcgaatagtgtcttgagttttttatttaattgcaatgcatattgtgcactgtggagcttgttctaatcaatcatcagaatgtcgtgagacaagatctaaatgatgaatggaaaaatttgc

SEQ ID NO: 40348 - protein, 201 aa, Panicum virgatum
  misc_feature: Ceres CLONE 2002689
  misc_feature (115)..(149): Pfam Name: PPR Pfam Description: PPR repeat
MRTEGLTDYAIKMFDGLSKDGLTHEALALFAVIKDKGTMPDVVAHTAVLEAYVNAGPAHWRDAVRTYDRMLANGVKPNAYTLAVLARGLAASDRFSEAGRYLVDMLDRGMRPNVATYLAVFEAYVRMEKVEEGQLLLETMKGKGFMPDEEAVRRGTVKRGHVFRGVMNLLFGKGLWYVLLPHVGNVSVKAFGNDSSRFQMQ

SEQ ID NO: 40349 - DNA, 692 bp, Panicum virgatum
  misc_feature: Ceres CLONE 2002693
  misc_feature: Encodes the peptide sequence at SEQ ID NO. 40350
taaccggccacgtactagctagacaacacaagcatcgtcatcaatggcggcgtcccgtgctgcctcttcggtgtcggtggtcctcttcctcgtcctcgccgccttcgctgccggcgccagcgcggccaccttcaacataaagaataactgcggctacacggtgtggccggcgggcatcccggtgggcggtggcacgcagctggacccaggccagacgtggaccgtcgacgtgcccgccggcacgagcggcaggttctggggccgcaccggctgctccttcaacggcgggagcggccactgcgacagcgccgactgcgccggcgcgctgtcctgcacggtctccgggcagacgccggcgacgctggccgagtacaccatcggcggcgcccaggacttctacgacatctcgctggtcgacggcttcaaccaggccatggacttctcgtgcagcaccggcgtgaacctgcactgcggtggcgctggatgccccgacgcctacctcttcccgaacgatgacaccaagacccatgcctgcagcgccaacagcaactaccaggtcaccttctgcccgtgatgagcgaggcggcagctggtcgtcgatcgaacgatgaataatgcacgataaataatcaatatgtgtactactatagtggagtgatgatgaataaggcgatcgatgtcgtgaaaagtcg

SEQ ID NO: 40350 - protein, 176 aa, Panicum virgatum
  misc_feature: Ceres CLONE 2002693
  misc_feature (34)..(176): Pfam Name: Thaumatin Pfam Description: Thaumatin family
MAASRAASSVSVVLFLVLAAFAAGASAATFNIKNNCGYTVWPAGIPVGGGTQLDPGQTWTVDVPAGTSGRFWGRTGCSFNGGSGHCDSADCAGALSCTVSGQTPATLAEYTIGGAQDFYDISLVDGFNQAMDFSCSTGVNLHCGGAGCPDAYLFPNDDTKTHACSANSNYQVTFCP

SEQ ID NO: 40351 - DNA, 730 bp, Panicum virgatum
  misc_feature: Ceres CLONE 2002721
  misc_feature: Encodes the peptide sequence at SEQ ID NO. 40352
gcggttcctcctgtgagggctagaggaagggaagaacggccacgggatggacatgaaccaggagctggaagaggtggtcccaaatgactcggaccctcttctcgggagggagaacaaggaggcagagtcatcatcagtggagctgtctgcaccacaaccagcaaccgtgaccccgctggagatcgaggatgaggagaccgatggttcttctgctgcatgctgccgcatttgcctcgaggccgagtctgagataggtgatgaactgatatcaccttgcatgtgcaaaggaactcaacagtttgttcaccgttcatgccttgatcactggcgttctgttaaggtaggatttgcattttcccactgcacaacatgcaaagctcagtttcatctcagggtggagacttgggaggacaattcatggcgtaaaatgaagttccggatctttgttacaagagacgtgctcctcgtatttcttgccgtacagcttactattgctattattggtgcaatcgcatactttctagacagggatggaagtttcaggaacagtttcagtgatggttgggatcgcttcttgtcaaagcacccaataccattctactattgcataggtgttgttgttttctttgtgctgcttggattctttgggttgatagtgcactgctcatccttcacgaccaccaggatccacgcctagctgggtgccggaactgctgctacgggtggggca

SEQ ID NO: 40352 - protein, 216 aa, Panicum virgatum
  misc_feature: Ceres CLONE 2002721
  misc_feature (59)..(109): Pfam Name: zf-C3HC4 Pfam Description: Zinc finger, C3HC4 type (RING finger)
MDMNQELEEVVPNDSDPLLGRENKEAESSSVELSAPQPATVTPLEIEDEETDGSSAACCRICLEAESEIGDELISPCMCKGTQQFVHRSCLDHWRSVKVGFAFSHCTTCKAQFHLRVETWEDNSWRKMKFRIFVTRDVLLVFLAVQLTIAIIGAIAYFLDRDGSFRNSFSDGWDRFLSKHPIPFYYCIGVVVFFVLLGFFGLIVHCSSFTTTRIHA

SEQ ID NO: 40353 - DNA, 692 bp, Panicum virgatum
  misc_feature: Ceres CLONE 2002756
  misc_feature: Encodes the peptide sequence at SEQ ID NO. 40354
atctttcatcgtcttcccccattcctctcctccggccccccgcccccctcgcctcctccggccgccggcagtagccttcggggactagaaagaaagaaattggccccttgatgggttgatttgggccttggatcgatcgattattggattgaaatcgatcggggatgggcgaggaggcggcggacgactacgacctggacctggacctgctgggcggcgccgatgacgagcgggtgatggagtgggagactggcctccccggcggcgaggagctgaccccgctttcgcagccgctggtcccgccggggctggccgccgccttccgcatcccgccggagcccgggcggacgctgcttgacgtgcaccgcgcgtcggcggccacggtgtcgcggctgcggcgcgcgtcgtcggggtcgtcgttccagcccttcgtaggaggaggtggaggtggaggagaaggagcagcggtggcagcagcagacgcaatcaacaactcgtcgaagcggccccggctggtgtggacgccgcagctgcacaagcggttcgtggacgtggtggcgcacctggggatcaagaatgcggtgcccaagacgatcatgcagctgatgaacgtggaagggctgacgcgggagaacgtggcgagccacctgcagaagtaccggctgtacgtgaagcggatgcaggggctctcc

SEQ ID NO: 40354 - protein, 175 aa, Panicum virgatum
  misc_feature: Ceres CLONE 2002756
  misc_feature (116)..(166): Pfam Name: Myb_DNA-binding Pfam Description: Myb-like DNA-binding domain
  misc_feature: The sequence is a functional homolog of SEQ ID NO 1992 in the 11/479,226 US patent application
  misc_feature: The sequence is a functional homolog of SEQ ID NO 1232 in the 10/666,642 US patent application
  misc_feature: The sequence is a functional homolog of SEQ ID NO 1089 in the 11/479,226 US patent application
  misc_feature: The sequence is a functional homolog of SEQ ID NO 1233 in the 10/666,642 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
MGEEAADDYDLDLDLLGGADDERVMEWETGLPGGEELTPLSQPLVPPGLAAAFRIPPEPGRTLLDVHRASAATVSRLRRASSGSSFQPFVGGGGGGGEGAAVAAADAINNSSKRPRLVWTPQLHKRFVDVVAHLGIKNAVPKTIMQLMNVEGLTRENVASHLQKYRLYVKRMQGL

SEQ ID NO: 40355 - DNA, 704 bp, Panicum virgatum
  misc_feature: Ceres CLONE 2002770
  misc_feature: Encodes the peptide sequence at SEQ ID NO. 40356
aaggcgccgagctactcatcagcatcattcagttgggtgtcgttgagcgtgcacttgtacttgagcttggcagttgattcccatggggagatctccttgctgcgacgagagtggcctcaagaagggcccgtggacgccggaggaagacgagaggctgctgcagtacatccagaagaacggccatggcagctggaggaccctcccaagactcgccgggctgaacagatgcggcaagagctgccggctgcggtggaccaactacctgcggccggacatcaagcgcggcaagttctcgcaggaggaggagcagaccatcctgcacctccactccgtcctcggcaacaagtggtcggcgatcgcgacgcacctgccgggccggacggacaacgagatcaagaacttctggaacacgcacctcaagaagcggctcatccagatgggcttcgaccccatgacgcaccgcccgcggaccgacttcttcgccgcgctgccgcagctcatcgcgctcgccgcgctccgcgaccagctcgccgcggacccggcggcgagcgcgcacctgcaggccggcggcggctccgctgccggcggcgtcgacgtggccatccaggccgccaagctccagtacctgcagtgcctcctccagtccgcggccaccaccatcgacggcatcgcctccccggccgccgcgggttccacggccgacg

SEQ ID NO: 40356 - protein, 207 aa, Panicum virgatum
  misc_feature: Ceres CLONE 2002770
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1010 in the 11/435,388 US patent application
  misc_feature: The sequence is a functional homolog of SEQ ID NO 1073 in the 10/374,780 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 126 in the 10/412,699 US patent application
  misc_feature: Useful for making plants with modulated nitrogen use efficiency
  misc_feature: Useful for making plants with altered cell wall content and/or composition
MGRSPCCDESGLKKGPWTPEEDERLLQYIQKNGHGSWRTLPRLAGLNRCGKSCRLRWTNYLRPDIKRGKFSQEEEQTILHLHSVLGNKWSAIATHLPGRTDNEIKNFWNTHLKKRLIQMGFDPMTHRPRTDFFAALPQLIALAALRDQLAADPAASAHLQAGGGSAAGGVDVAIQAAKLQYLQCLLQSAATTIDGIASPAAAGSTAD

SEQ ID NO: 40357 - DNA, 1011 bp, Panicum virgatum
  misc_feature: Ceres CLONE 2002772
  misc_feature: Encodes the peptide sequence at SEQ ID NO. 40358
accgaggttctgtaacttcactatttcaaccaattctcgcccaccaaaacagctcaagtttttgttcctcaagcatcttgcgcaatttacctcacgctaccgtttcatagtttttgctacagctccgcatcacagccatgtcttctcctcaggaccgcgtccagaaccttgttgctcaggttgataaagagctctccaagtaccccgtgctcaacaatctcgagaagcagacctcgatccccaaggcctatggcgtgcttggcttgggcgcactttatctcttcctgatcatcttcaacctcggcggccagcttctgaccaacattgcgggcttcgttatccccggatacttttcccttgctgctctcttcactacgagcaaggcggacgatactcaatggcttacctactgggttgtgtttgcgttcttcactgttcttgagagcctcgtcagcgttgtctactggttccctttctactacactttcaagtttgtctttctcctgtggctgtcccttcccgccttcaggggtgccgagatcatcttccgctcgttcctggctcctgctctgggacgttacttccacgctcccggctccaccgccagcggcctccgcgcgaaggccgactccctccacactgagtaaatggtgctcaggtccttgacactggacccatccgtcaaaatacagagcgcgtagctctgaatgtggtccagccaggatcgtggattggtgggattccacgtgaaacacgggtttcttttctgacgttgggacatcgatccagatgttcatgagcacgcagtcggacaacggcagaaacggggtctatttgaacaagttggcaggcctgcctgctggtattttctttgggaaacggtcaatgaaagggtcaataggggtgtatacgggtgcgggattcctttggatctgggatagccggtgattgattggttgctttagaatatgtaggcgtggatttgtatgtgatgatatttgtacggcgatc

SEQ ID NO: 40358 - protein, 169 aa, Panicum virgatum
  misc_feature: Ceres CLONE 2002772
  misc_feature (42)..(145): Pfam Name: TB2_DP1_HVA22 Pfam Description: TB2/DP1, HVA22 family
MSSPQDRVQNLVAQVDKELSKYPVLNNLEKQTSIPKAYGVLGLGALYLFLIIFNLGGQLLTNIAGFVIPGYFSLAALFTTSKADDTQWLTYWVVFAFFTVLESLVSVVYWFPFYYTFKFVFLLWLSLPAFRGAEIIFRSFLAPALGRYFHAPGSTASGLRAKADSLHTE

SEQ ID NO: 40359 - DNA, 682 bp, Panicum virgatum
  misc_feature: Ceres CLONE 2002775
  misc_feature: Encodes the peptide sequence at SEQ ID NO. 40360
tcgccattgcagagttgcagttgcagagcgggagggagcgaagatgatgacgtcgtggctgttgggccgccggggcccctcgggcttctcctggagctccaccgccgaccaggtcaccgagggcatctccgccgccggcctcaccgccgtcgtcaccggggcgtccagcggcatcggcgccgagacggcgcggacgctggcgctgcgcggggcgcacgtcgttatggctgtcaggggcgtccccgccgcgcaggccgtcagggaccgcgtcctcgccgaggcgcccggggccaggctcgacgtcatggagctcgacctctcgtccatggcctccgtccgcgccttcgcctcccagttcgtcgccagggggctccccctcaacatcctcatcaacaatgcaggagtaatggcaacaccttttgagctttcaaaggatggaattgagatgcagtttgcaactaaccatgttggccattttctgttgacacaacttctgttggataccatgaagaagacctctcgtgaatcaaatgtggaaggaagaattgtcaatgtttcatcagaggggcaccgatttgcataccgggaaggcatccgttttgataagattaatgatgaatcagtgtatagcaccattggagcatatgggcagtcaaagcttgcaaacatcttgcacgctaaa

SEQ ID NO: 40360 - protein, 212 aa, Panicum virgatum
  misc_feature: Ceres CLONE 2002775
  misc_feature (33)..(181): Pfam Name: adh_short Pfam Description: short chain dehydrogenase
  misc_feature: SWISSPROT Homolog: EC 1.3.1.33 Protochlorophyllide reductase
MMTSWLLGRRGPSGFSWSSTADQVTEGISAAGLTAVVTGASSGIGAETARTLALRGAHVVMAVRGVPAAQAVRDRVLAEAPGARLDVMELDLSSMASVRAFASQFVARGLPLNILINNAGVMATPFELSKDGIEMQFATNHVGHFLLTQLLLDTMKKTSRESNVEGRIVNVSSEGHRFAYREGIRFDKINDESVYSTIGAYGQSKLANILHA

SEQ ID NO: 40361 - DNA, 711 bp, Panicum virgatum
  misc_feature: Ceres CLONE 2002778
  misc_feature: Encodes the peptide sequence at SEQ ID NO. 40362
ctgctaactagctatgcggagccatccctccgcagctagcttcttagagggactatggccgtttaggccacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatcgcggcgacggaggcggttcgccgcccccgacgtcgcgagaagtccattgaaccttatcatttagaggaaggagaagtcgtaacaaggtttccgtaggaacctgcggaaggatcattgctctttcctcgcagtacttttgggcggtattgcaacggagtgccaaaatgcctccaaagttcgaccccaatgagattgcggaggtgtttgtgcgcgtgaccggtggtgaggttggtgctgcctcctccctggcacccaagattggtcctctgggtctgtcccccaagaaggttggtgaggatattgccaaggagaccgccaaggactggaagggacttcgtatcaccgtcaagctgaccgtccag

SEQ ID NO: 40362 - protein, 65 aa, Panicum virgatum
  misc_feature: Ceres CLONE 2002778
  misc_feature (12)..(65): Pfam Name: Ribosomal_L11_N Pfam Description: Ribosomal protein L11, N-terminal domain
MPPKFDPNEIAEVFVRVTGGEVGAASSLAPKIGPLGLSPKKVGEDIAKETAKDWKGLRITVKLTV

SEQ ID NO: 40363 - DNA, 485 bp, Panicum virgatum
  misc_feature: Ceres CLONE 2002787
  misc_feature: Encodes the peptide sequence at SEQ ID NO. 40364
aaactccgtttcgaattctagggttttgctgctctcccgtgctctgagcggcgcatccccccgttaagtgcgattcctcgagtacaatcctgatggcgctccccaaccaagggactgtacattacccccgcttcaagctcgtcatccttggatatggcggaacggataaaaccacatttctgaacaggcctctcactggacagtctgataataaatatcaaccacccattggtgtgcaacttcatccgctggatttccctactaagtgcgctaacatccgtttctactgctgggatacagctaggaaagaaaagtttggtgacctcaaggatggatactatatccctgaccattgtgctatcattatgtttgatattacctcggcgctgacttaccagaatgttcctacatcgcatatgcacctgtacacggtgtgaaaaaacatccccataatgctgtgtaccatcaatgctgatgtgaagaac

SEQ ID NO: 40364 - protein, 114 aa, Panicum virgatum
  misc_feature: Ceres CLONE 2002787
  misc_feature (15)..(113): Pfam Name: Ras Pfam Description: Ras family
MALPNQGTVHYPRFKLVILGYGGTDKTTFLNRPLTGQSDNKYQPPIGVQLHPLDFPTKCANIRFYCWDTARKEKFGDLKDGYYIPDHCAIIMFDITSALTYQNVPTSHMHLYTV

SEQ ID NO: 40365 - DNA, 867 bp, Panicum virgatum
  misc_feature: Ceres CLONE 2002793
  misc_feature: Encodes the peptide sequence at SEQ ID NO. 40366
ctcctcccggcccaagcaagcgcgcgcgcactcgcacacagagagacagtgaggagggaggaggaaggccgggcagccggaggtctagagagatcgatcatagcacgcagatggcccggttcgtggacccgctggtggtggggcgggtgatcggcgaggtggtggacctgttcgtgccctccgtcaacatgaccgtcgcgtacggacccaaggacatcagcaacggctgcctcctcaagccctccgccaccgccgcgccgccgctcgtccgcatctccggccgccgcaacgacctctacacgctgatcatgacggacccggatgcgccgagccccagcgaccccaccatgagggagtatctccactggatagtggctaacataccagggggaacagatgcatcaaaaggggatgtggtggtggactacatgggcccgcggccgccggtggggatccaccgctacgtgctggtgctgttcgagcagaagacgcgcgcgcgcgcgggggcgccggcggaacgcgccaacttcaacacgcgcgccttcgcggcggcgcacgagctcggcctccccaccgccgtcgtctacttcaacgcccagaaggagcccgccaaacgccgccgctagtagctactacctccacactcacggctgctgcgtgagtgcgtgcgtgcgccgccggccgccggcggttatattataattaccgccggtgaataagagcttttactatactgccccgttaagtaccttattaattaccgtatactcgtattttttctgtgttttccgtatacgtatatggtctatgtacttgtgctcttgcatgtatatgtagcatgcgtcttgcatggactgtggcttttgg

SEQ ID NO: 40366 - protein, 171 aa, Panicum virgatum
  misc_feature: Ceres CLONE 2002793
  misc_feature (19)..(163): Pfam Name: PBP Pfam Description: Phosphatidylethanolamine-binding protein
  misc_feature: The sequence is a functional homolog of SEQ ID NO 2 in US patent 7196246
  misc_feature: The sequence is a functional homolog of SEQ ID NO 2 in US patent 7208653
  misc_feature: Useful for making plants with modulated flowering time
MARFVDPLVVGRVIGEVVDLFVPSVNMTVAYGPKDISNGCLLKPSATAAPPLVRISGRRNDLYTLIMTDPDAPSPSDPTMREYLHWIVANIPGGTDASKGDVVVDYMGPRPPVGIHRYVLVLFEQKTRARAGAPAERANFNTRAFAAAHELGLPTAVVYFNAQKEPAKRRR

SEQ ID NO: 40367 - DNA, 716 bp, Panicum virgatum
  misc_feature: Ceres CLONE 2002813
  misc_feature: Encodes the peptide sequence at SEQ ID NO. 40368
accagcacttgcttgtcattcccaagcaaacgcattcatccagcaccggccgcactcagctcgtcaagctaagttcacattcacgcacaatccaagcaatggctcgcgctcatcaggtggtggctatcgccgtcgttgccgccgtcgtgctgctcgccgccgcggcgacgaccaccgaggccgccgtgacctgcgggcaggtgagctcggccatcggcccctgcatcgcctacgcccgcggcaccggctccggcccctcggcagcctgctgcagcggcgtgaggagcctcaactcggcggccaggagcaccgccgacaggcgcgccgcatgcaactgcctcaagtccgccgccggcagggtgagtggcctcaaacttggaaacgccgcaagcatcccgtccaagtgcggagtcagcatcccctacaccatcagcccaagcgtcgactgctccaggtaatttattaatcccttaattatatatatattatatattaattatacacatgataatatatatgactaatcaatgcaatgcaaaaaaaaactaatcaaaattatatatatatatatatattcttgctgcagggtgagctaaacgacgaccagtacctaccgtcgctacctatctacttaattatcgtctatgatcgagttcgatgatgatgaataaaaatctctccggcgtcgcgtgcactgtcgtcatgcgctagctcag

SEQ ID NO: 40368 - protein, 119 aa, Panicum virgatum
  misc_feature: Ceres CLONE 2002813
  misc_feature (32)..(117): Pfam Name: Tryp_alpha_amyl Pfam Description: Protease inhibitor/seed storage/LTP family
MARAHQVVAIAVVAAVVLLAAAATTTEAAVTCGQVSSAIGPCIAYARGTGSGPSAACCSGVRSLNSAARSTADRRAACNCLKSAAGRVSGLKLGNAASIPSKCGVSIPYTISPSVDCSR

SEQ ID NO: 40369 - DNA, 976 bp, Panicum virgatum
  misc_feature: Ceres CLONE 2002821
  misc_feature: Encodes the peptide sequence at SEQ ID NO. 40370
tctctttctctccctctcgcatcgcgtgaaccgcaccccatcttaatacgtcactcaaatacaagatgagtcaggttccgcgcccccttcacgcccaagaggctgatgttcagaagatgttggccgccgaggtccacatcggttccaacaacctcgaccccaagatggagcgctacgtctggaggcgccgccaggatggtgtccacctgatcgatctcggcaagacctgggacaagctcgtccttgccgcccgcgtcatcgccggcattgagcacgcctccgatgtggtcgtcatctccggccgtacctatggtcagagggccgtacacaagttcgccaacttcactggtgccaccgccatcgctggtcgcttcacccccggtaccttcaccaatcagcagcagcagagggacttcaaggagcctcgtctcatcatcgtcgctgacccccgcgtcgaccaccagtcgctcactgagtcgtcgtatgtcaacatcccgaccattgccttcgccaacaccgactcgcccctccgtcacgttgacattgccatcccctgcaacaacggctcgaagcacgccatcggtcttatgttctaccttcttgctcgtgaggtcctctaccttaagggtaccctcaaccgtcacgacggctgggacgtgatgcccgatctcttcttctaccgtgatcccgaggagaccgagaaggaagagaccgtcgaggccaccaccgccttcgatgaggcctacaagcccggttacgacgccaccgccggtgagcagtggtcgctcgagggtgaggagggtgctggtttcactcagcccaccaccgaggagtggggcgctgatgccgaggccacctccgcggctcccgctgccactgagggtgcccccgccacctgggacgtgtaagttcttctgggctgatgatgctctgtccggccttcgatcaaaacatataaacaaaccaatcccccgtc

SEQ ID NO: 40370 - protein, 263 aa, Panicum virgatum
  misc_feature: Ceres CLONE 2002821
  misc_feature (1)..(170): Pfam Name: Ribosomal_S2 Pfam Description: Ribosomal protein S2
MLAAEVHIGSNNLDPKMERYVWRRRQDGVHLIDLGKTWDKLVLAARVIAGIEHASDVVVISGRTYGQRAVHKFANFTGATAIAGRFTPGTFTNQQQQRDFKEPRLIIVADPRVDHQSLTESSYVNIPTIAFANTDSPLRHVDIAIPCNNGSKHAIGLMFYLLAREVLYLKGTLNRHDGWDVMPDLFFYRDPEETEKEETVEATTAFDEAYKPGYDATAGEQWSLEGEEGAGFTQPTTEEWGADAEATSAAPAATEGAPATWDV

SEQ ID NO: 40371 - DNA, 676 bp, Panicum virgatum
  misc_feature: Ceres CLONE 2002826
  misc_feature: Encodes the peptide sequence at SEQ ID NO. 40372
ccgatataactagcagtagctccgagcatcttgcaccaccttgcagcccatggccgccgccgctcccgtatccgttccccgcatcaagctgggctcccaggggctggaggtctcggcgcagagcctcggctgcatgagcatgtccgccttctacggcccgcccaagcccgagcccgacatgatcaagctcatccaccacgccgttgccactggagtcaccttgctcgacacctccgacatgtacggcccgcacaccaacgagatcctcctcagcaaggcattgcagggcggggtgcgggagaaggtggagctggccactaagttcggcatcgattatttccccggcggcttagccgccggaaatgtcgacatccgcggggacccggcgtacgtgcgcgcggcgtgcgagggcagcctcaagcggctcggcgtagactgcatcgacctctactaccagcaccgcatcgacaagagggtgcccatcgaggtcacgatgggtgaactcaagaagctagttgaagaaggaaagataaagtacattggattatctgaagcttcggcatcgacgattagaagagctcatgcagtccatcctattactgcagttcaactggaatggtcattatggtgtagagatgtagaagaagatataattcccacttgcagggaacttgga

SEQ ID NO: 40372 - protein, 208 aa, Panicum virgatum
  misc_feature: Ceres CLONE 2002826
  misc_feature (15)..(208): Pfam Name: Aldo_ket_red Pfam Description: Aldo/keto reductase family
  misc_feature: SWISSPROT Homolog: EC 1.1.1.65 Pyridoxine 4-dehydrogenase
MAAAAPVSVPRIKLGSQGLEVSAQSLGCMSMSAFYGPPKPEPDMIKLIHHAVATGVTLLDTSDMYGPHTNEILLSKALQGGVREKVELATKFGIDYFPGGLAAGNVDIRGDPAYVRAACEGSLKRLGVDCIDLYYQHRIDKRVPIEVTMGELKKLVEEGKIKYIGLSEASASTIRRAHAVHPITAVQLEWSLWCRDVEEDIIPTCREL

SEQ ID NO: 40373 - DNA, 1444 bp, Panicum virgatum
  misc_feature: Ceres CLONE 2002839
  misc_feature: Encodes the peptide sequence at SEQ ID NO. 40374
attcgttggtctggtcgtctccccaccaacccacggcctcgccgccagcagaaaacagagagggaggagaggaggacccacatggacatggctatggctgcgcgcttgggccccctcgtcctcccgcacgcggcgctcctcggctcctccgccgctgcctccgcccgagctctgcctctcaccccgtcccgcgctcctcgcctcccttatcctcttcctcatttccccacctgccgccgcccctcctcctcctccgccgccgccgcctacgcggcgcgccccctcccccgccgcgggtcgccgcgtctcctggctgtccgcgccatggcgtccgggaacccctacgccgccgagctcgccgcggccaagaaggccgtcaccctcgccgcacgcctctgccaggcagtgcaacaggacattgtgcattcaggcattcagtctaaggcggacaaaagccctgtcacagtggccgattatggatctcaaatattggtcagccttgtcttgaagatggaagtatcatctggcccgttttcattggtggctgaggaggaaggtatcctctcagcgattgatgatggaaagtccaagggaggcccaactgggagacattgggtcctagatccaatcgatggtactaaaggtttcgtaaggggtgaccaatatgcaatcgcactggccctgcttgatgaaggtaaagttgttctgggtgtattggcttgtccaaatcttcctttgtcatcaataagcaatccgaatggtagctcttcgggcggtcaagttggtgcccttttttctgctacaattggttgtggggctgaagtagagtctctagatggttctccgccacagaagattagtgtttgttccattgacaatccagtcaacgcctcattctttgaatcctatgaaagtgcacactccatgcatgatctgactggctctattgcagagaaacttggtgtcctagctcctccagttagaattgacagccaagcaaaatatggtgctatggcccgaggcgatggtgccatttacttgcgttttccacacaaaggttacaaagagaagatatgggaccatgcggctggctcaattgtcgtgactgaagctggaggtatagtaacagatgctgctgggaatgacttggatttctccaaagggagatttcttgatctcgacacaggcatcatcgcaacgaacaagcagttgatgccgtcactcctgaaggccgtccaagatgctattaaggagaagaaccaggccgcctccctcttgtaggctgtagcagtcagtgatcaacaaaaaatgttagttgcaataatgtttcatattcataccgtgtcttacatgtgcctggccttttgttgtgacattacaatttcatgttgtaccacttgtgatgaggctctttcctcttggcaatcagataatcgttcttttt

SEQ ID NO: 40374 - protein, 318 aa, Panicum virgatum
  misc_feature: Ceres CLONE 2002839
  misc_feature (3)..(309): Pfam Name: Inositol_P Pfam Description: Inositol monophosphatase family
  misc_feature: SWISSPROT Homolog: EC 3.1.3.7 3'(2'),5'-bisphosphate nucleotidase
  misc_feature: Useful for making plants with modulated drought sensitivity
MASGNPYAAELAAAKKAVTLAARLCQAVQQDIVHSGIQSKADKSPVTVADYGSQILVSLVLKMEVSSGPFSLVAEEEGILSAIDDGKSKGGPTGRHWVLDPIDGTKGFVRGDQYAIALALLDEGKVVLGVLACPNLPLSSISNPNGSSSGGQVGALFSATIGCGAEVESLDGSPPQKISVCSIDNPVNASFFESYESAHSMHDLTGSIAEKLGVLAPPVRIDSQAKYGAMARGDGAIYLRFPHKGYKEKIWDHAAGSIVVTEAGGIVTDAAGNDLDFSKGRFLDLDTGIIATNKQLMPSLLKAVQDAIKEKNQAASLL

SEQ ID NO: 40375 - DNA, 438 bp, Panicum virgatum
  misc_feature: Ceres CLONE 2002840
  misc_feature: Encodes the peptide sequence at SEQ ID NO. 40376
aactaacgctaaaaaagtaacagtttctgtactttattgcggacaatcatgctgcgccgagtggtctgcgcgcggtggtcgccgtcggtcgccgcccgcttcgtcaccatcacgccgctcgtgatgccggcgctgagcccgacgatgacccagggcaacttcgccaagtgggtgaagcaggtcggcgagtcgatccagcccggcgacgagctcgccaagatcgagaccgacaaggccacgatgtccttcgacaacgtcggcgacgaaggcttcatggcgcgccacatcatcgaggcgggcacgaacgacgtgcaggtcggcaccgtcgtcgcgctgctggtcgagagcaaggcggacatcgattcggacgaggtgaagaactggaagccctcggaagagcccaagaaggccgccccgaaggaggcagagaaggagccg

SEQ ID NO: 40376 - protein, 129 aa, Panicum virgatum
  misc_feature: Ceres CLONE 2002840
  misc_feature (22)..(97): Pfam Name: Biotin_lipoyl Pfam Description: Biotin-requiring enzyme
  misc_feature: SWISSPROT Homolog: EC 2.3.1.12 Dihydrolipoyllysine-residue acetyltransferase
MLRRVVCARWSPSVAARFVTITPLVMPALSPTMTQGNFAKWVKQVGESIQPGDELAKIETDKATMSFDNVGDEGFMARHIIEAGTNDVQVGTVVALLVESKADIDSDEVKNWKPSEEPKKAAPKEAEKE

SEQ ID NO: 40377 - DNA, 570 bp, Panicum virgatum
  misc_feature: Ceres CLONE 2002861
  misc_feature: Encodes the peptide sequence at SEQ ID NO. 40378
ggccgtcggactcgatgccgcggctgcacgcggactcgagctgctcggagctggtgctgtccccggagcagcagctggcgtgcgaccgggaggtgcagagccagcccaagatcagcgagtgggagcgcaccttcgcctccgaccccgtgaaccccgccggccacggcggcgccggcgcgggcctcggcggcgacccgctgctgcaggacatcctcatgtactggggcaagccgttctagacggtctcgtgcgcgaaccaagggaacggcagagcggttggctggcctgcctctctcggcagcgcaaccgccgcggcgtgggcttgactcaggcgagccgccctagctgactactagtaagagctctaaagatgggatggattagacggagatgtcatcatcatcataaactaaaaacaagaagatgatggactgggattattcgaggcggcaatgagacccgtgtggccccgccgggagctagggagagatcgcgatgcattggtggtcgatcgtgcgtggcatgtgtgtgtacttgtacatatccatacatggttggttgattcggtgc

SEQ ID NO: 40378 - protein, 78 aa, Panicum virgatum
  misc_feature: Ceres CLONE 2002861
  misc_feature: The sequence is a functional homolog of SEQ ID NO 890 in the 10/374,780 US patent application
PSDSMPRLHADSSCSELVLSPEQQLACDREVQSQPKISEWERTFASDPVNPAGHGGAGAGLGGDPLLQDILMYWGKPF

SEQ ID NO: 40379 - DNA, 671 bp, Panicum virgatum
  misc_feature: Ceres CLONE 2002881
  misc_feature: Encodes the peptide sequence at SEQ ID NO. 40380
aatacataattgacacagcgaagagctctccatctccttccttggcagcaggtagtacaacacggtggtggaagatggcctcgccggttcgccgcccagggtccggcgagggaatggatgcgccgccaccaaccgggactggcgacgactcgccggagccgaccagggactggtcggagctgccgctggacgccctcgcatcggtcttcgtcaagctcggcgccatcgagatcctgatgggcgctggcctcgtgtgccgctcctggctccacgccgccgagctgcccgacttgtggcgatccgtggacatggcgcgccacaaggtggtggacaacatcgtcgacatattcggcgactctcctgtggaaccaaagatcaaccatgacgtcctgcgcgccatggcaaggttcgccgtggaccgctcccgtggccagctggaggtgttcgtcgccaagcggttcgttaccgatcaactcctggagtacatcggcgacaggtcgccggctctgaaggccgtcgggctcgtctcgtgcggcggcgtctccaacgaagggttcacgcagctggtggcgaggtgccctctgctagaggacctcatgcttgtgcactgccccaagatcggcggccgcgacgtctacgaggccaccggccgggcatgtccgcagctcagg

SEQ ID NO: 40380 - protein, 185 aa, Panicum virgatum
  misc_feature: Ceres CLONE 2002881
  misc_feature (18)..(66): Pfam Name: F-box Pfam Description: F-box domain
MDAPPPTGTGDDSPEPTRDWSELPLDALASVFVKLGAIEILMGAGLVCRSWLHAAELPDLWRSVDMARHKVVDNIVDIFGDSPVEPKINHDVLRAMARFAVDRSRGQLEVFVAKRFVTDQLLEYIGDRSPALKAVGLVSCGGVSNEGFTQLVARCPLLEDLMLVHCPKIGGRDVYEATGRACPQL

SEQ ID NO: 40381 - DNA, 705 bp, Panicum virgatum
  misc_feature: Ceres CLONE 2002889
  misc_feature: Encodes the peptide sequence at SEQ ID NO. 40382
gagcacgagcccctcgcccttcgcccttgccgccgatccttccccaaaacctagcccgcccgcccgcccgccgtcggggccttctagaaccttccatccggggcgccgcgcctcccgccacggaccccgtcctctcgtcgcccccgcaccctcccgcgcggcggcctcgcagatccggttggatcgagggcgcaggaggctccggtcgggggcacacctcgcccagcccgaggccaggagatggggcaggcgttccggaagctcttcgatgccttcttcggcaacaaggagatgcgggtggtgatgcttgggttggatgcagctggaaaaaccaccatactctataagctgcacattggcgaagttctctccaccgtccctaccatcggtttcaatgttgagaaggttcagtacaagaatgtagtgttcactgtgtgggatgtcggcggccaggagaaactgaggcccttgtggaggcactacttcaccaataccgatgctctgatttatgtggttgattcactggatagagagagaatcgggagagccagagcagagttccaggctataatcaatgacccttttatgcttaacagtgtacttttggtgtttgctaacaagcaagatatgaggggagcaatgaccccgatggaggtgtgtgagggcctaggggtgtacgacctgactaaccgcatctggcacatc

SEQ ID NO: 40382 - protein, 154 aa, Panicum virgatum
  misc_feature: Ceres CLONE 2002889
  misc_feature (5)..(154): Pfam Name: Arf Pfam Description: ADP-ribosylation factor family
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with altered terpenoid content
MGQAFRKLFDAFFGNKEMRVVMLGLDAAGKTTILYKLHIGEVLSTVPTIGFNVEKVQYKNVVFTVWDVGGQEKLRPLWRHYFTNTDALIYVVDSLDRERIGRARAEFQAIINDPFMLNSVLLVFANKQDMRGAMTPMEVCEGLGVYDLTNRIWH

SEQ ID NO: 40383 - DNA, 715 bp, Panicum virgatum
  misc_feature: Ceres CLONE 2002891
  misc_feature: Encodes the peptide sequence at SEQ ID NO. 40384
aacccgcaagaaaacttccccccgcaccagagcaagggagagacgaggagtcgacgagcccagaccccgagctccagcgcaacgccgccgccgcagccgccgccgatggatccgaagctgacggaggtgacccagatgttcgcccgcttcaaggcggcgtacgcccgcaacgacctcgacgcctgcgtcaccctcctctcacagctcaaggtccagctcaccaaattccccagccttccgccattgtttcagcagacacccaacgccgtggaggagctcaaacttgcacgggacatttatgagcatgcggttgttttgagcgtgaaacttgaggaccaagatgcttttgaacgcgatttctgccagctcaagccttattatatggatatatgtggcataattcccccctcaccagaggagtacccaattttaggactcaatcttttgaggttgttggtccagaatagaattgcagagttccacactgagctggagcttctgcctgtcaaggcacttgagcatccttgcatcaagcatgccgtcgagcttgagcaatcctttatggagggtgcctacaaccgagtgttgagcgctcggcaggctgtgccgcacgagacctatgtttacttcatggaccttctcgccaaaacagttagagatgagatgattccctatccataagtgatgccaaacaaatgctgatgttcagctcgga

SEQ ID NO: 40384 - protein, 191 aa, Panicum virgatum
  misc_feature: Ceres CLONE 2002891
  misc_feature (24)..(190): Pfam Name: SAC3_GANP Pfam Description: SAC3/GANP/Nin1/mts3/eIF-3 p25 family
MDPKLTEVTQMFARFKAAYARNDLDACVTLLSQLKVQLTKFPSLPPLFQQTPNAVEELKLARDIYEHAVVLSVKLEDQDAFERDFCQLKPYYMDICGIIPPSPEEYPILGLNLLRLLVQNRIAEFHTELELLPVKALEHPCIKHAVELEQSFMEGAYNRVLSARQAVPHETYVYFMDLLAKTVRDEMIPYP

SEQ ID NO: 40385 - DNA, 785 bp, Panicum virgatum
  misc_feature: Ceres CLONE 2002904
  misc_feature: Encodes the peptide sequence at SEQ ID NO. 40386
catccagccgtgcgcgatgttcctgcggcggctcgccgccctctgcggcggcgcgaccgacggcggtgtcctggccgccctccgggccgagctcgccagcgagttttccttcgccgccgttccccttccccctcccttccattgccaggacttcgtcaccgtatcggacgccccgcttgctgaagacttgctcctgcgccgccggacccactccgaggaggtcctggtgtcggcgctgctcgcgccggtgatgtttgaaggacaggaacccctgcccagggacttgctcatgaaggtgttcgtcagtaagcctggtgcgacgccggttctgcacttcgactgtggtttatggcttgaggagaaacccttcggtcaatacgctattaacgccgtccggtaccactcgtctcctggcgacgctcgagaagacaagtatgaagggccggagttcagagatttggatcctcaactaaaggctgcattgaaagaatatctggtagcaagaggcgtcaactccaaactggtaagctcaattctgaggcacttgtatcagaaggagcaagcccagcattttaagtggctgaagactatggaagagacattcaccaaagatcattgatccaatcatccctctacctctccattcttctctcaccgagttaaacgtataatgtctattttggtgagccaacgctggggcaggtgcctgttctgtgctgacattggctcatttgtatcatctcatgtatgtgacgcaagtcaataaccagatagagcttcacgct

SEQ ID NO: 40386 - protein, 200 aa, Panicum virgatum
  misc_feature: Ceres CLONE 2002904
  misc_feature (22)..(196): Pfam Name: MAM33 Pfam Description: Mitochondrial glycoprotein
MFLRRLAALCGGATDGGVLAALRAELASEFSFAAVPLPPPFHCQDFVTVSDAPLAEDLLLRRRTHSEEVLVSALLAPVMFEGQEPLPRDLLMKVFVSKPGATPVLHFDCGLWLEEKPFGQYAINAVRYHSSPGDAREDKYEGPEFRDLDPQLKAALKEYLVARGVNSKLVSSILRHLYQKEQAQHFKWLKTMEETFTKDH

SEQ ID NO: 40387 - DNA, 629 bp, Panicum virgatum
  misc_feature: Ceres CLONE 2002908
  misc_feature: Encodes the peptide sequence at SEQ ID NO. 40388
accgccaagacacgggtcgcgcgagagcacgcacggcctggcgccttaactctggctgccctgccctgccctgccgcacacactactactggtagcgtcgccgtcccgggcgcggcacacgtagcgtggattcattccctggctgctggctaggtaggtaggtagagaggtgacggctgacggcgagatggcgatcggcagggcggcggcgctggtggtgttggtgctgtgcgcgctccggcaggaggcggcggcgcagcggtacaacgccatctggagcttcggcgactccatctccgacaccggcaacctctgcgtgggcgggtgcccgtcgtggctcaccacggggcagccgccctacggggagaccttcttcggccgccccaccgggcggtgctccgacggccgcgtcatcatcgacttcctggccgagcactttgggctgccgctgccgccggcgtccaaggccggcggcgacttcaagaagggcgccaacatggccatcatcggcgccaccaccatgaacttcgacttcttcaactccatcggcctcagcgacaagatttggaacaacggcccgctcgacacccaaatccagtggttccgccagctcctcccatccgtctgca

SEQ ID NO: 40388 - protein, 147 aa, Panicum virgatum
  misc_feature: Ceres CLONE 2002908
  misc_feature: SWISSPROT Homolog: EC 3.2.1.51 Alpha-L-fucosidase
MAIGRAAALVVLVLCALRQEAAAQRYNAIWSFGDSISDTGNLCVGGCPSWLTTGQPPYGETFFGRPTGRCSDGRVIIDFLAEHFGLPLPPASKAGGDFKKGANMAIIGATTMNFDFFNSIGLSDKIWNNGPLDTQIQWFRQLLPSVC

SEQ ID NO: 40389 - DNA, 741 bp, Panicum virgatum
  misc_feature: Ceres CLONE 2002918
  misc_feature: Encodes the peptide sequence at SEQ ID NO. 40390
aaccagcacacaataatcagcatcgtcagactattccacgcataggccgccggacgagagcatggccaagcagctggaagaccaccggagcaacgacggcgaggtcgagttgggggcgatgatgacgacggagtggaagctggaactggacgtcgccagcaagctgttcgacgccttcaccgtcgccggcctctgcgtcgacgccatcgagcccggccgcgccatgatctgctctttcacggtgccgccgcgccttacggacgcgagcaagcgcatgcatggaggggccttggcgtctctggtcgacctggtgggctcggccgtgttcttcgctggcggctcgccgacgacgggggtgtccctggagatcaccatctcgtacctaaccgcggcccgtgcaaacgaggagatcgagatcgacgcgagggtcctgggcatcggcgcgacggcggggtgcgtgacggtggaggtcaggaagaaggccaccggcgaggtgatcgcgcacggccggcacaccaagtacctcgccgtctccagcaaactgtgatgtatggatggatatcacgatcaggatcggatggatggagcgcgtacgtacgcgcgcgcattaggtcgctctcgcctatatatatgcattccctcgtgttatacacactacaagaaaagtgtgcattagtaccgggcggaaccccttggttagtaccggtttctcgcccggtaccgccccatcggtactaaatg

SEQ ID NO: 40390 - protein, 161 aa, Panicum virgatum
  misc_feature: Ceres CLONE 2002918
  misc_feature (69)..(146): Pfam Name: 4HBT Pfam Description: Thioesterase superfamily
MAKQLEDHRSNDGEVELGAMMTTEWKLELDVASKLFDAFTVAGLCVDAIEPGRAMICSFTVPPRLTDASKRMHGGALASLVDLVGSAVFFAGGSPTTGVSLEITISYLTAARANEEIEIDARVLGIGATAGCVTVEVRKKATGEVIAHGRHTKYLAVSSKL

SEQ ID NO: 40391 - DNA, 712 bp, Panicum virgatum
  misc_feature: Ceres CLONE 2002924
  misc_feature: Encodes the peptide sequence at SEQ ID NO. 40392
acccaaccaacccaaccgcgcttgtgttgtgtacactccactagtcccagctagctccacccaagccaggaagcagagctagaggcgtccatggcggcgcggcgggcgctgtccgcggcggtggcggtggcgctgctggcggcgtcggcgtcggcggactcgtggctgtacgagaagttcacgacggacgggcacgtgcgcgccgactacaacgcacaggggcagcaggtgacgtcgctcatcctcgaccgccagtccggcggcgccttctactcccgccagaagtacctctacggcgtcttcagcatccagatgaagctcatccgcggcaactccgccggcaccgtcacctccttctacctgacctccggcgacggccccgggcatgacgagattgacatggagttcatgggcaattccaccggcgagccggtggtgctcaacaccaacgtgtgggccgccggcgacggcaagaaggagcagcagttctacctgtggttcgacccggccgccgacttccacacctacaccatcatctggaacgaccggaacgtcatcttcaaggtggacgacctcttcatccgcagcttccggcggcacgccgacctgccgtaccccggctgggagcccatgtcggtgcacgccacgctgtgggacggcagcttctgggccacgcagcaggggaaggtgaaggtggactggggcgggcgcg

SEQ ID NO: 40392 - protein, 207 aa, Panicum virgatum
  misc_feature: Ceres CLONE 2002924
  misc_feature (26)..(206): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MAARRALSAAVAVALLAASASADSWLYEKFTTDGHVRADYNAQGQQVTSLILDRQSGGAFYSRQKYLYGVFSIQMKLIRGNSAGTVTSFYLTSGDGPGHDEIDMEFMGNSTGEPVVLNTNVWAAGDGKKEQQFYLWFDPAADFHTYTIIWNDRNVIFKVDDLFIRSFRRHADLPYPGWEPMSVHATLWDGSFWATQQGKVKVDWGGR

SEQ ID NO: 40393 - DNA, 536 bp, Panicum virgatum
  misc_feature: Ceres CLONE 2002933
  misc_feature: Encodes the peptide sequence at SEQ ID NO. 40394
aaggccatgctggtgccaatttggttcctctcgttgcttctaaccggataggtagagaaactgttgagactgagcatggcaagagcactataaccttctacgggaattccttcattgcaggaccaactggagaaatcgtgaagcttgctaatgacaaagatgaggaagtactggtagcggagtttgacttagacgagataaagtcaaccaggcatggttgggggatattcagggaccgccgccctgaattatataaagtgctattgacactggatggtgagaaatgataataagctcaactttagcgcgtttatctatccttgaataggacgtgatgagctctacattactgggaaggcacaggctccccgagtgttgccaccacatcgatgatagattttcccttctttccctgtccaaatatgctttgcttgcatctgtacaagccacctgtatgattcgtgatattttaccattttcacatttcatgaataaatagtcatgcaatgcaatgcaatgcaatgttttggctcagg

SEQ ID NO: 40394 - protein, 94 aa, Panicum virgatum
  misc_feature: Ceres CLONE 2002933
  misc_feature: SWISSPROT Homolog: EC 3.5.1.53 N-carbamoylputrescine amidase
GHAGANLVPLVASNRIGRETVETEHGKSTITFYGNSFIAGPTGEIVKLANDKDEEVLVAEFDLDEIKSTRHGWGIFRDRRPELYKVLLTLDGEK

SEQ ID NO: 40395 - DNA, 632 bp, Panicum virgatum
  misc_feature: Ceres CLONE 2002944
  misc_feature: Encodes the peptide sequence at SEQ ID NO. 40396
gaatctgttatgcgtatcagatgcggaaaaggggtacggttcacaacatatcatggtcatttcatgctaagatcgacagacctgttagcccttccagccgttgactctgataaagcttttggaatgcaactatctctagaggagaccttaatgaccacccagactgtatactttcaagtggcactgctatacacatcttcctccggtgaaaggcgtatcagggtccacacagcagctgcacctgtggtcacagatcttagtgaaatgtatcgtcaagcagatactggtgccattgtctcattgttgggtagaattgcggttgaaaattctgtgtctgataagctggacagtgtccgacagcaattacagttaaagcttgtgagaagtttgaaggaataccgaaacttatatgttgtacaacaccggataggagggagactgatttttccagaatctctaagatttttgccattatacatcctggccatctgcaaatctcttgccctccgtggaggttacgcagatgtctctcttgatgaaagatgtgctgctggtttcagcatgatgatactgcctgtaaaaaggctgctcaactttgtctatccttcgctgtacagagttgatgaaatatt

SEQ ID NO: 40396 - protein, 210 aa, Panicum virgatum
  misc_feature: Ceres CLONE 2002944
  misc_feature (1)..(83): Pfam Name: Sec23_BS Pfam Description: Sec23/Sec24 beta-sandwich domain
  misc_feature (95)..(200): Pfam Name: Sec23_helical Pfam Description: Sec23/Sec24 helical domain
ESVMRIRCGKGVRFTTYHGHFMLRSTDLLALPAVDSDKAFGMQLSLEETLMTTQTVYFQVALLYTSSSGERRIRVHTAAAPVVTDLSEMYRQADTGAIVSLLGRIAVENSVSDKLDSVRQQLQLKLVRSLKEYRNLYVVQHRIGGRLIFPESLRFLPLYILAICKSLALRGGYADVSLDERCAAGFSMMILPVKRLLNFVYPSLYRVDEI

SEQ ID NO: 40397 - DNA, 527 bp, Panicum virgatum
  misc_feature: Ceres CLONE 2002956
  misc_feature: Encodes the peptide sequence at SEQ ID NO. 40398
aagagaaatttcaataagatgtctggtagaggaaaaggcggcaagggtttgggaaaaggaggtgccaagcgtcacagaaaagtgctcagagacaacattcaaggtataaccaagccggcgatacgtcgtctagccagacgtggcggtgtcaagcgtatatcaggcctcatctatgaagagacacgtggtgtgctcaaagtgttcttggagaacgtgattcgcgatgctgtaacctacaccgagcatgccaagcgtaagacagtgactgcaatggacgtagtgtatgctctgaagagacaaggtcgcactctgtacggttttggtgcctagacagtcgtaccaagacaattcagctcaattttcttctcaaaaaacattgtatataagtcgtcagccttataagctcacaaaaacacacacagaatagaatcaaaacaaaatttcaaatagaaattgtaaactcaaattcactctttttttaagtattcaatttgtttgttagaataaaatttcttatataacactac

SEQ ID NO: 40398 - protein, 103 aa, Panicum virgatum
  misc_feature: Ceres CLONE 2002956
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGA

SEQ ID NO: 40399 - DNA, 338 bp, Panicum virgatum
  misc_feature: Ceres CLONE 2002962-R
  misc_feature: Encodes the peptide sequence at SEQ ID NO. 40400
cccccccccccccccccccccccccccccccccgttccccccccccctcctcccccgggcccccccccccccccgtctccccgccccccccccggccccccccccccccccccccccctttcccctttccccccccccccccccccccccccgcagttcacccccccccccccccccccgctctccccgcccccccccccccccggccccccccccttcccggggggggacccccccaccccgccccccccccccgcgcccctttcggggccccggggccccccgcccccctcaatcccccccccggggtcctcgcccccccccccccccccccgggg

SEQ ID NO: 40400 - protein, 112 aa, Panicum virgatum
  misc_feature: Ceres CLONE 2002962-R
  misc_feature: Useful for making plants with altered cell wall content and/or composition
  misc_feature: Useful for making plants with modulated flowering time
PPPPPPPPPPPFPPPLLPRAPPPPRLPAPPPAPPPPPPPFPLSPPPPPPPRSSPPPPPPRSPRPPPPPAPPPSRGGTPPPRPPPPRPFRGPGAPRPPQSPPRGPRPPPPPPG

SEQ ID NO: 40401 - DNA, 1102 bp, Panicum virgatum
  misc_feature: Ceres CLONE 2002962
aacgagctcatcgcgagcagttggtccactcttttaccacactgcccccaataactacaacaacacagctacgacggcaacacagcatcacccggtccattgactacacaccaacattggttcatccattcttttcccgggatctttgctctctcccatcacccatcacccatcaccatcacccaccacgatgcctaccaaaggccaccaacggtcgcgttcatccatcgaccgggtcattgatctgctggcagatcttgaagacaaccaaatcagcctcctcctcgatgacttgaaccacaccacctcgagcaatgtcgccgtaccggatgcgatcgcccttttcgagcatcatgcgaacaaacccaggaacaggtcatgccggtctccttctccgctgaggaccctgcaggtcgagctcgagcgacgtcacagcaagagactttctgctgcaccagaaagactgtctcgtttcaaagcagccaacccccaaccgcccgccccccaggacctagcgacgccgtcgccgtcgccgtcgccgccacccacagaggacctcttcgaccaacccaacttcaacgacagcttctcacttgacctgtccccgccacccgtgtcgttcgaccaccccaagacctcatcggccggaccacccccggtattccgccctcgttcttacaagaggatcagccggcccatgttcctctcaccgaccgcaacagccgaacttcacctgttgctccttgccttcttcaacgagaccccgctcccgccggtctcgccggtcacaaccgcgactccatcacccactacaccgcttttcggcttttcccattctcccttcaccgacttcgaagttgaaccgaacactccaggcctcgatctgctcgaaccttcaccgacacggacaccaagcttttccggtgggagaagcctcaagacgatgcctagcatcagtagcatattcgaggtcatgaggtcacagtagacgattaattactttcaaggtgttgttgtagcattagcaagcgtttggggtgtaattttgtacgatgggatactgagaatgatatccgagctatggggctctttgttggaaaaa

SEQ ID NO: 40402 - DNA, 662 bp, Panicum virgatum
  misc_feature: Ceres CLONE 2002967
  misc_feature: Encodes the peptide sequence at SEQ ID NO. 40403
taggctatgatggtgcaaaatcagacatctggtcttgtggtgttgttctatttgtccttgttgctggttatctccctttccaaggcccaaacttgatggagatgtatcggaagatacagcatggtgatttcaggtgccccagttggttttcacacaaactcaagaagctgttgtacaagatcttggaccctaacccaagcacaagaatttcaatccagaaaataaaagagtctacctggttccgaaaaggccctgagcggacccgcacagttaaggagaaaattccctgcgagaatgccaccacaaatgctgctccaacactttctgtgaggcgcggaaagaatgcttatgaagatgtgaagccgctgcctgtgacaaacttaaatgccttcgaaattatctctttctcctcagggtttgatctatctggcttatttattgaaaagggacacagaaaggacgcacgatttacttcagataagccagcctcagcaatcatctcgaagattgaagatgttgcaaagatgctgaatctcagggtaaggaagaaggataatggtgttgtcaagattcaagggaggaaggagggaaggaatggtgtccttcagtttgacacagagatctttgagatcacaccgttccatcatctcgttgagatgaaa

SEQ ID NO: 40403 - protein, 219 aa, Panicum virgatum
  misc_feature: Ceres CLONE 2002967
  misc_feature (123)..(182): Pfam Name: NAF Pfam Description: NAF domain
  misc_feature: SWISSPROT Homolog: EC 2.7.11.1 Non-specific serine/threonine protein kinase
GYDGAKSDIWSCGVVLFVLVAGYLPFQGPNLMEMYRKIQHGDFRCPSWFSHKLKKLLYKILDPNPSTRISIQKIKESTWFRKGPERTRTVKEKIPCENATTNAAPTLSVRRGKNAYEDVKPLPVTNLNAFEIISFSSGFDLSGLFIEKGHRKDARFTSDKPASAIISKIEDVAKMLNLRVRKKDNGVVKIQGRKEGRNGVLQFDTEIFEITPFHHLVEM

SEQ ID NO: 40404 - DNA, 718 bp, Panicum virgatum
  misc_feature: Ceres CLONE 2002987
  misc_feature: Encodes the peptide sequence at SEQ ID NO. 40405
aataaagccgcagcccgtctctctctccccttcaatctcgattccatagcttccgccgctagggttttgacctgcagcttcctcgccactccaccacttcaacccctgttcgatcccggccatcggatcgatggcgtcggacgcagcggcggggaaggacaagatgctgacgctgatcagctgcgacaaggagaacttcgaggtggaggagtcggtggcgagggagtcgcggaccatcctgcacatgatcgaggatggctgcaccgacaacggcatcccggtccccaacgtcaactccaagatcctcgccaaggtcatcgagtactgcaagaagcacgtcgaggcgcgccgcggcgccgacgcggacgccgttgagccaactgccgcgaccaacaaggcctccgacgacgagctcaagaccttcgatgctgacttcgtcaaggtggaacaggccaccctcttcgacctcatcctggctgcaaactacctggacatcaaggggctcctggatctgacctgccagaccgttgcggatatgatcaaggggaagactccggaggagatccgcaagaccttcaacatcaagaacgacttcacccctgaggaagaggaggaagtgaggagggagaaccagtgggccttcgaatgaggaggctgaggctctaacgacagcaatctcctataaccaggccagcggggaacgtgttatgccagggaa

SEQ ID NO: 40405 - protein, 172 aa, Panicum virgatum; identical to SEQ ID NO: 12120
  misc_feature: Ceres CLONE 2002987
  misc_feature (95)..(172): Pfam Name: Skp1 Pfam Description: Skp1 family, dimerisation domain
  misc_feature (11)..(71): Pfam Name: Skp1_POZ Pfam Description: Skp1 family, tetramerisation domain

SEQ ID NO: 40406 - DNA, 1041 bp, Panicum virgatum
  misc_feature: Ceres CLONE 2002998
  misc_feature: Encodes the peptide sequence at SEQ ID NO. 40407
cttggccttggcctttccctcttcagctaattgcttggacccttgcacctgctgcaagtggagccagcatccgagaagctaccactactagctgctccggctcagctcagctcaaaaggcgtcggggtttagcgcacgagatgagcagcgcgttgcccggggcagactgggcaacgagcaggagcaggaggaggaggagatgctgctgttaggattggccgcgggccccgccgtcgccggggaagtcgagaagcaggacgacggcggggcgtcctccggcggccatggctcgaggattggccccgcggtggtgctcgtcttggtgatagtggcagtgttgctgctcgtgtccgggctgctgcatctcttggtcaggtgcttgcgccggcgcggcggcgcgcgctcgggggcggaggacggcgccgacggggcgggtggcggcggggaggagtcggcgctgcagaggcagctgcagcagctgttccacctgcacgacgccgggctggaccaggacgtcatcgacgcgctcccggtgttcctgtaccgggaggtggtgggcggcgccggcgccaaggagccgttcgactgcgcggtatgcctgtgcgagttcgccggcgaggaccggctccggctgctgccactgtgcgggcacgcgttccacatcgactgcatcgacacctggctgctctccaactccacgtgcccgctctgccggtgcgcgctcggcgccgacgccgccgcgctgctcggcgcgttcggcgactagggcgggtggaagcacgaggacgccgtgctcccggtgcgcctcggcaagttcaagaacctgtccagggcggcgcccgtccccgcccagggcggcgccggcattgtgaccaaggaggccggcgagacgagcagcagcagcctcgacgccgggcggtgctactccatgggctcctaccagtacgtcctcgccgaggcgagcctgcaggtgtccgtccaccggaggcacggcgacggctcatgccagggctagggccatgctcagaggcgccggcgccc

SEQ ID NO: 40407 - protein, 188 aa, Panicum virgatum
  misc_feature: Ceres CLONE 2002998
  misc_feature (130)..(171): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: The sequence is a functional homolog of SEQ ID NO 1939 in the 11/479,226 US patent application
MLLLGLAAGPAVAGEVEKQDDGGASSGGHGSRIGPAVVLVLVIVAVLLLVSGLLHLLVRCLRRRGGARSGAEDGADGAGGGGEESALQRQLQQLFHLHDAGLDQDVIDALPVFLYREVVGGAGAKEPFDCAVCLCEFAGEDRLRLLPLCGHAFHIDCIDTWLLSNSTCPLCRCALGADAAALLGAFGD

SEQ ID NO: 40408 - DNA, 291 bp, Panicum virgatum
  misc_feature: Ceres CLONE 2002998-R
cgaggggtagaagatcggtgccgccagccagggagacagcttctcgcagtccaagattcgacagtggccgcggaacgccaaggggaagttgcccgtgctcgcgtccgatgactcgccggcgatgaacggccggctgccgcggcagaggcggagccccggggattcgtgacgcagagaaaacgtgtgtggtggtgcgtgctccggactttgctgagctgatttagctcgcccttttaaccggtgaatctgttcatagccattcgttcctcttacaaaatcacatttgcgggt

SEQ ID NO: 40409 - DNA, 1217 bp, Panicum virgatum
  misc_feature: Ceres CLONE 2003002
  misc_feature: Encodes the peptide sequence at SEQ ID NO. 40410
ataagccatgctcttagctcttctctggtcgctggaatagaacgagcggccccctcctctcctgtgttgttctttccccttctctcttctctacttgtctagggttagggatctcccatggaggattgagtttttgtactagaattcgatgggaatggaggccccatcctcctcttgccctccgggcgttggattttgattcaatcttgtttcgctgctggattttggttcccttgtgttgcgttgctgtgcagggccggctctgtgttttggcgctgatgcttgggggcgagcggcagcaggcttggcaggcgcagggcgcgcgcttggccttgactgcggtggtgtggcaagtagcagcgccggcggcgactccgcgacgcgcagcaggaagcggcaagcagtagcgccggcagcagtgttgggcggcggcgcaaggcaagccctttgctccggcttccgcaagcaccctgcacgcgcagcaggccagcaggccaaatcggcacatgggccaaagcaccaggccaccacagcagcggcgtgctcaggttcactagcccaaggagcagggagctagaaaagctgggaatggccggaggacgagaagggctgaagctgctgggaacatgggcgagcccgtttgtgatcagagtgaagcttgcgctcagcttcaagggcctgagctatgaggacgtggaggaggaggacctctaccacaacaagagcgagctgctcctcaagtccaacccggtgcacaagatggtgcccgtgctcatccacaacggtaagcccgtttgcgaatctcagctcatcgtggaatacatcgacgaggccttcggcacagagggtccctccctcctccctgctgagccctacgaacgcgccatggctcgcttctgggctgcctacatcgacgacaagttgtttgcctccgcgtctcaagtcggtagagccaagacggaggaggagaaggccgaggcactgaagcagacgttcatggcggtcgagaccctggaggcagccttcaaggagtgctccaaggggaagcccttcttcgggggtgacagcgtggggtacttggacatcgtgctcgggcccatcataccgttggcgcatgtcggcgaggcacggtttggtatcaagctctttgacggcaccagaagcccgctcttggaggcatgggtagagcgcttccccatgatggatgcggccaaggc

SEQ ID NO: 40410 - protein, 209 aa, Panicum virgatum
  misc_feature: Ceres CLONE 2003002
  misc_feature (6)..(81): Pfam Name: GST_N Pfam Description: Glutathione S-transferase, N-terminal domain
  misc_feature: SWISSPROT Homolog: EC 2.5.1.18 Glutathione transferase
MAGGREGLKLLGTWASPFVIRVKLALSFKGLSYEDVEEEDLYHNKSELLLKSNPVHKMVPVLIHNGKPVCESQLIVEYIDEAFGTEGPSLLPAEPYERAMARFWAAYIDDKLFASASQVGRAKTEEEKAEALKQTFMAVETLEAAFKECSKGKPFFGGDSVGYLDIVLGPIIPLAHVGEARFGIKLFDGTRSPLLEAWVERFPMMDAAK

SEQ ID NO: 40411 - DNA, 594 bp, Panicum virgatum
  misc_feature: Ceres CLONE 2003002-R
ttgtctccgcgtctacagtgggcagagcacaagcctgaggaggtgaatcccgaggccccgaagccgacttttagggcggtcgagaccggggactctgctttcagggactgctctaatggtaagcccttcttcggtggcggccgtctggttcacttggatatcctttgagggcccatcatagggttggcgcatgtgggagaggcacggtttggtatcaaggtgtttccaggcaccaggaagcccgctgttggaggcatgggcagagcgattggcctcgatggatgtgaccaagtgcaatcttgccagaggtcagtcaagcggattgagtcccccaagggcaagcacgcacgatccgcggccgcgatgtccgcaaccccaagcatctagtaaaattagctcgttcatgtgcgttccatcgcgtaatatctttacacaaaacagacactcagttttatagtccatgggttggcttataataagttgtccttttctatcaatcaaccgtattatttagcatgggttttcctacgggaaccaatttgaaccatgggagcgatgccatatccaaatcaaatttggtgcccagccttgggc

SEQ ID NO: 40412 - DNA, 826 bp, Panicum virgatum
  misc_feature: Ceres CLONE 2003008
  misc_feature: Encodes the peptide sequence at SEQ ID NO. 40413
aacgaacctcccatcgactcggatttttgtcgacaatccgcgagtcaccgtcaagatgggtatcgatctccgcaaacaccacgagcggtccacgcaccgcaaggcccccaagagcgacaacgtctacctgaagctcttggtgaagctctaccgcttcctggcccgccgcaccgatgcgcccttcaacaaggtggtcctgcgccgcctgttcatgagccgcatcaaccgcccgcccatctcgctgtcccgcatcgcggccaacctcaagaacggcaacgagaacaagacggtcgttgttgtcggcaccgtcaccgatgacaaccgcctcctgaccgtccccaagatgtcggtcgccgctctccgcgtcaccgccaccgcccgcgcccgcatcactgccgccggcggcaacgtcatcaccctcgaccagctggccctcgagaagcccactggcgccaacaccctgctgctccgcggccccaagaacgcccgtgaggccgtcaagcacttcggctttggtccccacaagaacaagaagccctacgtccgctccaagggccgcaagttcgagcgcgcccgtggccgcaggaggtcgcgtggcttcaaggtctaagctggtggaccaccgataccctctggagtttggggcgtgggcacgggttctgggtcgtcgcatggcaatggttttggggcatgtggtttctgggcttgccgcggtctgctctctgctctcgaccgcggcacatgggacgcaaaagtctttttcctgttttacgggcatgacgaattgacgggctggcactctactggtgccacagccatgaatgac

SEQ ID NO: 40413 - protein, 184 aa, Panicum virgatum
  misc_feature: Ceres CLONE 2003008
  misc_feature (10)..(182): Pfam Name: Ribosomal_L18e Pfam Description: Eukaryotic ribosomal protein L18
  misc_feature: Useful for making plants with modulated nitrogen use efficiency
MGIDLRKHHERSTHRKAPKSDNVYLKLLVKLYRFLARRTDAPFNKVVLRRLFMSRINRPPISLSRIAANLKNGNENKTVVVVGTVTDDNRLLTVPKMSVAALRVTATARARITAAGGNVITLDQLALEKPTGANTLLLRGPKNAREAVKHFGFGPHKNKKPYVRSKGRKFERARGRRRSRGFKV

SEQ ID NO: 40414 - DNA, 660 bp, Panicum virgatum
  misc_feature: Ceres CLONE 2003011
  misc_feature: Encodes the peptide sequence at SEQ ID NO. 40415
gaggccgcgggcaataaagaaggaaatgatgcgcgcgcacaccgtggccacccctccccacccaccgccgcgccgggccacccactctctctctcctccctctccctctctctctctcctcaagccctccccccctccacctcctccaccaccaccacccaccattccggcgcggagaccgcttcccttcgcccacccccgcaaccctctcctcccccgcctcctccgcgcttccctccatttgtccgcgcccccctcgctgccgatcttaaccacccgccgcgcgctcccgccacccggcttcctctggtccgccctcctttccccccctcgacccaaaacgctcggctccccccaccactttccatctctcttctttgttcccccagaggacgaggaggaggaagaagaaccaggaggcctctccccccctgcaccggtagcgagagggagggcggaagaggatgagcgcgtccaggttcataaagtgcgtcacggtcggggacggcgccgtcggcaagacctgcatgctcatctcctacacctccaacaccttccccaccgactatgttccaacggtgtttgacaacttcagtgctaacgtcgtggttgatgggtacactgtcaacctcgggctatgggacactgcaggtcaagagg

SEQ ID NO: 40415 - protein, 65 aa, Panicum virgatum
  misc_feature: Ceres CLONE 2003011
  misc_feature (8)..(65): Pfam Name: Ras Pfam Description: Ras family
  misc_feature: Useful for making plants with modulated nitrogen use efficiency
MSASRFIKCVTVGDGAVGKTCMLISYTSNTFPTDYVPTVFDNFSANVVVDGYTVNLGLWDTAGQE

SEQ ID NO: 40416 - DNA, 796 bp, Panicum virgatum
  misc_feature: Ceres CLONE 2003015
  misc_feature: Encodes the peptide sequence at SEQ ID NO. 40417
gatagatgctgagatatgcagctcacctgcgtattcgagaaaaaagtggctgcgatttcctcttgcatttttctgataacatggccttgcaggtagtgaagcttctaagagaggcttatgggcgggtaaagcgtctgcttaagaagcacgagaagcaattacatgcgttagcgaatgcgttgctggagcacgaaacacttactgcggatgagatcaacaaagtagttcatccataccaagaagagccccagttctccttccaagatgaggagtttgccctcacttaaaagattctttcgttacatccagacagcattcaccaactgtgaattgtaaatccatgtacagtaagtggtgcctagatgaaccatggaagttctttcagacgtctcccttctgtaaagtggggtacaaaacctgtggtgcattttcttctcggcaccattttcctttggtgaacaggcaagcatcagaagaagatatttgcaaagggtgatgcaagcttatcgataattctttcattggaagaccaccatgctcccttggcaaagctttggattgcaaagcccctccatacttttagtttagctaggagagatataggtgtaacattgcatgttctgaaggctaggtttctggctagggagacatctttttacaatgttcttttcacctttttctttttacatttgttgtaaggagctcgtacatataaaggttggtgccaaataaacattgattcactctttgtactaagttaatctttcctaagtttataccaaatgaatgcattgtc

SEQ ID NO: 40417 - protein, 93 aa, Panicum virgatum
  misc_feature: Ceres CLONE 2003015
  misc_feature: Useful for making plants with modulated heat sensitivity
MLRYAAHLRIREKSGCDFLLHFSDNMALQVVKLLREAYGRVKRLLKKHEKQLHALANALLEHETLTADEINKVVHPYQEEPQFSFQDEEFALT

SEQ ID NO: 40418 - DNA, 731 bp, Panicum virgatum
  misc_feature: Ceres CLONE 2003018
  misc_feature: Encodes the peptide sequence at SEQ ID NO. 40419
atcgtcgacggcaacgacgtcccgccgcccgcgcgggacttccgcgacctccgcctcccggagcccatgctccggaagctgcgcgagaggggcatcgtccagcccacgcccatccaggtgcaggggctgcccgtggttctctccgggcgcgacatgatcggcatcgccttcacggggtcggggaagacgctcgtgttcgtgctgccgcttatcatggtagcgctgcaggaggagatattgatgccgattgtgcctggggagggcccgtttgggatgatcatctgcccgtcgcgggagctggccaagcagacctatgatgtgattgagcagttcctccttccactcaaggatgctgggtacccggagataaggcctctgctttgcattgggggtgtggatatgaggacgcagctggatgtgttgaagaagggcgtgcacattgtggtggcaacgcctggccggctcaaagatttgcttgccaagaagaagatgaatctcgataactgcaggtacttaaccttagatgaagcagataggctggttgatttgggatttgaggatgacatcaaggaggttttcgaccatttcaaggatcaaaggcagacccttcttttttctgctactatgccccagaagattcaaaattttgcgaagaatgcccttgtgaaaccagttactgtcaatgtggggagagctggagcagcaaatcttgatgtctttcaagaagtcga

SEQ ID NO: 40419 - protein, 243 aa, Panicum virgatum
  misc_feature: Ceres CLONE 2003018
  misc_feature (36)..(216): Pfam Name: DEAD Pfam Description: DEAD/DEAH box helicase
IVDGNDVPPPARDFRDLRLPEPMLRKLRERGIVQPTPIQVQGLPVVLSGRDMIGIAFTGSGKTLVFVLPLIMVALQEEILMPIVPGEGPFGMIICPSRELAKQTYDVIEQFLLPLKDAGYPEIRPLLCIGGVDMRTQLDVLKKGVHIVVATPGRLKDLLAKKKMNLDNCRYLTLDEADRLVDLGFEDDIKEVFDHFKDQRQTLLFSATMPQKIQNFAKNALVKPVTVNVGRAGAANLDVFQEV

SEQ ID NO: 40420 - DNA, 739 bp, Panicum virgatum
  misc_feature: Ceres CLONE 2003029
  misc_feature: Encodes the peptide sequence at SEQ ID NO. 40421
aacgaggatttcgagcagcgacacccgtccgatccccgaacgctgccaagcccctgccgcctgccgcctgccgctgccggcgcggcggcgccccccacagatccgcacaaactctcggccggttcgcccgcgccgcccgtccgttccgcggcctcgcacggccccaaatcccacagctgcgcccccaaagccaccagccggccggccccgctacaaaagcaggcggctggctgcgcgacgagcagcagctgcctcagccactgcgctgcgcctcggtgaggagggcgcataggatagggatggcggcggcggtggagggcgtgcggcaccggacggtggaggcgaacggcgtccgcctgcacgtggcggaggcggggcccgaaggcggcggcgccgcccccgcggtgctgctgctgcacggcttcccggacctctggtacggctggcgccaccagatggccgccctggcggcgcggggctaccgcgccgtggcgcccgacctccgcggctacggcgactctgacgccccgcccgacgcgtccgcctacaccaccttccacgccgtcggggacctcgtcgcgctcatcgccgacctcggccagccccaggtgttcgtcgtggggcacgactggggcgccatcgtggcgtggcagctgtgcctcctccggccggacctggtgcgggcgctcgtgaacctccgcgtcgtctaccaacgcggggcccggagaggagcccgctc

SEQ ID NO: 40421 - protein, 146 aa, Panicum virgatum
  misc_feature: Ceres CLONE 2003029
  misc_feature: SWISSPROT Homolog: EC 3.3.2.10 Soluble epoxide hydrolase
MAAAVEGVRHRTVEANGVRLHVAEAGPEGGGAAPAVLLLHGFPDLWYGWRHQMAALAARGYRAVAPDLRGYGDSDAPPDASAYTTFHAVGDLVALIADLGQPQVFVVGHDWGAIVAWQLCLLRPDLVRALVNLRVVYQRGARRGAR

SEQ ID NO: 40422 - DNA, 688 bp, Panicum virgatum
  misc_feature: Ceres CLONE 2003041
  misc_feature: Encodes the peptide sequence at SEQ ID NO. 40423
tttgtttgatggtatgtgctactcggataaccgtagtaattctagagctaatacgtgcaacaaaccccgacttccgggaggggcgcatttattagataaaaggctgacgcgggctctgctcgctgatcagatgattcatgataactcgacggatcgcacggcccttgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaactagcgccggcgccgcagacactaccccttcgctcccttccctcccgccgctgccgcacctccgccggagccgagatggccccgaagaaggacaaggccccgccgccgtcctcgaagccggccaagtccggcggcggcaagcagaagaagaagaagtggagcaagggaaagcaaaaggagaaggtcaataacgcggtgctcttcgaccaggccacctacgacaagctgctctcggaggtgcccaagtacaagcagatcaccccctccgtcctctccgagcgtctcaggatcaatggctccctggctcggagggccatcaaggacctgatggctcgtggcctcatccgaatggtctcagtgca

SEQ ID NO: 40423 - protein, 95 aa, Panicum virgatum
  misc_feature: Ceres CLONE 2003041
  misc_feature (1)..(94): Pfam Name: Ribosomal_S25 Pfam Description: S25 ribosomal protein
MAPKKDKAPPPSSKPAKSGGGKQKKKKWSKGKQKEKVNNAVLFDQATYDKLLSEVPKYKQITPSVLSERLRINGSLARRAIKDLMARGLIRMVSV

SEQ ID NO: 40424 - DNA, 978 bp, Panicum virgatum
  misc_feature: Ceres CLONE 2003046
  misc_feature: Encodes the peptide sequence at SEQ ID NO. 40425
accttcacgtctccaaaatggccgccatcaccaagtccgtcgccacccgcgccgtgtccgtgcgcaccgcccgcgcctcgcgcgtggccgtccgcgccgcggttgagttctacggccccgaccgtgctcagttcctgggccccttcacggacaccccctcctacctgactggcgagttccccggtgactacggctgggacaccgccggtctgtccgctgaccccgagaccttcaagcgctaccgtgaggtggaggtcatccacgcccgctgggccctgctgggtgctctgggcatcattgtgcccgagctgaccgcctcctccgtgccctacggcgagtccgtgtggttcaaggctggcgcccagatcttcgctgacggtggcctgaactaccttggcaacgagtccctggtgcacgcccagtccatcgtggccaccctggccgtccaggtcatcctgatgggccaggctgaggctttccgcgccaacggctctgcccccggcctggacaacctggactccctgtaccccggtggccccttcgaccccctgggtctggctgacgaccccgacaccttcgctgagctgaaggtgaaggagatcaagaacggccgcctcgccatgttctccaacttcggcttcttcgtccaggccatcgtgaccggcaagggccccattgccaacctgaacgaccacctggctgaccccaccgtgaacaacgcgttcgcgtacgccaccaagttcaccccctccgcctaaaatgatgatttgaccgcttcggcggcccggctgtgatgtcgggatcccccagtgctaggacctgaacccttctagtgcctggggtgtataactaccccaagttttgactgagttggtggatgtggatgtcgtgtacatcaggaagtttgaggagagaggcttcgtgtttttggacaccgtgtgggcttgtcacaaagagcttgtaacatacccggttcgg

SEQ ID NO: 40425 - protein, 246 aa, Panicum virgatum
  misc_feature: Ceres CLONE 2003046
  misc_feature (45)..(213): Pfam Name: Chloroa_b-bind Pfam Description: Chlorophyll A-B binding protein
MAAITKSVATRAVSVRTARASRVAVRAAVEFYGPDRAQFLGPFTDTPSYLTGEFPGDYGWDTAGLSADPETFKRYREVEVIHARWALLGALGIIVPELTASSVPYGESVWFKAGAQIFADGGLNYLGNESLVHAQSIVATLAVQVILMGQAEAFRANGSAPGLDNLDSLYPGGPFDPLGLADDPDTFAELKVKEIKNGRLAMFSNFGFFVQAIVTGKGPIANLNDHLADPTVNNAFAYATKFTPSA

SEQ ID NO: 40426 - DNA, 694 bp, Panicum virgatum
  misc_feature: Ceres CLONE 2003047
  misc_feature: Encodes the peptide sequence at SEQ ID NO. 40427
atcatcacccgccgccgccgccgacatagccgaagcaccagcgcttgagcgtagttcaggagcgaggattggagtgatgtccgctgaggaggctgccgctgccgcgaccgaggtccccgagaccgaggtcgagtccgaggccccggccgccgaggaggcggaggccaagcccgccaaggccaagaaggcgccgaaggagaagaaggcgcccaaggagaagaaggcccccaaggagaagaaggagaagaagcccgccgcggcgaggaagacggccgcccacccgccgtacgccgagatgatctcggaggcgatcgcggcgctcaaggagaggaccgggtcgagctcggtggccatcggcaagtacgtggaggagaagcacggcgcgaagctgccgcccaacttccgcaagctgctggccgggcagctcaagaagctcgccgccgcggggaagctgacccgcgtcaagaactcgttcaagctgccggccgccgccgacgccaagcccaaggcggccaagcccgccgccgcggccaagccgaagccagccaaggccgccaagcccgcggtcaagcccaaggcgtccccgaaggccaaggccaagatcgccgccaagaccaagacggccgccgcctcccccaagcccaaggccaaggccgcccccgccgcggcgcccaggccccgcggccgccccgcc

SEQ ID NO: 40427 - protein, 205 aa, Panicum virgatum
  misc_feature: Ceres CLONE 2003047
  misc_feature (67)..(137): Pfam Name: Linker_histone Pfam Description: linker histone H1 and H5 family
MSAEEAAAAATEVPETEVESEAPAAEEAEAKPAKAKKAPKEKKAPKEKKAPKEKKEKKPAAARKTAAHPPYAEMISEAIAALKERTGSSSVAIGKYVEEKHGAKLPPNFRKLLAGQLKKLAAAGKLTRVKNSFKLPAAADAKPKAAKPAAAAKPKPAKAAKPAVKPKASPKAKAKIAAKTKTAAASPKPKAKAAPAAAPRPRGRP

SEQ ID NO: 40428 - DNA, 696 bp, Panicum virgatum
  misc_feature: Ceres CLONE 2003055
  misc_feature: Encodes the peptide sequence at SEQ ID NO. 40429
cagcgcttgcaacaactcatccatccagcaccgtatcgtgccctcatcacattcgcgcacaatggctcgcgctcagcaggtcgtggcgatcgccgtcgttgccgccgtcgtgctgctcgccgccgcggccacctccgaggccgccgtgacctgcgggcaggtgagctcggccatcggcccctgcatcgcctacgcccgcgggtccggctccggcccctcctcagcctgctgcagcggcgtgaggagcctcaactccgccgccaggagcaccgccgacaggcgcgccgcatgcaactgcctcaagtccgccgcaggcagggtgagcggcctcaacgccggcaacgccgccagcatcccgtccaagtgcggagtcagcatcccctacaccatcagcccatccgtcgactgctccaaggtggcttaatatcgtgatgagttggttggagcctgcatgctgcaaagcacatccaccgatatatctagctatcgtctatatatgatcgatcgagttcttgctagctcgctgatgaataaaatctctccgccgtcgctcatcatgtgagagacacggccggatcggatgtgtcggtccctgctacgttctgtacctgtctgctgcatgtacatctccatttccgtcccagagtctgtaccttgtccactaccttttaatacatacaccactttttggtatgt

SEQ ID NO: 40429 - protein, 120 aa, Panicum virgatum
  misc_feature: Ceres CLONE 2003055
  misc_feature (31)..(116): Pfam Name: Tryp_alpha_amyl Pfam Description: Protease inhibitor/seed storage/LTP family
MARAQQVVAIAVVAAVVLLAAAATSEAAVTCGQVSSAIGPCIAYARGSGSGPSSACCSGVRSLNSAARSTADRRAACNCLKSAAGRVSGLNAGNAASIPSKCGVSIPYTISPSVDCSKVA

SEQ ID NO: 40430 - DNA, 626 bp, Panicum virgatum
  misc_feature: Ceres CLONE 2003079
  misc_feature: Encodes the peptide sequence at SEQ ID NO. 40431
gagatggtaaaaaaggagcatcagagaaacctgaggcgcagatattcctgcagatggtagcagcattcggattgaaggataaattcgatggggagttcttgaggaggctgtttgttgctaatggacgaaagagggagctcgccaggattgcatgcgtacttggattcgaggagagccttggagatattgttgaggaactcataaagccagggaatgttgttgaggctatatatgtagctcatgaggctgatttgcttgagaaatttccacctgtccctctcctcaaaggttatctgcaggactgcagtgacaaggctcaggccgtgttgaaaagtggaaggcattccagttctgcacttgaagaggcaaacaacctggagggcaatgcatacaggtccgtcatcagatgtgttgaatcctgccagctacagtcagtgtttagcaccgaggtcataaagaagaagctagcgaagcttgagaaagagaaggcagagaggaagaagccaggtggcccaagcagattccagaacaagcgatcacggggggccgctagacctttccccttccctgctgccaaggctgcaaggggctcaagctcaagcttccagaacccagtctcacgttcc

SEQ ID NO: 40431 - protein, 207 aa, Panicum virgatum
  misc_feature: Ceres CLONE 2003079
  misc_feature (1)..(173): Pfam Name: Frigida Pfam Description: Frigida-like protein
DGKKGASEKPEAQIFLQMVAAFGLKDKFDGEFLRRLFVANGRKRELARIACVLGFEESLGDIVEELIKPGNVVEAIYVAHEADLLEKFPPVPLLKGYLQDCSDKAQAVLKSGRHSSSALEEANNLEGNAYRSVIRCVESCQLQSVFSTEVIKKKLAKLEKEKAERKKPGGPSRFQNKRSRGAARPFPFPAAKAARGSSSSFQNPVSR

SEQ ID NO: 40432 - DNA, 507 bp, Panicum virgatum
  misc_feature: Ceres CLONE 2003097
  misc_feature: Encodes the peptide sequence at SEQ ID NO. 40433
aaaaagaacttaaagatttttattaaagggatgaacagaattctcaagaagaaccaaggtcctaaggccaagaaggaacacttcaaattcaagattgactgcaaggaacccgctgatgactccgttatcgatgtcaacgatcttgctgaattcttgaagcaaagaattaaggtcaatggaaagaagggtaacctcggtgatgtcgtctccgtcgaaactgaaaagagcaacctcatcgtcactgccgaacccccattctccaagagatacttgaaatatttaactaagaaatatttgaagcaacacaaaattagagattacttacatgtcattgcctctgataagaccacttacaaggttaagtacttcaacattcaaaacgaagaaaacgaagaagaagccgaataaagaatgtagttctttttgcatagattatccgtcagcctcaatatttgtgtttccctatgtaccttgcataatataaacaatagacaaaccccatattcg

SEQ ID NO: 40433 - protein, 135 aa, Panicum virgatum
  misc_feature: Ceres CLONE 2003097
  misc_feature (23)..(134): Pfam Name: Ribosomal_L22e Pfam Description: Ribosomal L22e protein family
KKNLKIFIKGMNRILKKNQGPKAKKEHFKFKIDCKEPADDSVIDVNDLAEFLKQRIKVNGKKGNLGDVVSVETEKSNLIVTAEPPFSKRYLKYLTKKYLKQHKIRDYLHVIASDKTTYKVKYFNIQNEENEEEAE

SEQ ID NO: 40434 - DNA, 642 bp, Panicum virgatum
  misc_feature: Ceres CLONE 2003111
  misc_feature: Encodes the peptide sequence at SEQ ID NO. 40435
aatgttcgtgttgcacccagatggagctgctttagttcgcaagaccattgaaactggaaacgatatacttatggagaccttccggaaagccgtagcaccacctgtgcagccagcaaatttgcttacaatccttaaagctgtgacaaacttatttgacagctcatgcttgcaccagtggttgagaatccactgtgctgagatcattgattccgtgaccaactgcaagtcttcgtttaacaagaatgcacacttggcatatgccacacttttgctgaactatgctgttctttcgattgaatcaaaggatgaacagagtcaggcgcaaattctttctgctgcccttgaaattgcagaagatgaggctcaagattttgactccaaataccgggcactcgttgcaattggttcccttatgcaaaagggccttgtgaagtcccttgctctcgaccttgatgttaagagcgttgcaagcagcgcaaaggcttcaatggactcgaagattgctgaagtcggagctgacatcgaactgttaacacgatgagatgagaagagggctgaatgcagtttgggggaaattcctcctctcactggaggcgccgttgtgcgtgatttagccatggaactggggctcgcgtggcaagc

SEQ ID NO: 40435 - protein, 179 aa, Panicum virgatum
  misc_feature: Ceres CLONE 2003111
  misc_feature (1)..(174): Pfam Name: PUL Pfam Description: PUL domain
MFVLHPDGAALVRKTIETGNDILMETFRKAVAPPVQPANLLTILKAVTNLFDSSCLHQWLRIHCAEIIDSVTNCKSSFNKNAHLAYATLLLNYAVLSIESKDEQSQAQILSAALEIAEDEAQDFDSKYRALVAIGSLMQKGLVKSLALDLDVKSVASSAKASMDSKIAEVGADIELLTR

SEQ ID NO: 40436 - DNA, 706 bp, Panicum virgatum
  misc_feature: Ceres CLONE 2003124
  misc_feature: Encodes the peptide sequence at SEQ ID NO. 40437
gtggttctaaacaacacgaacaacccaagaaaaacttttcctagcggtgaacaatgtgcgggggcgccattctcgcggaactcatcccgtcgccgcgccgggcggcgtcgaagccggtgaccgcgggccacctctggccggcgggctccgacaccaagaaggccggcagcgggaggagcaagaggcaccagctcgccgacgtcgacgactttgaggccgccttcgaggacttcgccgacgattttgacaaggaggaggtcgaggaccaccatttcgtgttctcgtccaaatccgcattctccccagcccacggcgtgcgcgcggcgacccagaagaggcgcggccgccgccacttccgcggcatccggcagcgcccctggggcaagtgggcggcggagatccgcgacccgcacaagggcacccgcgtctggctcggcaccttcaacaccgccgaggacgccgcccgggcctacgacgtcgaggcacgccgcctccgcggcagcaaggccaaggtcaacttccccgcggccggcgcgcgcccacgccgcggcaactcgccgagaccgcagcgccaccatgccgcagcgcagcccgcgttgcttgcaggagagaagcggaaggaggaggagatcgtcgtgaagcctgaaattggggcgtcgttcgacttcgacgtgggcagcttcttcgacacgggcttccccgcggc

SEQ ID NO: 40437 - protein, 217 aa, Panicum virgatum
  misc_feature: Ceres CLONE 2003124
  misc_feature (99)..(150): Pfam Name: AP2 Pfam Description: AP2 domain
  misc_feature: Useful for making plants with altered lignin content
MCGGAILAELIPSPRRAASKPVTAGHLWPAGSDTKKAGSGRSKRHQLADVDDFEAAFEDFADDFDKEEVEDHHFVFSSKSAFSPAHGVRAATQKRRGRRHFRGIRQRPWGKWAAEIRDPHKGTRVWLGTFNTAEDAARAYDVEARRLRGSKAKVNFPAAGARPRRGNSPRPQRHHAAAQPALLAGEKRKEEEIVVKPEIGASFDFDVGSFFDTGFPA

SEQ ID NO: 40438 - DNA, 539 bp, Panicum virgatum
  misc_feature: Ceres CLONE 2003126
  misc_feature: Encodes the peptide sequence at SEQ ID NO. 40439
ctgcttcggccccttctcaaagcgcgagcgctgcggacggcatacaggagctccaggtccgactccgggaagaccctggccctcttcggcaagtccaaggccgcgccggcgaagaaggctcctgcgcccaaaccgaaggttgaggaggggatcttcggcacgtccggcgggatcggtttcaccaaggagaacgagctgtgcgtcggccgtgttgccatgcttggttttgccgcatccctactcggagaggccatcaccgggaagggcatccttgcccagctgaacctggagacgggcatccccatctacgaggcggagcccctcctcctcttcttcatcctcttcaccctcctcggcgccatcggcgctctcggagaccgcggcaccttcgtcgacgacgtgaccggcctcgacaaggccgtcatcccacccggcaagggcttccgtggcgccctcggcctcggcgaggaagggccgctgttcgggttcaccaagtcagaacaagctgttcgtgggggggctggcgcaactgggcgggg

SEQ ID NO: 40439 - protein, 179 aa, Panicum virgatum
  misc_feature: Ceres CLONE 2003126
  misc_feature (40)..(170): Pfam Name: Chloroa_b-bind Pfam Description: Chlorophyll A-B binding protein
  misc_feature: Useful for making plants with modulated light quality response
  misc_feature: Useful for making plants with modulated nitrogen use efficiency
LLRPLLKARALRTAYRSSRSDSGKTLALFGKSKAAPAKKAPAPKPKVEEGIFGTSGGIGFTKENELCVGRVAMLGFAASLLGEAITGKGILAQLNLETGIPIYEAEPLLLFFILFTLLGAIGALGDRGTFVDDVTGLDKAVIPPGKGFRGALGLGEEGPLFGFTKSEQAVRGGAGATGR

SEQ ID NO: 40440 - DNA, 574 bp, Panicum virgatum
  misc_feature: Ceres CLONE 2003127
  misc_feature: Encodes the peptide sequence at SEQ ID NO. 40441
gatgctgttctcttgttgttcatcaagctgtgaatgtgataacacttgtgccaacaaaccattccagcacagacctctgaagaataccaaattgattaagacagagaaatgtggatttggattggtagctgaggatgaaataaagaatggagaatttgttgtagaatatgtgggggaagttattgatgacagaacatgcgagaaaagattatggcaaatgaaaaggctgagtgacactaacttctacctttgtgaggtcagtagcaatatggtcattgatgctacagacaagggaaacatgtcccgatttataaaccatagttgtgaaccaaacacagagatgcagaaatggactgttgatggagagaccagagttggaatctttgctcttcgtgacatagagaaaggggaggagctgacttatgactataaatttgtccagtttggagcagatcaagattgtcattgtggatcttcatactgccgaaaaatgcttggaacaacaaagtcactcaactcactgcttcttcgaaatggctattcagttagctcacataatcagtatgtcaagaag

SEQ ID NO: 40441 - protein, 190 aa, Panicum virgatum
  misc_feature: Ceres CLONE 2003127
  misc_feature (21)..(150): Pfam Name: SET Pfam Description: SET domain
  misc_feature: SWISSPROT Homolog: EC 2.1.1.43 Histone-lysine N-methyltransferase
MLFSCCSSSCECDNTCANKPFQHRPLKNTKLIKTEKCGFGLVAEDEIKNGEFVVEYVGEVIDDRTCEKRLWQMKRLSDTNFYLCEVSSNMVIDATDKGNMSRFINHSCEPNTEMQKWTVDGETRVGIFALRDIEKGEELTYDYKFVQFGADQDCHCGSSYCRKMLGTTKSLNSLLLRNGYSVSSHNQYVK

SEQ ID NO: 40442 - DNA, 559 bp, Panicum virgatum
  misc_feature: Ceres CLONE 2003128
  misc_feature: Encodes the peptide sequence at SEQ ID NO. 40443
aactaacgctaaaaaagtaacagtttctgtactttattggttgccgaagatgcagatcttcgtgaagaccctcgcgggtcgcacgcttgcgctggatgtccagccgacggactcgatcgagcacgtcaagggcctcgtcgaggccgcggagggcgtctccgcgttccacctcgtcaccgacaagatgctcgaggagggcgcgacgctcggcgacttcggtgtcctggccgagtcgacgatccacgttgtgctggcggtcgatggtggtaagaagaagaagaagaagaagaagatcttcaagggcccgaagaagccgcaccaccgccataagaacgtgtcgatgcgcgtcctcaagttctacaaggttgagggcgacggcgaggatgctgagtacaaggtcacccacgaccgcatcgagtgcccgtccccgcagtgcggcgccggcgtgttcatggccgtccacaaggaccgccagcactgcggcaagtgctcgctgacgtacaagttcgacaagaagtaagcaccccggcaactctatcactttcaccgctctctcttg

SEQ ID NO: 40443 - protein, 156 aa, Panicum virgatum
  misc_feature: Ceres CLONE 2003128
  misc_feature (99)..(150): Pfam Name: Ribosomal_S27 Pfam Description: Ribosomal protein S27a
  misc_feature (6)..(71): Pfam Name: ubiquitin Pfam Description: Ubiquitin family
  misc_feature: Useful for making plants with modulated cold sensitivity
MQIFVKTLAGRTLALDVQPTDSIEHVKGLVEAAEGVSAFHLVTDKMLEEGATLGDFGVLAESTIHVVLAVDGGKKKKKKKKIFKGPKKPHHRHKNVSMRVLKFYKVEGDGEDAEYKVTHDRIECPSPQCGAGVFMAVHKDRQHCGKCSLTYKFDKK

SEQ ID NO: 40444 - DNA, 938 bp, Panicum virgatum
  misc_feature: Ceres CLONE 2003130
  misc_feature: Encodes the peptide sequence at SEQ ID NO. 40445
aacaaacgctaaaaaagtaacagtttctgtactttattgacaattcgtatttgcgttccatgcgcccagttctcctggcggcttgcgtgctcttggcggttggctgcacggccgctgtcacgggctcgaattcaatgaccgcgcagcagaagctgttcgtggaagctaagcgagcggcagaactcaaggccaaggttcttcgcgacacgccccagaccgtcaaggcgctgaacgtgacgcagttcctggggcgctggttcgaggtgtaccaagaccttgtgaccgccgccacgttccagcagaactccttctgcgcgaccgccgactacggcatcgacactgcgaatcccgcgcacgtcaccgtttccaaccgcgagcactacggggccatcgacgggccgcagaagaacgtctccggctacgcgtaccagccgaacccgaccgccgagccgggccagctcgtcgtctacctgcacggccagaacgcgtcgcccttccccgcgccgtactggatcctgcgcctcggcccggtcttcggtgaccactacgagtacgccatcgtgtcggacgagctgcgcctgacactgttcgtgctcgcgcgcaaccccgggcgcttctactcggccttcgagggcgaggtcctcgcgtggctcgcggcgaacggctttggcgagtggtggaacacgcctatcaagctgcagcaggacaactgcacgtacttccccgccaactaagccccgcgcgaagctgccgggcacgtgagacacgaagacaaaagctcactcgccccctaccagatactctctccgccacgcaattttaaagcgtttcgtcccgtggaagccctatttcatcgttgacaaccaaaccacagaaactgcccgacgaagcggcgcttggtgaccagttttcatcgcgcatgcgtaccgtcgttaatg

SEQ ID NO: 40445 - protein, 224 aa, Panicum virgatum
  misc_feature: Ceres CLONE 2003130
  misc_feature (57)..(200): Pfam Name: Lipocalin_2 Pfam Description: Lipocalin-like domain
MRPVLLAACVLLAVGCTAAVTGSNSMTAQQKLFVEAKRAAELKAKVLRDTPQTVKALNVTQFLGRWFEVYQDLVTAATFQQNSFCATADYGIDTANPAHVTVSNREHYGAIDGPQKNVSGYAYQPNPTAEPGQLVVYLHGQNASPFPAPYWILRLGPVFGDHYEYAIVSDELRLTLFVLARNPGRFYSAFEGEVLAWLAANGFGEWWNTPIKLQQDNCTYFPAN

SEQ ID NO: 40446 - DNA, 720 bp, Panicum virgatum
  misc_feature: Ceres CLONE 2003135
  misc_feature: Encodes the peptide sequence at SEQ ID NO. 40447
caccacagccacggttcgcgcatcctgcctcccctccctcctctcctctcaccaactaccaacctcgccgcgatccggtggatgcagcagcgcggccgctccttcaaccgccgctcccggagcttctcccgcgcccgtctcgccatcgagggatcttaatctcgcggcccacctcccctgaccggtcccctcggttctgagtttccgcctgaccaacaacgaacgcgcgcacgcatcgacctgccgtgatgaacgccgccgccgccaacgccgccgctgttgtttctgttgtttctgttaacgggaagatggaggtggaggagaggcatgcacagaagagctactgggaggagcactccaaggacctcaccgtcgaggccatgatgctcgactcccgcgccgccgatctcgacaaggaggagcgccccgagatcctgtctttacttcctccatatgaaggaaaatcagtgctggagcttggtgctggaataggtcgttttaccggagaacttgctaaaacagctgggaatgttcttgctctggatttcatcgaaagtgcgattaagaagaatcaaagtattaatggtcactacaagaacacatcctttatgtgtgctgatgtgacatcccaggacctggtgattcaagctagctccatcgatctgatattttcaaattggctattgatgtatctttctgatgcagagggtgagcagctag

SEQ ID NO: 40447 - protein, 157 aa, Panicum virgatum
  misc_feature: Ceres CLONE 2003135
  misc_feature: SWISSPROT Homolog: EC 2.1.1.103 Phosphoethanolamine N-methyltransferase
  misc_feature: The sequence is a functional homolog of SEQ ID NO 40 in US patent 7151202
MNAAAANAAAVVSVVSVNGKMEVEERHAQKSYWEEHSKDLTVEAMMLDSRAADLDKEERPEILSLLPPYEGKSVLELGAGIGRFTGELAKTAGNVLALDFIESAIKKNQSINGHYKNTSFMCADVTSQDLVIQASSIDLIFSNWLLMYLSDAEGEQL

SEQ ID NO: 40448 - DNA, 668 bp, Panicum virgatum
  misc_feature: Ceres CLONE 2003143
  misc_feature: Encodes the peptide sequence at SEQ ID NO. 40449
agaggaaggatgttaacttggatttaattaaagtagagggcaaggttggtggtaagctggaggacactgaactgatatatggaattgttgttgacaaagatatgagccacccgcaaatgccaaagagaattgaggatgctaagattgccattctgacatgcccattcgagcccccgaagccgaagacaaagcataaggtcgacattgacactgtagagaaattccagacgctgcgtgagcaagagcagaaatactttgatgaaatggttcagaagtgcaaggatgttggtgcgaccctggttatttgtcaatggggtttcgatgatgaagccaatcatttgttgatgcacagaaatctgccagctgtcagatgggttggtggtgttgaattggaattgattgccattgctacaggaggacgtattgttccgagattccaagagttgagtcctgaaaagcttgggaaggctggattagtccgagagaagtccttcggaactacaaaggaccggatgctttacattgagcagtgtgccaattccagagctgtaactattttcattcgtggtggaaacaaaataatgattgaggagactaagcgcagtcttcatgatgctctttgtgtggcaaggaatttgatccgcaataactcaattgtgtatgggggc

SEQ ID NO: 40449 - protein, 221 aa, Panicum virgatum
  misc_feature: Ceres CLONE 2003143
  misc_feature (1)..(221): Pfam Name: Cpn60_TCP1 Pfam Description: TCP-1/cpn60 chaperonin family
  misc_feature: SWISSPROT Homolog: EC 2.7.1.68 1-phosphatidylinositol-4-phosphate 5-kinase
RKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSPEKLGKAGLVREKSFGTTKDRMLYIEQCANSRAVTIFIRGGNKIMIEETKRSLHDALCVARNLIRNNSIVYG

SEQ ID NO: 40450 - DNA, 702 bp, Panicum virgatum
  misc_feature: Ceres CLONE 2003150
  misc_feature: Encodes the peptide sequence at SEQ ID NO. 40451
actccaacactactagctcgatcctccattccctcccgcactccaggcagcagtgctcctccagcgacactagctagctaagctcgccgggaagaagacgacgaccatggccgcgcgctgcccctacttcgccgccgaggagacgacccgcggcatccgccccggcgagtcccccgccgccgcgctccgccgcatcctcgcctcccccggcgcgcaccaggcgcccggctgcttcgacgccctcggcgcccgcctcgtcgagcaagccggcttccccatcgccttcatgagcggtttctgcgtctctgcggcacggcttggtttgcctgacgttggcctcatctcctacggagagatggtggaccagggccgtaagatcaatgaatccgtgtccatcccggtgcttggcgacggagacaatggctacggaaactctatgaacatcaagagaaccatcaaagggtacatcaacgctggtttcgccggaatcatgcttgaagatcaggtgtcgcctaaagcatgtggacatactgaaggaaggaaagtcgtctcaagggaggaggccgtcatgcacataaaggctgctgttgatgctaggaatgagagtggctctgaccttgtcattgtggcaaggacagattcacgtcagggcatttctttcgatgaggcaatatggagagcgaaagcttttgctgacgcccg

SEQ ID NO: 40451 - protein, 198 aa, Panicum virgatum
  misc_feature: Ceres CLONE 2003150
  misc_feature: SWISSPROT Homolog: EC 2.7.8.23 Carboxyvinyl-carboxyphosphonate phosphorylmutase
MAARCPYFAAEETTRGIRPGESPAAALRRILASPGAHQAPGCFDALGARLVEQAGFPIAFMSGFCVSAARLGLPDVGLISYGEMVDQGRKINESVSIPVLGDGDNGYGNSMNIKRTIKGYINAGFAGIMLEDQVSPKACGHTEGRKVVSREEAVMHIKAAVDARNESGSDLVIVARTDSRQGISFDEAIWRAKAFADA

SEQ ID NO: 40452 - DNA, 670 bp, Panicum virgatum
  misc_feature: Ceres CLONE 2003194
  misc_feature: Encodes the peptide sequence at SEQ ID NO. 40453
atcgcatctcctctcgctctctgttgtgtgactgattgccaagaaagctctctgcttgcttgtgttccagcctctgaatctcgtgaggatgtcgtgctgcggaggcaactgcgggtgcggctccggctgcaagtgcggctccggctgcggagggtgcaagatgtacccggacatgactgagcagggcaccaccaccaccagccagactgtcatcatgggcgttgcaccaaccaacaaggggcacgccgagggcggatttgaggccggcgccggagccgagaacggctgcacctgcaacccctgcacctgcaagtgaggagctcatggccatggccggaccggaggagatctgaagctagtatagcggcgttgtgtgtgcgtcgttcgtttgtctgaaagtgtgtgtggcatgcttaataacggtgttgcgcgtgctgctagtagatggtactgatggggaacaataataatgatggtgctgagatgtcgtcggcgtcgccgccgccgtcgtgtccttcctccccggccggtcgggcacctgtggcggtgctctagcagtgtgttgtgtgtgcagcagaccatgctctgatctttgtggtgtatgtgtgtggcctgctgcttggtgtccctagtgtcatgtgtacccatccatctatatctatctacatcc

SEQ ID NO: 40453 - protein, 75 aa, Panicum virgatum
  misc_feature: Ceres CLONE 2003194
  misc_feature (1)..(74): Pfam Name: Metallothio_2 Pfam Description: Metallothionein
MSCCGGNCGCGSGCKCGSGCGGCKMYPDMTEQGTTTTSQTVIMGVAPTNKGHAEGGFEAGAGAENGCTCNPCTCK

SEQ ID NO: 40454 - DNA, 636 bp, Panicum virgatum
  misc_feature: Ceres CLONE 2003211
  misc_feature: Encodes the peptide sequence at SEQ ID NO. 40455
actatacaaccgaaaattaccggacactactcaaacagtgcatggaactatcacaaaggaaggatagagcgactactctggcagccattgctgttgctccagaagtaaaaatcaaacaggattcgcggctaggtgacttggtatttggatcaatttctggattcacaggcaagctagttgaatacccattcgataccattaaagtgcatttgcagacgcaaccaaaccaaagtctatggacttgcattcgcagcatcgtcaaaacagaaggctttgctggattctatactggaatatcagctcctcttttgggttcgatggctgaaaatgctgttctattcttggcttatgctcaaattcagcaattgattagattttccactggaacaaaggaatcagatccacttagtaccgcccaattgtgctgcgctggggggctctctggtgcagtagtgtcttacgtccttactccagtcgaattgctcaagtgtcgtttgcaaatgcaggattaccttcctgaattggcttcaagtggaaaacgccatcacggtgcactatcactattcaaacatattgtcagaagtgaggggatttccggtttgtacaaagggcatactggtactgtgcttcgagaag

SEQ ID NO: 40455 - protein, 198 aa, Panicum virgatum
  misc_feature: Ceres CLONE 2003211
  misc_feature (28)..(114): Pfam Name: Mito_carr Pfam Description: Mitochondrial carrier protein
  misc_feature (123)..(198): Pfam Name: Mito_carr Pfam Description: Mitochondrial carrier protein
MELSQRKDRATTLAAIAVAPEVKIKQDSRLGDLVFGSISGFTGKLVEYPFDTIKVHLQTQPNQSLWTCIRSIVKTEGFAGFYTGISAPLLGSMAENAVLFLAYAQIQQLIRFSTGTKESDPLSTAQLCCAGGLSGAVVSYVLTPVELLKCRLQMQDYLPELASSGKRHHGALSLFKHIVRSEGISGLYKGHTGTVLRE

SEQ ID NO: 40456 - DNA, 642 bp, Panicum virgatum
  misc_feature: Ceres CLONE 2003236
  misc_feature: Encodes the peptide sequence at SEQ ID NO. 40457
aactaacgctaaaaaagtaacagtttctgtactttattgcttcaccacctccaagtcaagcacgatggccaccccgagcaagaagaccgcgacgcgcaaggccgcgagcggcaagaagacgtcgcagtcgaagaaggcgggcctgatcttcccggtgggccgcatcgcgtcgcagctgcgcaagggccgctacgcggcgcgcgtgtcgagctctgccgccgtctacttggcggcggtgcttgagtataccgtggctgaaatcctcgagctgtcggcgaaggctgtgctgcagcgcaacaagtcgaagcgcatcacgccgcgcgcgctgacgctggctgtgcgccacgacgcggacctgggcaccctgctgaaggacgtgacgctgtcgcgcggtggcgtcgtgcctaaggtggagaaggctctggaggccaagaagaagaagcgcagctcgaagaagtcgtcggcgacgccgaaggtgtaagtgagtgcgcgcacgccacacacgcccacccacacgcgggttgatttctctccgttcgggcgccgatgacaccaatagaagctacgtgcgctgctgctttggtagcagcgccgcggctggggtgaccgaccaaaaaggcatgcaccaccaccaccacgtgg

SEQ ID NO: 40457 - protein, 138 aa, Panicum virgatum
  misc_feature: Ceres CLONE 2003236
  misc_feature (21)..(95): Pfam Name: Histone Pfam Description: Core histone H2A/H2B/H3/H4
MATPSKKTATRKAASGKKTSQSKKAGLIFPVGRIASQLRKGRYAARVSSSAAVYLAAVLEYTVAEILELSAKAVLQRNKSKRITPRALTLAVRHDADLGTLLKDVTLSRGGVVPKVEKALEAKKKKRSSKKSSATPKV

SEQ ID NO: 40458 - DNA, 610 bp, Panicum virgatum
  misc_feature: Ceres CLONE 2003256
  misc_feature: Encodes the peptide sequence at SEQ ID NO. 40459
accgataacacactacgctactctacgctctcgccagctaggcgatcttacactgcgttccgcttccgcagcagcccagcccacccacacacgcacccacaatggcggggcgcatcgccgaggcggcggcgttcctggcactggcggtggttccagcggcgctggcgcaggcgccgggccccgcggcggcgccgagtgggccccccaacgagacggcgatcctggagaagggcgggcagtacacgaccttcatccggctgatgaaggagacgcagcacgacacgcagctcaacagccaactcaacagctccttcggcaacaacggcggcggctacacggagttcgcgcccaccgacaacgccttcaacaacctcaaggccggaacgctcaactccctcacccagcagcagcaggtgtcgatggtgcagggccacatcctgccaaatatctacagcatggactccttccagaccgccagcaaccccgtccgcacccaagcctccggccgggacgggccctacacgctcaacatcacctccgacaccaacaaccaggtcaacgtctcctacggcatcatataggtccgcatcaacgacgcgctctactccgc

SEQ ID NO: 40459 - protein, 159 aa, Panicum virgatum
  misc_feature: Ceres CLONE 2003256
  misc_feature (46)..(159): Pfam Name: Fasciclin Pfam Description: Fasciclin domain
  misc_feature: Useful for making plants with altered carbohydrate content
  misc_feature: Useful for making plants with altered cell wall content and/or composition
MAGRIAEAAAFLALAVVPAALAQAPGPAAAPSGPPNETAILEKGGQYTTFIRLMKETQHDTQLNSQLNSSFGNNGGGYTEFAPTDNAFNNLKAGTLNSLTQQQQVSMVQGHILPNIYSMDSFQTASNPVRTQASGRDGPYTLNITSDTNNQVNVSYGII

SEQ ID NO: 40460 - DNA, 687 bp, Panicum virgatum
  misc_feature: Ceres CLONE 2003259
  misc_feature: Encodes the peptide sequence at SEQ ID NO. 40461
aagtcaacaagaacacacaagagctagctagctgctcaacgtgtagtagctctctccacagccagcagctactagctcgatcgatcgatttaactaacaaaatgcagagcctcactatgaagccatcttccaagcagcagcagctcagcagcttgttgatcgtcgttgctgctgtcttgctgctaggcctcgccggagccgcgcacggcggcggcggcaggaagaagctcatcgtctcccgcagcgaggacgagccgtgcaagaagatgacggtgtactaccacgacatcctctacagcggcaacaacaccgccaacgcgacgtcggcggcggtgaccaagccggcggcggcgctgagcttgtcgcactggaagaacggcaccttcttcggcctgctggtggtgttcgacgacctggtgacggaggagcaggcgctgtcgtcggagccggtggcgcgcgcgcagggcttctacttctacgacaagaaggagcagtacaacgcgtggatggccttctccctcgtcttcaactcgacggcgtacacgggcaccctcaacctcatgggcgccgacctcatgtacgagaagacgagggacatctccgtcgtcggcggcaccggggacttcttcatgtcgcgcggcgtcgccacgctgagcctcaccggcgccgagggtaccgtctacttcc

SEQ ID NO: 40461 - protein, 195 aa, Panicum virgatum
  misc_feature: Ceres CLONE 2003259
  misc_feature (26)..(195): Pfam Name: Dirigent Pfam Description: Dirigent-like protein
MQSLTMKPSSKQQQLSSLLIVVAAVLLLGLAGAAHGGGGRKKLIVSRSEDEPCKKMTVYYHDILYSGNNTANATSAAVTKPAAALSLSHWKNGTFFGLLVVFDDLVTEEQALSSEPVARAQGFYFYDKKEQYNAWMAFSLVFNSTAYTGTLNLMGADLMYEKTRDISVVGGTGDFFMSRGVATLSLTGAEGTVYF

SEQ ID NO: 40462 - DNA, 702 bp, Panicum virgatum
  misc_feature: Ceres CLONE 2003276
  misc_feature: Encodes the peptide sequence at SEQ ID NO. 40463
aacaaacgctaaaaaagtaacagtttctgtactttattgctaaacgggagatgttcgcggcccacctccgcaagctccgcaaggcgaagcgctcgaagccgacgccgctcgagaacgacgtcgcgaaggctctgtacgagctggagctgaaccacaagacgctccgcgagcacctgccgcgcttccacatcaacaccgccaaggccgttgagacgaagtcgtcgcagaagaaggctgttgtggtcttctacccgctgcgctacctgtcgctggtgcgccagatccagaccgtgctgacggccgagctggagaagcgcttctcgggcaagatcgtcgccctcgtcgcgcagcgcaagatcacgcgccgcccgtccaacatctacgcgctccagcaggtgcagcgctcgacgacccgcacggcggtctacgagaacatcctcaacgacctcctgttccccgctgacgtcgtcggccgccgctggcgctaccgcgtggacggctcgaagatcatgaaggtgtacctggactccgtgatgcgcaagcgcatggactcccgcctgccgctcatcgccgcgctgtacaagaagctgacccagcgcaccgtgaccttcggctacatgtggaacccgcgtctccagcaggtctcgcacaagtaagcgaatgcttccgcttagcagcatgttccgcctccgtactgtttgg

SEQ ID NO: 40463 - protein, 201 aa, Panicum virgatum
  misc_feature: Ceres CLONE 2003276
  misc_feature (7)..(194): Pfam Name: Ribosomal_S7e Pfam Description: Ribosomal protein S7e
MFAAHLRKLRKAKRSKPTPLENDVAKALYELELNHKTLREHLPRFHINTAKAVETKSSQKKAVVVFYPLRYLSLVRQIQTVLTAELEKRFSGKIVALVAQRKITRRPSNIYALQQVQRSTTRTAVYENILNDLLFPADVVGRRWRYRVDGSKIMKVYLDSVMRKRMDSRLPLIAALYKKLTQRTVTFGYMWNPRLQQVSHK

SEQ ID NO: 40464 - DNA, 1529 bp, Panicum virgatum
  misc_feature: Ceres CLONE 2003283
  misc_feature: Encodes the peptide sequence at SEQ ID NO. 40465
gaatggcggcgggccgcaggccctcgcgtacaaacgcagcgcggccgcgctcgcggggctcgccgctgcacacgcataagcgcacccgcctcgtcgagcccgagacgaagcccagggaggcatacgaaccgagggaatcagcctgcgcgctgcgccatggccctttccgagagctcgaggaatgcgctgcttcccgccttcctctacgcgtcccctgccaccgccggtggcgtgggcggacgcgcggtcgccgctccgtctgcggcggggcccgcggtgtgggcgcgggcgccgagcgagccgggccggaggatagagatgtactcgccggcgttctacgcggcgtgcacagccggtggtatcgccagctgtgggctcacgcacatgacggtcacgccgctcgacctcgtcaagtgcaacatgcagatcgatccggctaagtacaagagcatctcttctggttttggtgttttgttgaaagagcaaggcgccaagggttttttcagaggctgggtacccaccttgcttggatacagtgctcagggagcatgcaagttcggtttctatgaattcttcaagaagtattactcagacattgctggccctgagtatgctgcaaagtacaagaccttgatttaccttgcgggatctgcttcggctgaactcattgcagatattgccctctgtccaatggaggctgtgaaggtccgtgtgcaaacacagcctggctttgcaagaggtttgtctgatggtcttcccaagtttgttaaatctgaaggctatgctgggctttataaaggaattgttcctctctggggccgacaaattccatacactatgatgaaatttgcctctttcgagacggttgttgagatgatctacaaatatgccatccctgcacccaagagcgagtgcagcaagaatctccagcttggagtgagctttgcagggggatacattgctggggtgttctgtgcagtcgtttctcacccagctgacaaccttgtttccttcctcaacaatgctcagggggcaactgtaggcgatgctgtgaagaagattggcctagtggggctatttacccgtgggctgccattgcggatagtgatgattggcaccctaactggagcccaatggggtatctatgacgctttcaaagtcatggttggactgccaactactggtggcgttgctccaacacctgctgcagctaaggcctgaacctacactgatgagcttcaaacaacaattttggcgctaacctggatgatgaccaaacagctcctctttccctgtctttcggagcaactctttaattcttttaggaacgcctaactgcgtgcctgctaaaatttcagatgagccacaagctcagtacatggtgctaactagaagaagagagatttaggaacatgtttagtagatggtcatcaggtgcatgatgactgccgtggaaaccatggcgtccttttttttttttttgcatgtcatcattctggaaacgcaaatttttatagccccttttgact

SEQ ID NO: 40465 - protein, 354 aa, Panicum virgatum
  misc_feature: Ceres CLONE 2003283
  misc_feature (60)..(148): Pfam Name: Mito_carr Pfam Description: Mitochondrial carrier protein
  misc_feature (157)..(245): Pfam Name: Mito_carr Pfam Description: Mitochondrial carrier protein
MALSESSRNALLPAFLYASPATAGGVGGRAVAAPSAAGPAVWARAPSEPGRRIEMYSPAFYAACTAGGIASCGLTHMTVTPLDLVKCNMQIDPAKYKSISSGFGVLLKEQGAKGFFRGWVPTLLGYSAQGACKFGFYEFFKKYYSDIAGPEYAAKYKTLIYLAGSASAELIADIALCPMEAVKVRVQTQPGFARGLSDGLPKFVKSEGYAGLYKGIVPLWGRQIPYTMMKFASFETVVEMIYKYAIPAPKSECSKNLQLGVSFAGGYIAGVFCAVVSHPADNLVSFLNNAQGATVGDAVKKIGLVGLFTRGLPLRIVMIGTLTGAQWGIYDAFKVMVGLPTTGGVAPTPAAAKA

SEQ ID NO: 40466 - DNA, 1091 bp, Panicum virgatum
  misc_feature: Ceres CLONE 2003290
  misc_feature: Encodes the peptide sequence at SEQ ID NO. 40467
aaatagtggcttttgctctgctttcttgcgttcgcgagaaagccaattcttgttgcttgttttggttggggcgagcgcaaagcaaatgtcatcagaagaccaggttgcaccacttgcaacacgagtagaagagataagaggacgagatggtgcctctgatttcgaaaagcttgcagcctttggccagcttctcagtgaaacggaagaggcgaacttgatcctggtgttggaagctgccaaaccagcgcttgagaatgttctgacagcattccgaacagcattgaacaaggtgactagcccttctgattcccttggttccttgaaaacaaatgtcaccaacttttttgaacctccagctcctgttgtctctgctgcccctcctccacctggacctcctcctccacctggacctccccctccagctggcggacctcctccacctcctggccctcctccacctcctggtggtccaccaccaccacctggtcctccacctcctccgggtggtccaccgccacctcctggtggtcctcctccactcgcaggtggcagcggtggtggtggcggtggtcgtggggatctgttggcagccattcaaagaggtaagtcgttgaagaaggcagccacaccagcacccagaccagctgcctcccctgctgcggcttcgaagccagctggcggtggtggtggcactggtgatctgatggctgccattgccggtggtgcacgtgcaggccttcgcagcggtgctgtgcgagagctcggaccggcaagcccgaggaaactctccccgcaggaagaactcatggctcgcatccaaagcggtggcgctttaaagaaggttgaacgccctgccgaagcctcacctgctcgtcctgccgattctcctgcatcccctctctccttctctctccgtaaaactccaactccttcccgcgatccccctgctgaaacaactcgttcccaatctgtcccctttgtgcagctccgaaagaccggtggtcctggaacacccagcagcagtccagctccaggctcatcgtcttagcatcgctctccgaataaaacacatcaaagaatccttgaaaaag

SEQ ID NO: 40467 - protein, 348 aa, Panicum virgatum
  misc_feature: Ceres CLONE 2003290
  misc_feature (190)..(207): Pfam Name: WH2 Pfam Description: WH2 motif
NSGFCSAFLRSRESQFLLLVLVGASAKQMSSEDQVAPLATRVEEIRGRDGASDFEKLAAFGQLLSETEEANLILVLEAAKPALENVLTAFRTALNKVTSPSDSLGSLKTNVTNFFEPPAPVVSAAPPPPGPPPPPGPPPPAGGPPPPPGPPPPPGGPPPPPGPPPPPGGPPPPPGGPPPLAGGSGGGGGGRGDLLAAIQRGKSLKKAATPAPRPAASPAAASKPAGGGGGTGDLMAAIAGGARAGLRSGAVRELGPASPRKLSPQEELMARIQSGGALKKVERPAEASPARPADSPASPLSFSLRKTPTPSRDPPAETTRSQSVPFVQLRKTGGPGTPSSSPAPGSSS

SEQ ID NO: 40468 - DNA, 689 bp, Panicum virgatum
  misc_feature: Ceres CLONE 2003293
  misc_feature: Encodes the peptide sequence at SEQ ID NO. 40469
gtcgacgccgcggcaaacctctgcgccaccacgggaggagaccgcggccatggtggcgatggagctggagatcctgggcatgaacttcgggtgcgtcctcgcggcgctgagcgacgccaagatccccgacaagggctgcctcctcccgctcatctccaagctgctcggctacgccatcgtcgccgcatccaccaccgtcaagctcccccagatactgaaaattttgaagcatggaagtgttagaggacttagtgtagcatcctttgagcttgaggtcgttggctacacaattgctttggcatattgtattcataaaggacttcccttttcagcttatggagagcttgcttttctgttaatccaagcgattatcttggttggaatcatttactattactccccgccaatgggaaccaaaacatggatgaaagctttattatattgtggactggctccaaccgttttgactggaaaaattgatcctgctctttttgaagtcctctatgcttcacagcatgctatcttcttttttgctagagttccacagatatggaagaattttacgaataagggcactggcgagctcagctttcttacctgtttcatgaactttgctggttctattgtaagagtttttaccagcatccaggagaagactcccttaagtgtgatcatgggctctgcaattg

SEQ ID NO: 40469 - protein, 213 aa, Panicum virgatum
  misc_feature: Ceres CLONE 2003293
  misc_feature (32)..(98): Pfam Name: PQ-loop Pfam Description: PQ loop repeat
  misc_feature (155)..(210): Pfam Name: PQ-loop Pfam Description: PQ loop repeat
MVAMELEILGMNFGCVLAALSDAKIPDKGCLLPLISKLLGYAIVAASTTVKLPQILKILKHGSVRGLSVASFELEVVGYTIALAYCIHKGLPFSAYGELAFLLIQAIILVGIIYYYSPPMGTKTWMKALLYCGLAPTVLTGKIDPALFEVLYASQHAIFFFARVPQIWKNFTNKGTGELSFLTCFMNFAGSIVRVFTSIQEKTPLSVIMGSAI

SEQ ID NO: 40470 - DNA, 720 bp, Panicum virgatum
  misc_feature: Ceres CLONE 2003302
  misc_feature: Encodes the peptide sequence at SEQ ID NO. 40471
gacaaaattggccacactacaattgatttgggtattgcccaagagaacgtagaagcttgccaagaccttgatatcaaaggtactgaccctacggacagattaaagttagtaaaggggcatcttgtttcttttcctttggatttcatgtgccaagaggacttgagaccatatttcagtgaaagtgagtattacacatcaccacaggttttccattagcttctatctcatgaagttactcactcggctgtacatattgcaaagagcagcttgtagatgctttacaaattttgtcaataggaaagaaaaaagaaacaaagatattaccatactattatagagatactagaagtatagtttcctagaaagagaatagtatacaagtacagttcattagacacctgttcaatttttcggcaagaaacactcaaattcattatttgccagtgcaactaatataggtcttacgttagctgtacacattgcctcaggcaagaaatacatcttgttgccagaagtacattttttcccctatcttgctgtgtgtatgtgttatagtttttactgaggatatttgacaattaaacatatgctggacgcactgttcgtttgccccgagttggagggacaatacatgtatatgtcctgtgttgaagcttctctagtatggccaacataagaattgctcggatttgtgtacatctaagtctttgaagcactgaa

SEQ ID NO: 40471 - protein, 71 aa, Panicum virgatum
  misc_feature: Ceres CLONE 2003302
  misc_feature: SWISSPROT Homolog: EC 3.1.4.4 Phospholipase D
DKIGHTTIDLGIAQENVEACQDLDIKGTDPTDRLKLVKGHLVSFPLDFMCQEDLRPYFSESEYYTSPQVFH

SEQ ID NO: 40472 - DNA, 683 bp, Panicum virgatum
  misc_feature: Ceres CLONE 2003311
  misc_feature: Encodes the peptide sequence at SEQ ID NO. 40473
gtgctctctcagaggtgggttggcttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggtggcggcggcggctacggcggcggtcgtcagggtggctacggcggcggcggcggcggctacggaggcggtggtggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatcggccggcagcgacgacgcagaagagagcctcctagcttcttactccaagctaaagcttcagtgtcggcagcaagcagcggcggaagag

SEQ ID NO: 40473 - protein, 158 aa, Panicum virgatum
  misc_feature: Ceres CLONE 2003311
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
MAAADVEYRCFVGGLAWATDNASLQQAFASYGDVLDSKVITDRETGRSRGFGFVTFSSEQSMLDAIEAMNGKDLDGRNITVNQAQSRGGGGGGGYGGGRQGGYGGGGGGYGGGGGGGGYGGGRREGGYGGGGGGGRREGGYGGGGYGSRGDSGGNWRN

SEQ ID NO: 40474 - DNA, 527 bp, Panicum virgatum
  misc_feature: Ceres CLONE 2003315
  misc_feature: Encodes the peptide sequence at SEQ ID NO. 40475
accaatctcaccttgaatccacaacccgtctggtcgtcggcaagcatgtctgggcgcggcaagggcggcaaggggctgggcaagggcggcgcgaagcgccaccggaaggtgctgcgcgacaacatccagggcatcaccaagccggcgatccggcggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcactgccatggacgtagtctacgcgctcaagcgccagggccgtaccctctacggcttcggcggctaggctgaggcactcgccccctcgctgtctcccttctgcagctacgacgttatctgggcattgctcacaggtcttgctgtcaagaaagtctcagattcgcttgattagctcatctctggctgtagtaggtttatctgaaccatgagacattaatgaattgaagttaccttgtg

SEQ ID NO: 40475 - protein, 103 aa, Panicum virgatum; identical to SEQ ID NO: 12044
  misc_feature: Ceres CLONE 2003315
  misc_feature (25)..(94): Pfam Name: Histone Pfam Description: Core histone H2A/H2B/H3/H4

SEQ ID NO: 40476 - DNA, 746 bp, Panicum virgatum
  misc_feature: Ceres CLONE 2003322
  misc_feature: Encodes the peptide sequence at SEQ ID NO. 40477
atcgcagctcgcagcagcagcaccaccaccaccaaacagctagagcagcagcaacactagcaaggaagctagagagatcgtcgagatggcgaggaagggcggtgcggcggcggcggcggtcgtggtgctggcggcgctcctggtcctggcggcggcgaggccggccgagggcgccgtgacgtgcgcggaggtggacttgaacctgcgcccctgcgtcgggtacgtgacggggaaggacgcggcgccgcccgccgagtgctgcgccggcgtgcggcggatccgggcgctgccgtcgggcacggcggagcggcggcaggcgtgcgagtgcgtgaagcaggcggcggcgaggttcccggggctcaacgccgatgccatccgcgtcctcccggcgcagtgcggctcgccgctgccgttcccgctcaccctcaacttcgactgcaccacgtatacaagctaactttatgagcgcgcgcgcgcgcgcgcacacacacacacacaaatttgctagcttttctttattaccgcgtacatatactaattagtgtttttttcattttggttcctggctttgcagaattccatgagctaatgatgaacaacacatgaagcaaagaggccatcctgaaaatggagagagatctgctagacgggttcactctgaatgaactagttgcttgctagctcttgcaataaggcccttgctttgcaagctagtttctatctaatgcactatttgaaataatgta

SEQ ID NO: 40477 - protein, 123 aa, Panicum virgatum
  misc_feature: Ceres CLONE 2003322
  misc_feature (33)..(118): Pfam Name: Tryp_alpha_amyl Pfam Description: Protease inhibitor/seed storage/LTP family
MARKGGAAAAAVVVLAALLVLAAARPAEGAVTCAEVDLNLRPCVGYVTGKDAAPPAECCAGVRRIRALPSGTAERRQACECVKQAAARFPGLNADAIRVLPAQCGSPLPFPLTLNFDCTTYTS

SEQ ID NO: 40478 - DNA, 715 bp, Panicum virgatum
  misc_feature: Ceres CLONE 2003326
  misc_feature: Encodes the peptide sequence at SEQ ID NO. 40479
aatttgctctttgcgtatcaattcaaactgcttctcttccatgtcagaaagcaaatcatctgcagggcaagcgagcgccaaatctggtgcaggagatttgtttaaaggccaagaaaaacaacgtgatgttcgcacgtcgaacattgtggctgctcgtgcggtttcaaatgctattcgcacctcattgggaccaaaaggaatggataagatgattatttctgcgaacaatgacgttgttattacaaacgacggcgccatcatcttggcgaaaatggaggttcagcacccagctgccaaaatgttgtgcgatatttccaaagcacaggacgtagaagctggtgatggcacaactagtgtggtggtcttagctggttcactgctcgaagctgctcaagacttgttgaacaaaggaatccatgcatcactaatttcagaagcctttcttgccgccaacaagcgcgccttagaaattcttcgctccattgcaatccctgtttcgctctctgatcgcgaccaactcatcaagagtgcgatcacttctttgaattccaaggttgtgtcggagaactccaaattgctggcgcccctcgctgtcgatgctgtgcttcgcataatggacgagaagtcagacaagtctgttgacttgaacaatattcgtgtcaccaagaaactcggtggcactgttgaggacactgagctgatcaacggtctcatc

SEQ ID NO: 40479 - protein, 224 aa, Panicum virgatum
  misc_feature: Ceres CLONE 2003326
  misc_feature (41)..(224): Pfam Name: Cpn60_TCP1 Pfam Description: TCP-1/cpn60 chaperonin family
MSESKSSAGQASAKSGAGDLFKGQEKQRDVRTSNIVAARAVSNAIRTSLGPKGMDKMIISANNDVVITNDGAIILAKMEVQHPAAKMLCDISKAQDVEAGDGTTSVVVLAGSLLEAAQDLLNKGIHASLISEAFLAANKRALEILRSIAIPVSLSDRDQLIKSAITSLNSKVVSENSKLLAPLAVDAVLRIMDEKSDKSVDLNNIRVTKKLGGTVEDTELINGL

SEQ ID NO: 40480 - DNA, 1242 bp, Panicum virgatum
  misc_feature: Ceres CLONE 2003341
  misc_feature: Encodes the peptide sequence at SEQ ID NO. 40481
ataaaccctcgtccccccttctctctcatccccacatctctcgacctaccggacgcggcagccaaaccctagcctccccctcgacccgcccttccggccaccgcgtgttcagcggtgaaggatgagcaggcgctggagccgcacgatctacgtcgggaacctcccgggcgacatccgggagagggaggtggaggatctcttctacaagtatgggagaattgttgacattgacttgaaggttcccccgaggccacctggttatgcttttgttgagttcgaaaatcctcgtgatgctgaagatgcaattgctgggcgggatggatacaattttgatggacaccgcctaagagtcgaacccgctcacggtggtagaggtaatgcttcctcatatgaccgttcaggtggctttggtggtggagcacgacgtggtgtgtcaaagcactcagagtatcgtgttcttgtcagtggactgccttcttctgcatcatggcaggatttgaaggatcatatgcggaaggctggtgatgtttgtttctctgaagtgtaccgtgaaggcggtggcaccattggaattgtggactacacaaactatgatgacatgaaatatgctataaagaagctggatgatactgaattcaggaacgcctttgggcgagcttatataagggtgaaggaatatgatggcaagcgtggtcgctcctactcacgtagccgaagcccaagtcgtagctacagcagaagcaggagcccgagcaaatcaccaagagctcgccgctcagcatctagatcccggtcgaggtctgtttcttcccgttcaaggtctgcatcaaaagggcgttctccgtcaagatcaccagcaagatccaaatctcctaatgcttctccagcaaatggtgaagcagcaagccccaagaagcagagcccaagcagaagcccatctggctcacgctctcctgatgcgaaacctgaataaaactggtgtgctcgacgaggcattgcagatgggagtccagagctcagctttgtctggacacctgatgtcctccatattgttctagtaccatcgctgtcctagcaactgtgcaatgagattggatattaactatcagtttgtatcgttggaccccccactttgttatgttttctggcccgctgaagggctcatttttacttcaattattcgtggctgttgaatgctatgtggatttggattatgttgactaaatcatgttgttctggacc

SEQ ID NO: 40481 - protein, 283 aa, Panicum virgatum
  misc_feature: Ceres CLONE 2003341
  misc_feature (9)..(77): Pfam Name: RRM_1 Pfam Description: RNA recognition motif. (a.k.a. RRM, RBD, or RNP domain)
  misc_feature (112)..(179): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with altered lignin content
MSRRWSRTIYVGNLPGDIREREVEDLFYKYGRIVDIDLKVPPRPPGYAFVEFENPRDAEDAIAGRDGYNFDGHRLRVEPAHGGRGNASSYDRSGGFGGGARRGVSKHSEYRVLVSGLPSSASWQDLKDHMRKAGDVCFSEVYREGGGTIGIVDYTNYDDMKYAIKKLDDTEFRNAFGRAYIRVKEYDGKRGRSYSRSRSPSRSYSRSRSPSKSPRARRSASRSRSRSVSSRSRSASKGRSPSRSPARSKSPNASPANGEAASPKKQSPSRSPSGSRSPDAKPE

SEQ ID NO: 40482 - DNA, 1037 bp, Panicum virgatum
  misc_feature: Ceres CLONE 2003369
  misc_feature: Encodes the peptide sequence at SEQ ID NO. 40483
aaagtcaacaagaacacaagagctagctagctgcgctcaacgtgtagctcgatcagcagctatactagctagctcttatcgaccaaaagatctagtcgtcgttgcattatattcatcgatcgatcgatcgattgagctaacaatgcagggcctcagtatgaatccatcttccaagcagctcagcagcttgtcggtcgtcgttgctgctgtcttgctgctagggctcgccggagtcgcgcacggcggcaggaggctcatcgtctcccgcagcgaggacgagccgtgcaagaagatgacggtgtactaccacgacatcctgtacagcggcaacaacaccgccaacgcgacgtcggcggcggtgaccaagccggcggcggcgctgagcacgtcgcactgggcgaacggcaccttcttcggcctgctggtggtgttcgacgacctggtgacggaggagcaggcgctgtcgtcggagccggtggcgcgcgcgcagggcttctacttctacgacaagaaggagcagtacaacgcgtggatggccttctccctcgtgttcaactccacggcgtacacgggcaccctcaacctcatgggtgccgatctcatgtacgagaagacgagggacatctccgtcgtcggcggcaccggggacttcttcatgtcgcgcggcatcgccacgctaagcctcgtcgcctacgagggtaccgtctacttccgcctcaagatggacatcaagctctacgagtgctacgtcaaagaccactgaccacgcacacatactgccgcttcacaatcacatgcatgcacgtctcgatcgtatctatatattctatatagatgcaactcactaagtgtcataattgtatttctctcaatcctcgtgctgccatgtgcccatgtcatcaatccactaagtgccgtgttgctatgtcataaacccactaagtgtcataatttctatttctctcagtcatgtttttcaatatgttgcggttcatcaaaagtataaataaagaagaagcccaacagccaaatttttc

SEQ ID NO: 40483 - protein, 206 aa, Panicum virgatum
  misc_feature: Ceres CLONE 2003369
  misc_feature (23)..(198): Pfam Name: Dirigent Pfam Description: Dirigent-like protein
MQGLSMNPSSKQLSSLSVVVAAVLLLGLAGVAHGGRRLIVSRSEDEPCKKMTVYYHDILYSGNNTANATSAAVTKPAAALSTSHWANGTFFGLLVVFDDLVTEEQALSSEPVARAQGFYFYDKKEQYNAWMAFSLVFNSTAYTGTLNLMGADLMYEKTRDISVVGGTGDFFMSRGIATLSLVAYEGTVYFRLKMDIKLYECYVKDH

SEQ ID NO: 40484 - DNA, 685 bp, Panicum virgatum
  misc_feature: Ceres CLONE 2003390
  misc_feature: Encodes the peptide sequence at SEQ ID NO. 40485
atcgtcctagctcccagaactcctcagtcctcactaccagcgctgcctctgctcactcgccgtccattcctcttccctctcgagcaagctcgtcagcatgtcgacggtgtcccttgaccagaagcttgccctcgccaagcgctgctcgagagaagccaccctcgctggagccaaggcagctgctgtagccaccgtcgcctccgcgatccccaccctggcgagcgtgcggatgctgccgtgggccaaggccaacatcaaccccaccggccaggccctcatcatctccacagtcgccggcatggcctacttcatcgcggcggacaagaagatcctctcgctggcgaggcggcactcgttcgagaacgcccccgagcacctcaggaacacctcctaccagggcaccggccgtccccacccggccttctccaggccctgatcggctcgcaagcacattaaagacccgtgctgccctgcgctctagcctcatctagatatgtataccgtgtgtgtgtgtatgcttgctgcaataataagcaggcctctgcagagcaggccggcaggtagctgcctgctctaagcttattagcatgggaagcttctgcagtgtggcgtagtctttgaatatatgcgtccatgccgtgtactattactctgtcgcggtaatgaaatactactagttcttgtc

SEQ ID NO: 40485 - protein, 112 aa, Panicum virgatum
  misc_feature: Ceres CLONE 2003390
  misc_feature (8)..(86): Pfam Name: ENOD93 Pfam Description: Early nodulin 93 ENOD93 protein
MSTVSLDQKLALAKRCSREATLAGAKAAAVATVASAIPTLASVRMLPWAKANINPTGQALIISTVAGMAYFIAADKKILSLARRHSFENAPEHLRNTSYQGTGRPHPAFSRP

SEQ ID NO: 40486 - DNA, 709 bp, Panicum virgatum
  misc_feature: Ceres CLONE 2003394
  misc_feature: Encodes the peptide sequence at SEQ ID NO. 40487
cccttttgactcctcccacctgcaaaaccgcgggccgcatcccacccgcgccgcccaccggcggcagccagccggtgctcgaggacggccgcgtcttcgagaaggccggggtcaatgtgtccgtcgtgtacggggtcatgccgccggatgcgtaccgcgcggccaagggggaggccgggaagaaaggcgccgcggaggcgcagaaggctggccccgtgcccttcttcgccgcggggattagctcggtgctccatcccaaaaatccatttgctcctacattgcattttaactaccgttactttgagacagatgcaccaaaagacgctcctggtgcaccaagacaatggtggtttgggggtggtactgacttgactccttcatacattattgaagaggacgtgaagcatttccattctgttcaaaaacaagcatgcgataaatttgatccaagttttcacccaagattcaaaaagtggtgtgatgattatttctatattaagcaccgtaatgagagacgcgggcttggtggaatattttttgatgatcttaatgattatgatcaagaaatgcttctcaactttgccacagaatgtgcggactctgtacttcctgcatacgtaccaatcatagagcggcgtaaggacactccatttcccgaggagcacaaggcatggcagcaactgcggagaggtcgttatgtggagttcaa

SEQ ID NO: 40487 - protein, 235 aa, Panicum virgatum
  misc_feature: Ceres CLONE 2003394
  misc_feature (2)..(235): Pfam Name: Coprogen_oxidas Pfam Description: Coproporphyrinogen III oxidase
  misc_feature: SWISSPROT Homolog: EC 1.3.3.3 Coproporphyrinogen oxidase
LLTPPTCKTAGRIPPAPPTGGSQPVLEDGRVFEKAGVNVSVVYGVMPPDAYRAAKGEAGKKGAAEAQKAGPVPFFAAGISSVLHPKNPFAPTLHFNYRYFETDAPKDAPGAPRQWWFGGGTDLTPSYIIEEDVKHFHSVQKQACDKFDPSFHPRFKKWCDDYFYIKHRNERRGLGGIFFDDLNDYDQEMLLNFATECADSVLPAYVPIIERRKDTPFPEEHKAWQQLRRGRYVEF

SEQ ID NO: 40488 - DNA, 667 bp, Panicum virgatum
  misc_feature: Ceres CLONE 2003401
  misc_feature: Encodes the peptide sequence at SEQ ID NO. 40489
gaccagggtttctactggtctttgcattcttggttgcgcagctgattgctacgctgattgctgtgtacgctgactgggcattcacttcaatcaaaggcattgggtggggctgggctggtattgtgtggctttacaacatcatcttctacttcccgctcgatatcatcaagttcctcatccgatatgctctgagtgggaaagcatgggatctggtcattgagcaaaggattgcattcacaaggaagaaggactttggcaaggaggagagggagctgaagtgggcacatgcacagaggaccctccatgggctgcaggcaccggatgccaagatgttcccagagaaggctgggtacaatgagctgaaccagatggctgaagaggcgaagaggagggctgagattgcaagactgcgggagcttcacacactcaagggacatgtggagtctgttgtgaagctgaaggggctcgacattgagaccatccagcagtcctacacggtttgatatcgcctgtccccagaagttttttttaaaaaaatctttctttctctttttggccaccgaagtgtgacttttacggtggctggactctctttgttttatttaactgaactggagtcacatccccagacaagtacttgaaatgagacggaatcgcttgatctctc

SEQ ID NO: 40489 - protein, 166 aa, Panicum virgatum
  misc_feature: Ceres CLONE 2003401
  misc_feature: SWISSPROT Homolog: EC 3.6.3.6 Proton-exporting ATPase
PGFLLVFAFLVAQLIATLIAVYADWAFTSIKGIGWGWAGIVWLYNIIFYFPLDIIKFLIRYALSGKAWDLVIEQRIAFTRKKDFGKEERELKWAHAQRTLHGLQAPDAKMFPEKAGYNELNQMAEEAKRRAEIARLRELHTLKGHVESVVKLKGLDIETIQQSYTV

SEQ ID NO: 40490 - DNA, 674 bp, Panicum virgatum
  misc_feature: Ceres CLONE 2003413
  misc_feature: Encodes the peptide sequence at SEQ ID NO. 40491
agatgtatatacatactcatcgacgggtctccttgcgcatccctgtacaaatcgaagcaaatttccactcctccgcggggcagctaccgtgcagcggcggaggggataagcgagcgacctcgaagctcggccggcgcggcgatggaggtcaagtgccggcgcctggaggggaaggtggccgtcgtgacggcgtccacgcaggggatcggcctcgccatcgctgagcgtctcggcctggagggcgccgccgtcgtcatctcctcccggaagcagaagaacgtggacgacgcggtgaaggggctcaaggcaaaggggatcacggcggtcggggccgtctgccacgtctccgacgcccagcagcgcaagagcctcatcgacacggcagtcaaggtcagaattgggggagaagggggtttcagtctctcagatgggttacattgcgtagtcagatttcttttgctgctctgctcagcgatcccgtcaggcctcctggcggttgatgttgtgccgaaccttgttgcattgttaattaagcttcgacgattgcaaatgtgcatcaggaacgctggtttagttgttttacgctactgacctgcgtcttcgatggaacaacaccaaatttgcaaggagctcttcagatctttatggatgaattttatctatggcaaatctgg

SEQ ID NO: 40491 - protein, 149 aa, Panicum virgatum
  misc_feature: Ceres CLONE 2003413
  misc_feature: SWISSPROT Homolog: EC 1.1.1.184 Carbonyl reductase (NADPH)
MEVKCRRLEGKVAVVTASTQGIGLAIAERLGLEGAAVVISSRKQKNVDDAVKGLKAKGITAVGAVCHVSDAQQRKSLIDTAVKVRIGGEGGFSLSDGLHCVVRFLLLLCSAIPSGLLAVDVVPNLVALLIKLRRLQMCIRNAGLVVLRY

SEQ ID NO: 40492 - DNA, 734 bp, Panicum virgatum
  misc_feature: Ceres CLONE 2003416
  misc_feature: Encodes the peptide sequence at SEQ ID NO. 40493
tttaattccatctccggtgtctccctcgctgctgccgtcatgtcgctcagttactcaacaattgcttggggtgcatcggtggacaagggtaagcttcaggatgtggactaccacctgcgcgcgacgacgacgccggggaaggtgtttggcttcttcggtgcattgggcgatgtggcatttgcatatgcggggcacaatgtggttctagagatccaggccaccatcccttcgacaccagagaagccgtctaagaaacctatgtggaagggagttattgtcgcctatatcgtggtggcactctgctacttccctgttgcactcatcggctattgggctttcggcaacaaagtggatgacaacatcctcatcaccctcaacaatccaaagtggctcatcgccctcgccaacatgatggtcgtgatccatgttatcgggagctaccagatctatgcgatgccggtgtttgatatgatagagactgtgctggtgaagaagctgggtttccctcctggcctgacactacgtttgatttcccggactgtttatgttgctttgacaatgttcatagccatcaccttccccttctttggtggattgctcggtttctttggtggattcgccttcgcgccgacaacatattttcttccctgcatcatgtggcttgcaatctacaagcccaaaacgttcagtctctcatggttcaccaactggatctgcattattcttgggggtgt

SEQ ID NO: 40493 - protein, 244 aa, Panicum virgatum
  misc_feature: Ceres CLONE 2003416
  misc_feature (1)..(241): Pfam Name: Aa_trans Pfam Description: Transmembrane amino acid transporter protein
  misc_feature: Useful for making plants with altered oil content
FNSISGVSLAAAVMSLSYSTIAWGASVDKGKLQDVDYHLRATTTPGKVFGFFGALGDVAFAYAGHNVVLEIQATIPSTPEKPSKKPMWKGVIVAYIVVALCYFPVALIGYWAFGNKVDDNILITLNNPKWLIALANMMVVIHVIGSYQIYAMPVFDMIETVLVKKLGFPPGLTLRLISRTVYVALTMFIAITFPFFGGLLGFFGGFAFAPTTYFLPCIMWLAIYKPKTFSLSWFTNWICIILGG

SEQ ID NO: 40494 - DNA, 668 bp, Panicum virgatum
  misc_feature: Ceres CLONE 2003427
  misc_feature: Encodes the peptide sequence at SEQ ID NO. 40495
gactcaattttttcaagggtagggatcatgctgataattcactccatgggtacaaggttttcataaatcctagcattagtgatgtcctttgcacagcaacagcagaggctcttgcaatggggaaattcgtcatctgtgcagaacatccatcaaacgattttttcatgtcatttccgaactgcttgacatacaaaacttcagaggaatttgtcgccagagtgaaagaagcaatggatagagaaccccaacctctaaccccagaacaaagatacaacctatcatgggaggcagcaaccgaaaggttcatggagtactcagaccttgacaaggttctcaacgatgaggtggttcagcctggacaagctggagctagaagcaaattgagaagaacctcacagcctaatttctccgacatcatggatggtggattggcttttgctcatcgatgcctaactggcagcgaggttctcaggttggcaacgggtgccattcctggcactcgtgactatgataagcagcactgcgtggatatgggccttttgccgcctcaggtccagcaccctgtttatggctggtgatacctgatgagtaccctaagttattcataggtgtatatatatgtagataatacactgcctagactaatatttagtgttgtaattgtagcg

SEQ ID NO: 40495 - protein, 191 aa, Panicum virgatum
  misc_feature: Ceres CLONE 2003427
  misc_feature: SWISSPROT Homolog: EC 2.4.1.241 Digalactosyldiacylglycerol synthase
LNFFKGRDHADNSLHGYKVFINPSISDVLCTATAEALAMGKFVICAEHPSNDFFMSFPNCLTYKTSEEFVARVKEAMDREPQPLTPEQRYNLSWEAATERFMEYSDLDKVLNDEVVQPGQAGARSKLRRTSQPNFSDIMDGGLAFAHRCLTGSEVLRLATGAIPGTRDYDKQHCVDMGLLPPQVQHPVYGW

SEQ ID NO: 40496 - DNA, 570 bp, Panicum virgatum
  misc_feature: Ceres CLONE 2003432
  misc_feature: Encodes the peptide sequence at SEQ ID NO. 40497
gcaagccacgcgttactgacgtcaagcgccgccccctcccattcctctgcctatcgctcggatccacctccacctctccctctcgcgcacgccgccgccgccgcgatgggcctcttcgacgcgctctaccgcgtggtgatgcgccgcaacgccgtctacgtcaccttcgtcgtcgccggcgccttcgcgggcgagagggcggtggattacggagtccacaagctctgggagatgaacaacgtcgggaaaaggtatgaagatataccagttctggggcaaaggccagccgaagaatgagagcattggagctcagactacccaggatgtcgctttccatgaaattagattccatttaagcaatggttttatcattcctttttgacataataacaaccaatgtaaaatccaaactctttccgggagttgcaacccgttcaattactcagcaggctgttggagtttcctgatgcatggttagaacctgttatctagccaggcatcggcatgtttggcatgtttggtcgaaaacttgatatgccatgaatgagaaatgttttgttggcaactgcg

SEQ ID NO: 40497 - protein, 63 aa, Panicum virgatum; identical to SEQ ID NO: 13073
  misc_feature: Ceres CLONE 2003432
  misc_feature (4)..(58): Pfam Name: UCR_UQCRX_QCR9 Pfam Description: Ubiquinol-cytochrome C reductase, UQCRX/QCR9 like

SEQ ID NO: 40498 - DNA, 695 bp, Panicum virgatum
  misc_feature: Ceres CLONE 2003445
  misc_feature: Encodes the peptide sequence at SEQ ID NO. 40499
agccaagcgccacgctccaccagtccaccgtaccaaccagccgcgcgcggtgatcagctagtgcggtggtgttgctttccgctccgtgggcgcggaccggcatccagcggggaggatgaagaaggtgtcggtggccgcggcggcggcagcggcgctgctgctgctgctggcggcggcggcggcggcggcggcggaggggagcgagctcaagctgggctactacgccaagacctgccgcgggtgggagaacgtggtcaagtaccacgtcgccaaggccatccgggccaaccgcgccagcggcgccgccctcgtccgcctcatcttccacgactgcttcgtcaggggttgcgacgcgtcggtgctgctcgacccgacgccggcgaacccgcacacggaggagcggtgccccggcacggtgtcgtgctcggacatcgtggtgttcgcggcccgggacgcgtccagcatcctgagcaacgggcacgtgcacttcaacccgccggcggggcgcctcgacggcaaggtctcccgcgccgccgacgcgcagcgcgacctcccggactcgaccttcacgatcgccgagctgatccgcaacttccggcgcaagaacttcgcggtggaggagctggtgatcctgtccggggcgcacgccgtcggcgtggggcactgctcctccttccgcgcgcggctgtcctcgc

SEQ ID NO: 40499 - protein, 193 aa, Panicum virgatum
  misc_feature: Ceres CLONE 2003445
  misc_feature (47)..(193): Pfam Name: peroxidase Pfam Description: Peroxidase
  misc_feature: SWISSPROT Homolog: EC 1.11.1.7 Peroxidase
MKKVSVAAAAAAALLLLLAAAAAAAAEGSELKLGYYAKTCRGWENVVKYHVAKAIRANRASGAALVRLIFHDCFVRGCDASVLLDPTPANPHTEERCPGTVSCSDIVVFAARDASSILSNGHVHFNPPAGRLDGKVSRAADAQRDLPDSTFTIAELIRNFRRKNFAVEELVILSGAHAVGVGHCSSFRARLSS

SEQ ID NO: 40500 - DNA, 925 bp, Panicum virgatum
  misc_feature: Ceres CLONE 2003453
  misc_feature: Encodes the peptide sequence at SEQ ID NO. 40501
cccggcagcgatgttcctgcggcggctgagaacctccgccgccctccgccgtggcgctagcgacggcggcgtcctggccgccctccgcaccgagctctcacacgagctcgcctcctccgccccgtccgatacccctcccttccattcccaggacgcccctgactttgtcaccgtatcggatgccccgcgcgcgcaggacgtgctcctgcgccgccggggcgattccgacgaggtcctcgtgtcggcgctgctcgcgccgctgcagttcgcggaccaagcgccgctgcccagggccgcgctcatgaaggtgttcgtcagtaagcctggcgcggctccggtgctgcacttcgactgccgtacgttctgggttggggaggacggcggcgacgctgactatgctattgacgctgttcggtaccacccaattcctggtgatgctgcggaaggcaagtatgaagggccggagttcagagatttggatcctgggctaaaagctgcattgcgagaatttctagcggcaaggggcgtcaactccaagctggcaggctcaattctccatcacttgcttcagaaggagcgctcccagtatgtgaattggctgaagactttagaagtggcatttgcaaaaaatcattgaccatatcctcatttgaacatttataaactatcgtttcttgctgagtcaagagttcacatttttgttgtgccgaggcgggaacgggcgcagttcctgcccattcatgtcgatgatcaggtccgagctccaccggcctaaatcctgttgagaatatgtggaatcccgacatccatatcccgagagaattcaattctctcattttaaatttgccccataaattcctgtggaacttgtacatagccaacaggttcttattatgtacatgtccatgaagagacatccttttcc

SEQ ID NO: 40501 - protein, 208 aa, Panicum virgatum
  misc_feature: Ceres CLONE 2003453
  misc_feature (29)..(204): Pfam Name: MAM33 Pfam Description: Mitochondrial glycoprotein
MFLRRLRTSAALRRGASDGGVLAALRTELSHELASSAPSDTPPFHSQDAPDFVTVSDAPRAQDVLLRRRGDSDEVLVSALLAPLQFADQAPLPRAALMKVFVSKPGAAPVLHFDCRTFWVGEDGGDADYAIDAVRYHPIPGDAAEGKYEGPEFRDLDPGLKAALREFLAARGVNSKLAGSILHHLLQKERSQYVNWLKTLEVAFAKNH

SEQ ID NO: 40502 - DNA, 709 bp, Panicum virgatum
  misc_feature: Ceres CLONE 2003456
  misc_feature: Encodes the peptide sequence at SEQ ID NO. 40503
tgatttttcatcccctcaccccccgccgccgcaggaagcccggctcgctaatcgccatggcccggatcaaggtgccagagctgcgggcgaagaacaaggcggagctgcaggcacagctcaaggagttcaagtcggagctctccctcctccgcgttgccaaggtcaccggcggcgcccccaacaagctctccaagatcaaggtggtgcgcacctccatcgcgcgcgtgctcaccgtgatctcgcagaagcagaaggcggcgctgcgggaggcgtacaagaacaagaagctgctcccgctcgacctccgccccaagaagacccgcgccatccgcaggcgcctcaccaagcaccagctctctttgaagactgagagggagaagaagcgtgagaagtatttccccatgaggaagtatgctatcaaggcctagattagtgaaagtgaacatgtttaccccttgtcaagttttgcccagaagttaccagaatttgatgtatcgcacatctattgtcatctaagtacaatgtagctgatcaactgcgtgatgaaaaatgtgtactctttgcttggtgaaatatgctggccattgttagttttgcttccaaaaaaaaaagagctctcgcttcgaaactgaaccagcacacccagctgccgttgccgtttctagagaactccctgccgttcgagatcccgctcgccacgatgcctgct

SEQ ID NO: 40503 - protein, 123 aa, Panicum virgatum; identical to SEQ ID NO: 13808
  misc_feature: Ceres CLONE 2003456
  misc_feature (6)..(64): Pfam Name: Ribosomal_L29 Pfam Description: Ribosomal L29 protein

SEQ ID NO: 40504 - DNA, 672 bp, Panicum virgatum
  misc_feature: Ceres CLONE 2003467
  misc_feature: Encodes the peptide sequence at SEQ ID NO. 40505
gcgaccaccctctctctccaccacccgccgcccccgcgagggcgaaaccctagctagggttctacccgccgccgccgtcgacaagtgctcgcgcgcccttcccccgagctcgccgtggacgccggccgcaagcgggccgcgccggagggcgccaacggcgcgggcggcccctagcgctcgagagaatcggagacaactcaaatgggtgtaggaagcaaatccaagccgtgcaccaaatttttcagcactgctggttgtcccttcggtgcaagttgccactttctccacaacttccctggcggttaccaggctgttgcaaagatgaccaacttgggaggaccacctgttccggctcctcctgggagaatacctatgggacctggtgcccctgatggtccaccttcacctgctctgaagacccgtatgtgtaacaagtacaacactgcagaagggtgtaaatgggggagcaaatgccactttgctcatggagagagggagcttggaaagcccatgcagatggacaactcagtgggagttcctccaatgggaccagggcccaacggtctctttatgcccccaccagtgcctgtcccggacatggttcctccatcaacatttggtgcttcagccacagccaatatcagtgttgacgcgtcacttgctggtgctatc

SEQ ID NO: 40505 - protein, 156 aa, Panicum virgatum
  misc_feature: Ceres CLONE 2003467
  misc_feature (71)..(97): Pfam Name: zf-CCCH Pfam Description: Zinc finger C-x8-C-x5-C-x3-H type (and similar)
  misc_feature (5)..(31): Pfam Name: zf-CCCH Pfam Description: Zinc finger C-x8-C-x5-C-x3-H type (and similar)
MGVGSKSKPCTKFFSTAGCPFGASCHFLHNFPGGYQAVAKMTNLGGPPVPAPPGRIPMGPGAPDGPPSPALKTRMCNKYNTAEGCKWGSKCHFAHGERELGKPMQMDNSVGVPPMGPGPNGLFMPPPVPVPDMVPPSTFGASATANISVDASLAGA

SEQ ID NO: 40506 - DNA, 1235 bp, Panicum virgatum
  misc_feature: Ceres CLONE 2003482
  misc_feature: Encodes the peptide sequence at SEQ ID NO. 40507
atcagagcatagagctagcaagctaagagcaataccaaagcatgggtccatcaacgctccttctgataatggtggtcgccggcgtcgccgcggtacacggccaccttgccaccgacactccggcggcacagttctgggagcaggccctcccgggcacgacgatgccagaggccattgcagatcttgtcatgaaaggcattgaccactcgccgctcgtggagcactactctgtactccccagtatcagtgtatgcacactcttcagctccgtttgcaatccacggacagtcgccgagaccggcatcttcttccacgaggcgcagctgctgccgggcagcgccatgacgctctccttcccggcagacgctgaggcggcgatcctcccccacgacgtcaccgggaaggtccccttcagaaacctagcagacgtcctcgccaccttcaacgtcccggtgggctccgacgaggccgcccaggtgagggacaccctgcgcaggtgccaggagccgcccgtcgccggcgaggtcaagacctgcgccacgtccctggagggcaccgtgcgcagcgccatggccatgctcggcaccgtgaacgagcagggcgtgtgggcggccacgtcggcgctcccccacggcggcctgccgcgtcagacctacgtggtccgggcggtctccccgctggacggcgaccgctacgtgtcctgccacagggtgccgttcccctacgccgtctaccagtgccacgctgcggagaacgggtacagagcctacgtggtctcgctcagcggcctccgtggcggcccggcggcttccatgctggcgttctgccacgccgacacctccagctggaacccggctcacccggccttcgaggtgctcaacactcgccccggtggcacgccggtgtgccacttcatgccttacggtgacctggcgttcgtcaagaaggcaggaagggcctattagcttgctttgcgcaatctaagcatcgccataaatgaagtataacggccacctctaatcctcgcattttggacatggatcgacatggcgatctttgttcataccacacatgtgcactatacaagtatgcatggccttgtgtgcattcgaaggtggcggctattatattgaataatgacggtgctagaactaggttcataaaaagggcctctaggtttgtttgggatcttaagtcgtgcaagtatcggtgtaaagactctggatcgactatgg

SEQ ID NO: 40507 - protein, 307 aa, Panicum virgatum
  misc_feature: Ceres CLONE 2003482
  misc_feature (87)..(302): Pfam Name: BURP Pfam Description: BURP domain
MGPSTLLLIMVVAGVAAVHGHLATDTPAAQFWEQALPGTTMPEAIADLVMKGIDHSPLVEHYSVLPSISVCTLFSSVCNPRTVAETGIFFHEAQLLPGSAMTLSFPADAEAAILPHDVTGKVPFRNLADVLATFNVPVGSDEAAQVRDTLRRCQEPPVAGEVKTCATSLEGTVRSAMAMLGTVNEQGVWAATSALPHGGLPRQTYVVRAVSPLDGDRYVSCHRVPFPYAVYQCHAAENGYRAYVVSLSGLRGGPAASMLAFCHADTSSWNPAHPAFEVLNTRPGGTPVCHFMPYGDLAFVKKAGRAY

SEQ ID NO: 40508 - DNA, 670 bp, Panicum virgatum
  misc_feature: Ceres CLONE 2003485
  misc_feature: Encodes the peptide sequence at SEQ ID NO. 40509
acccacctccatttagctagcttctctctctctctcctctcgcgctctcccccacccaaccaacaaatcgagctagctgagaagaggggaggaccagaggtggagagcggcgcaacgcagcctcgccgcgatctcggccgtgctgcccacgggcgcgcccgaggtcgacccgaggacgcaccgcctcaagaagcccgcgccgccggtgccccccggcgcgccccccgtgctcccgatctgggacgccatggcgcccggcccgtccatcgcccccgcgccggcgcctgggcccggctccgggaagcaccacttcgacgggcacagccaggtcaaggacttcatccagaccctgctcctctacggcggctacaacgagctcgccgacatcctcgtcaacctcacctcgctcgccaccgagatgggccgcctcgtctctgagggctacgtgctcaccgtcctcgcccccaacgacgaggccatggcgcgcctcaccaccgaccagctcagcgagcctggctcgccggagaacatcctctactaccacatggttcccgagtaccagaccgaggagtccatgtacaacgccgtgcggcggttcggcaaggcgcgctacgacacgctgcggctgccgcacaaggtggtggcgcgggaggccgacggctccgtcaag

SEQ ID NO: 40509 - protein, 140 aa, Panicum virgatum
  misc_feature: Ceres CLONE 2003485
  misc_feature: Useful for making plants with altered carbohydrate content
  misc_feature: Useful for making plants with altered cell wall content and/or composition
MAPGPSIAPAPAPGPGSGKHHFDGHSQVKDFIQTLLLYGGYNELADILVNLTSLATEMGRLVSEGYVLTVLAPNDEAMARLTTDQLSEPGSPENILYYHMVPEYQTEESMYNAVRRFGKARYDTLRLPHKVVAREADGSV

SEQ ID NO: 40510 - DNA, 718 bp, Panicum virgatum
  misc_feature: Ceres CLONE 2003487
  misc_feature: Encodes the peptide sequence at SEQ ID NO. 40511
agcacccacaccacgcgcggggagggaaggagagagaagctaggcggagcagcagctgcagcagcggctgcgattaacgccagacagataggtggcagaggaagaaagggggagaggggaggaagggctagctgagaggcgaactcaaagagagggcagctgcagcagcaagtataggtagctagcttgctcggaggcaatgaggtcgtcgttgcggcggagcgtggttgcggcggccgtagtggcgctggcggcggcgtggtgcgcggcggcgcagctgaaccagagctactacgcgtcgacgtgccccaacgtggagaccctggtccgcggcgccgtcacccagaagctgcaggagaccttcaacgccgcgccgggcacgctccgcctcttcttccacgactgcttcgtcagggtaaacacgcccacggttccattccatcggtctcttctgctcggccgaggagagtcgctcgcggctcgccacgtccgtcgatctcaccggccaatttggattttattgtcccagggctgcgacgcctcggtgctgctgtcgggccccggcgacgagcacagcgccggcgccgacacgacgctgtccccggacgcgctggacctcgtcacccgcgccaaggccgccgtcgacggcgacccgcgctgcgccaacaaggtctcctgcgccgacatcctcgcgctcgccgcccgcgacgtcgtctcc

SEQ ID NO: 40511 - protein, 172 aa, Panicum virgatum
  misc_feature: Ceres CLONE 2003487
  misc_feature: SWISSPROT Homolog: EC 1.11.1.7 Peroxidase
MRSSLRRSVVAAAVVALAAAWCAAAQLNQSYYASTCPNVETLVRGAVTQKLQETFNAAPGTLRLFFHDCFVRVNTPTVPFHRSLLLGRGESLAARHVRRSHRPIWILLSQGCDASVLLSGPGDEHSAGADTTLSPDALDLVTRAKAAVDGDPRCANKVSCADILALAARDVV

SEQ ID NO: 40512 - DNA, 708 bp, Panicum virgatum
  misc_feature: Ceres CLONE 2003497
  misc_feature: Encodes the peptide sequence at SEQ ID NO. 40513
accaactcctcctcatctatacctattacctctaccagcattcagctgatcgcccgcctccacaaacctcgaggatttcatcagcgccgctcgcgatgacgaggtcagcaccatcggcggcggcggcggcctccgtcccggcgccgacgaagaagcagcagcacgcggcgctgcggggcagccagctgaagcagctccgcgagatcttccggcggttcgacatggacggcgacggcagcctgacgcagctggagctggcggcgctgctgcggtcgctgggcctgcgccccacgggggaggaggtgcgcgcgctgctggcggggatggacgccgacggcaacggcgccgtggagttcgatgagctggcggacgcaatcgcgccgctgctcaccacgcagacgcacctcgtcgaccaggcccagctgctggaggtgttccgcgccttcgaccgcgacggcaacggcttcatctccgccgccgagctggcgcgctccatggcgcgcctcggccagccgctcaccttcgaggagctcacgcggatgatgcgcgacgccgacgccgacggcgacggggtcatcagcttccaggagttcgccgccgtcatggccaagtccgcgcttgacttcctcggcgtcgcctgatctttctggcctttccaaccccgcacgccgtcgcccgcccgcccgcccgccattgattagtagcgct

SEQ ID NO: 40513 - protein, 181 aa, Panicum virgatum
  misc_feature: Ceres CLONE 2003497
  misc_feature (145)..(173): Pfam Name: efhand Pfam Description: EF hand
  misc_feature (109)..(137): Pfam Name: efhand Pfam Description: EF hand
  misc_feature (33)..(61): Pfam Name: efhand Pfam Description: EF hand
  misc_feature: SWISSPROT Homolog: EC 2.7.11.1 Non-specific serine/threonine protein kinase
  misc_feature: Useful for making plants with modulated salt sensitivity
MTRSAPSAAAAASVPAPTKKQQHAALRGSQLKQLREIFRRFDMDGDGSLTQLELAALLRSLGLRPTGEEVRALLAGMDADGNGAVEFDELADAIAPLLTTQTHLVDQAQLLEVFRAFDRDGNGFISAAELARSMARLGQPLTFEELTRMMRDADADGDGVISFQEFAAVMAKSALDFLGVA

SEQ ID NO: 40514 - DNA, 578 bp, Panicum virgatum
  misc_feature: Ceres CLONE 2003498
  misc_feature: Encodes the peptide sequence at SEQ ID NO. 40515
atctttcacacatccaacgctacacaacacacaactcacaacagccccccagcgctagcgttaccacacacatttcacacaacttctctcgatcacttccaagactccaatctacgtcgaacatgcaaatcttcgtgaagaccctgactggcaagaccatcaccctcgaggttgagtcgagcgacacgatcgagaacgtcaagcagaagatccaggacaaggagggcatcccccctgaccagcagcgtctcatcttcgccggcaagcagctcgaggacggtcgcaccctcgccgactacaacatccagaaggagtcgactctccacctcgtgctccgcctccgtggtggtatgcagatcttcgtcaagaccctgaccggtaagacgatcaccctcgaggtcgagagctcggacaccatcgagaacgtcaagcagaagatccaggacaaggagggtattcctcccgaccagcagcgcctcatcttcgctggcaagcagctcgaggacggccgtaccctcgccgactacaacatccagaaggagtcgactctccacctcgtcctccgtcttcgtggaggc

SEQ ID NO: 40515 - protein, 151 aa, Panicum virgatum
  misc_feature: Ceres CLONE 2003498
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIENVKQKIQDKEGIPPDQQRLIFAGKQLEDGRTLADYNIQKESTLHLVLRLRGGMQIFVKTLTGKTITLEVESSDTIENVKQKIQDKEGIPPDQQRLIFAGKQLEDGRTLADYNIQKESTLHLVLRLRG

SEQ ID NO: 40516 - DNA, 708 bp, Panicum virgatum
  misc_feature: Ceres CLONE 2003505
  misc_feature: Encodes the peptide sequence at SEQ ID NO. 40517
accaagcagcagcaagcaagtgctcactcgctcatcttcttcttcttcttcttcttcttcccctgggcattagctgaagatcgatgagccgcggcgcccagatgaagagctttgtcagggtcctgatcctcgtgcaggtggccgccgccctgctggccggcggccccgtcgccgccgagctgagcatgggctactacggcatgacctgcccgttcgccgagtacatcgtccgcaacgtcgtcggcgaggccctggcgaaggaccccaccctcgccgccggcctcctccggctgcacttccacgactgcttcgtgcagggctgcgacgcgtcggtgctgctggactcgacggacggcaacacggcggagaaggacgcgccggcgaacctgagcctgcgcggcttcgaggtgatggacgccgtcaaggaggccctggaggcgtggtgccccggcgtggtctcctgcgccgacgccctggcgctggccgcccgcgacgccgtgttcatggcgcgcgggccctactacggcgtgcccctcggccgccgcgacggcacccgctccgtcgcctccgacaccttcctggcgctcccgccgccgctcaagaacctgacgctcctcatccagatcttcgacaacgtcgggctcgacgtccacgacttggtggcgctgtccggcgggcacacgctgggtgtcgcgcactgcgccagct

SEQ ID NO: 40517 - protein, 202 aa, Panicum virgatum
  misc_feature: Ceres CLONE 2003505
  misc_feature (43)..(202): Pfam Name: peroxidase Pfam Description: Peroxidase
  misc_feature: SWISSPROT Homolog: EC 1.11.1.7 Peroxidase
  misc_feature: Useful for making plants with altered cell wall content and/or composition
  misc_feature: Useful for making plants with altered carbohydrate content
  misc_feature: Useful for making plants with modulated phosphate use efficiency
  misc_feature: Useful for making plants with modulated nitrogen use efficiency
  misc_feature: Useful for making plants with modulated oxidative stress sensitivity
MKSFVRVLILVQVAAALLAGGPVAAELSMGYYGMTCPFAEYIVRNVVGEALAKDPTLAAGLLRLHFHDCFVQGCDASVLLDSTDGNTAEKDAPANLSLRGFEVMDAVKEALEAWCPGVVSCADALALAARDAVFMARGPYYGVPLGRRDGTRSVASDTFLALPPPLKNLTLLIQIFDNVGLDVHDLVALSGGHTLGVAHCAS

SEQ ID NO: 40518 - DNA, 734 bp, Panicum virgatum
  misc_feature: Ceres CLONE 2003506
  misc_feature: Encodes the peptide sequence at SEQ ID NO. 40519
gctcgatctctcgagcacagagcactgcaccctctcatccgccggtgcttgctcctcctccccacttcagctagtagcctcttcttgagagaatcatcaggaagaggccgggatatcgagggatcgagcaagatgatgagcggcaaggctctccttgtcgccgtgctcttggtgggcgtcgcctcccggtgctccggcagcaggggcctgcagggggatcacatcgctgagcagaagtacggtggcggtgggtacggtggcggcggcggcggatacggtggtggcggtgggtacggcggcggcggtggtggcggtgggtacggaggcggcggtggtggcggtgggtacggcggcggtggtggcggtgggtacggaggcggcggcggtggtggcggcggcggctacacgcccggctactccggcaccggaacctgcgactactggaagagccacccggacgcgatcatctcgtgcatcgggtcgctgggcagcatcctggggtcctttggcgacgtgtgcagcgccttcttcgggagcaagctgcagacgctgcaggacgcgctgtgcaacacccgcaccgactgctacggcgacctcctccgcgagggcgccgccgcctacctcaactccgtcgcctcccagaagtacgcctacaccacgcagcaggtcaaggactgcatcgccgtcgcgctcacctccgaggccgccgccgccgcgcaggccgccatgttcaa

SEQ ID NO: 40519 - protein, 200 aa, Panicum virgatum
  misc_feature: Ceres CLONE 2003506
  misc_feature (1)..(99): Pfam Name: GRP Pfam Description: Glycine rich protein family
  misc_feature: Useful for making plants with altered lignin content
  misc_feature: Useful for making plants with altered alkaloid content
  misc_feature: Useful for making plants with modulated nitrogen use efficiency
  misc_feature: Useful for making plants with modulated phosphate use efficiency
  misc_feature: Useful for making plants with altered terpenoid content
MMSGKALLVAVLLVGVASRCSGSRGLQGDHIAEQKYGGGGYGGGGGGYGGGGGYGGGGGGGGYGGGGGGGGYGGGGGGGYGGGGGGGGGGYTPGYSGTGTCDYWKSHPDAIISCIGSLGSILGSFGDVCSAFFGSKLQTLQDALCNTRTDCYGDLLREGAAAYLNSVASQKYAYTTQQVKDCIAVALTSEAAAAAQAAMF

SEQ ID NO: 40520 - DNA, 607 bp, Panicum virgatum
  misc_feature: Ceres CLONE 2003509
  misc_feature: Encodes the peptide sequence at SEQ ID NO. 40521
gctgttttcgatgcttcatctgagacagtagttctgtaccctgaaaatggagggaatttgcactgtttcactgcgttgaccccttgtgccgtgctggatgtgatgggccccccttacaaccgtgctgatggaagggattgtgcgtactatgacgaatcaccttacttaattggtggagatgaacagtattcttggcttaaagaggttactaccacatttgagatgaaaggtatacagatgccgcggaagtttagcgtctcggcatgactggcatgacattgtcgcgacaccagaagaggatgaagcaaatgacgctagcttgatgtacatatcttagctgctaagacagacgacaatgggtacaagggaaaggccgggccaggcaagttgcacaggctaggaaacttgacatttgtttctcttatttcgtctgggttgaaacaaacaatctcttgtggtttgggatgactctgcttctcttgtgttactggagtatccaatagtgcaatttgaatttgggctttttgggggcatgatcacttttttggttccctgtagacagagatgtacgcaggtgctcttttttgaagtgatcatggaccaaatt

SEQ ID NO: 40521 - protein, 88 aa, Panicum virgatum
  misc_feature: Ceres CLONE 2003509
  misc_feature: SWISSPROT Homolog: EC 1.13.11.19 Cysteamine dioxygenase
AVFDASSETVVLYPENGGNLHCFTALTPCAVLDVMGPPYNRADGRDCAYYDESPYLIGGDEQYSWLKEVTTTFEMKGIQMPRKFSVSA

SEQ ID NO: 40522 - DNA, 707 bp, Panicum virgatum
  misc_feature: Ceres CLONE 2003511
  misc_feature: Encodes the peptide sequence at SEQ ID NO. 40523
ggagatttccttcctcgtctttcctcctaatctcttctagcgcccgcacctccgtgctgctccgccgcccccggcgttcggcgcaaaccccctcccgcccacctcccgcgcgcgccggccgcccgtcccgtcgactgcctacgcgcaggcagcgagctcctgcccggccgcctcccgcccacgtctgcgcgcgccgcgagctcccaagtcgaagcggggatggctctggccagattggcgtcccccctcttcatcctcctcgccgcggcggggttcgcggcggcgacgcggtcgccgtcggccttcgtgcagaacgccatctactccaaccgcatcaccatcttctcgaaaacctactgcccgtactctatccgtgctaagcgcatatttcaagatctcaaggaagatccatatgttgttgaactagatctccgagaggatgggcgtgacattcaaagtgttctcctggacctagttgggcgccatactgtgccacaggtgtttgtgaatggccagcatgttggtggctcagatgatacagtaaatgctctttcagatggacagcttgagaaactccttggtaagagtcagtcacagtgattggtctcccgacaggctcgcactgtcaagaacacgttagtgactcacacttatgtacgggaggtatatgtacttgaggggttttcttctctgtataggaccgcaca

SEQ ID NO: 40523 - protein, 126 aa, Panicum virgatum
  misc_feature: Ceres CLONE 2003511
  misc_feature (39)..(101): Pfam Name: Glutaredoxin Pfam Description: Glutaredoxin
  misc_feature: SWISSPROT Homolog: EC 1.11.1.15 Peroxiredoxin
MALARLASPLFILLAAAGFAAATRSPSAFVQNAIYSNRITIFSKTYCPYSIRAKRIFQDLKEDPYVVELDLREDGRDIQSVLLDLVGRHTVPQVFVNGQHVGGSDDTVNALSDGQLEKLLGKSQSQ

SEQ ID NO: 40524 - DNA, 722 bp, Panicum virgatum
  misc_feature: Ceres CLONE 2003512
  misc_feature: Encodes the peptide sequence at SEQ ID NO. 40525
accccacatcgttggtagatcttgcagcgttgggtctcacagtcccagacccaattaagaagctagcagagcaactgagcaagcgatggcgccgccgaaggtgtacggatgggcgatctcgccgttcgtgtcgcgcgcgctgctggcgctcgaggaggccggcgttgactacgagctcgtccccatgagcccccaggacggcgaccaccgccgcccggagcacctcgccagaaacgtccgtaccctcccccggagcagccattgatctgtttctctcatcactcgccgactgagacactgatcttgtggcttgttcttgctgcagccttttggtcaggtgcccgttcttgaggacggcgacctcacggtcttcgagtcccgggcgatcgcgaggcacgtcttccgcaagcacaagccggagttcctgggcgccggcaccctggagcggtcggcgatggtggacgtgtggctggaggtggaggcgcaccagctgcacccggcggcgaacggcgtcgtggtggagtgcttcggcgcgccgttcctcggccgcccccgcaaccaggcggccgtcgacgagaacctcgggaagctgcggaaggtgctggaggtgtacgaggcgcggctggcgcagagcaagtacctcgccggcgacttcctcagcgtcgccgacctcagccacttcaccatcatgcactacttcatggccaccgagtacgcggggg

SEQ ID NO: 40525 - protein, 89 aa, Panicum virgatum
  misc_feature: Ceres CLONE 2003512
  misc_feature (13)..(89): Pfam Name: GST_C Pfam Description: Glutathione S-transferase, C-terminal domain
  misc_feature: SWISSPROT Homolog: EC 2.5.1.18 Glutathione transferase
MVDVWLEVEAHQLHPAANGVVVECFGAPFLGRPRNQAAVDENLGKLRKVLEVYEARLAQSKYLAGDFLSVADLSHFTIMHYFMATEYAG

SEQ ID NO: 40526 - DNA, 1344 bp, Panicum virgatum
  misc_feature: Ceres CLONE 2003520
  misc_feature: Encodes the peptide sequence at SEQ ID NO. 40527
aaccggcaaccgcatcaggagttcaggacttggggggacgcgcggcgttggagttcgccggcggcgaggagccgaggagaaggccggatccggaggatgggctgctccatatctgggctcaacgccctctacgagtccgccacgggcggcggcgacgtctggatcaacgagcgccgcttccgcgtcctccgccagatcggcgagggcggcttcgccttcgtctacctcgtcagggagcagcagcccgcctccgacgccgcgcccgcaaggcaccacgaccacgcttcccacgtctcagaggatggaacatatgccatgaagaaggtgctgatacagagtaaggagcagttggatctggtgagggaggagatccgtgtgtcgtcattgttcaatcaccccaacctgttgccacttcttgatcatgctataatagctgtcaagagtacacagggagattggagccatgaagcgtacctgctctttccagtccatttggatggtacattatttgacaacgctaacatcatgctgtccaaaaaggaattctattcaacagcggacgttctgcaaatattccatcagatgtgtgaaggactgaagcacatgcacagctttgatcctccatatgctcataatgatgtgaagcctggtaatgttcttataacccatcgtaaaggacaagcacctgttgcaactttgatggattttggaagtgcaaggcctgcaagaaagcaaatccgttctcgttctgaggcgttacagctgcaggagtgggctgctgagcattgctctgcaccttatcgtgcccctgaattatgggactgcccaagccatgctgatattgatgagaggacagacatctggtctttaggatgcaccctttacgcaatcatgtttaatgtttcaccgtttgagtatgctcttggtgaatctggaggaagtttgcaacttgctattgtcaatgggcagttgaagtggccagcaggacctaaccctccttatcctgatgaacttcgtcagtttgttatctggatgcttcagcctcaacctgcgatgcgccctcacattggcgatgtagttcttcatgttgacaagctcatcgcaaaatacttgtcctaaaccagctcgtacttgccattctgtctcatttctttgttacacaaagtgaacatagtgtaaaatgggttcatgattgacatcattcaatcgttagataagtgcaatattgatattctttgtagaactttcagattgttattgacatccatcaaatgttttactcagtcatgtacaaatatgtcaagtgaacatcagaagttgctatataatatatgtaatagcatc

SEQ ID NO: 40527 - protein, 340 aa, Panicum virgatum
  misc_feature: Ceres CLONE 2003520
  misc_feature (28)..(331): Pfam Name: Pkinase Pfam Description: Protein kinase domain
  misc_feature: SWISSPROT Homolog: EC 2.7.11.1 Non-specific serine/threonine protein kinase
MGCSISGLNALYESATGGGDVWINERRFRVLRQIGEGGFAFVYLVREQQPASDAAPARHHDHASHVSEDGTYAMKKVLIQSKEQLDLVREEIRVSSLFNHPNLLPLLDHAIIAVKSTQGDWSHEAYLLFPVHLDGTLFDNANIMLSKKEFYSTADVLQIFHQMCEGLKHMHSFDPPYAHNDVKPGNVLITHRKGQAPVATLMDFGSARPARKQIRSRSEALQLQEWAAEHCSAPYRAPELWDCPSHADIDERTDIWSLGCTLYAIMFNVSPFEYALGESGGSLQLAIVNGQLKWPAGPNPPYPDELRQFVIWMLQPQPAMRPHIGDVVLHVDKLIAKYLS

SEQ ID NO: 40528 - DNA, 723 bp, Panicum virgatum
  misc_feature: Ceres CLONE 2003528
  misc_feature: Encodes the peptide sequence at SEQ ID NO. 40529
atccctcctgcttatccaacgcaccaattccactccgtccatccatccgccatggcgacggccacgctgctgagctcctccttcgccatgcccgccgccgcccggagggcctcctcctcttcctccacctccctgggcttcgccacgtcgcagctcgccggcctctccctctccgccgccgcgcccacttcaaccgccgcggcccccctccacaagaggccgctccagcccatcgtcgcgcgccgggtgtgccccttcactgacaagaagacgaaccgggcgaacaaggtgtccttctccaaccacaagacgaagaagcagcagttcgtgaacctgcagtacaagaagctgtggtgggaggccggcaagcgctacgtcaagctgcgcctctccaccaaggccctcaagaccatcgagaagcacggcctcgacgccgtcgcgcgcaaggccggcatcgacctcaacaagaagtgagccgagcttgagtagtcaagccggtgatggcggtatggtcaggccgagcaatctcgcgaacagatgccactagcttagtcttcatggcagatcgaggttgcgtatatttttattctatggaaagagttgaggtttcttcgtcttgatcaatcttgtctccatttcgtaattgtgatcgattgggagaaagttaactgggctcaactgatcatttggcagccagtgaagtagaaaactgaatgggttttc

SEQ ID NO: 40529 - protein, 140 aa, Panicum virgatum
  misc_feature: Ceres CLONE 2003528
  misc_feature (65)..(125): Pfam Name: Ribosomal_L28 Pfam Description: Ribosomal L28 family
MATATLLSSSFAMPAAARRASSSSSTSLGFATSQLAGLSLSAAAPTSTAAAPLHKRPLQPIVARRVCPFTDKKTNRANKVSFSNHKTKKQQFVNLQYKKLWWEAGKRYVKLRLSTKALKTIEKHGLDAVARKAGIDLNKK

SEQ ID NO: 40530 - DNA, 701 bp, Panicum virgatum
  misc_feature: Ceres CLONE 2003531
  misc_feature: Encodes the peptide sequence at SEQ ID NO. 40531
agcagcagcaaacaagggggaaagccctctgtccgtggggattgccatcggtttcgtggcttggcagccaccgccaccgccctctctctttcccattctttatcttctccgaggcgagggagtctagtgcccatctcacattgtcacacagctgggctgccagggaaggaagagaagtgaagagagaaggcaggcaggatgccccacagccgcttctcggggtcgctccgctcgcccaagatcgacgtcgtcatcgacatggggaaccccttcctcaaccgcaccgtcgacggcttcctcaagatcggcgcggtcggcgcttgcaaggtggccgccgaggagaccttcgagtgcctccacagagtggatgtttcaaagcacaagcttgagcatgcgctaaagaaaatgtgcaaggagggtgcttactggggtactgttgctggagtttatgtgggcatggtgtatggagtggaaagggtccgtggtcgcagtgactggaagaatgcaatgataggtggcgcattatctggtgtcctgatctctggtgccagcaacaaccacaaagacaaaatcatcaaggacgccatcaccgctggcgcagttgcaacagctgttgagttcatcaactaccttacctagttatgcaactgcattcgcagtaccattgtcgtacaataacaataagaacttcttcagtgaag

SEQ ID NO: 40531 - protein, 146 aa, Panicum virgatum
  misc_feature: Ceres CLONE 2003531
  misc_feature (18)..(146): Pfam Name: Tim17 Pfam Description: Tim17/Tim22/Tim23 family
MPHSRFSGSLRSPKIDVVIDMGNPFLNRTVDGFLKIGAVGACKVAAEETFECLHRVDVSKHKLEHALKKMCKEGAYWGTVAGVYVGMVYGVERVRGRSDWKNAMIGGALSGVLISGASNNHKDKIIKDAITAGAVATAVEFINYLT

SEQ ID NO: 40532 - DNA, 423 bp, Panicum virgatum
  misc_feature: Ceres CLONE 2003536
  misc_feature: Encodes the peptide sequence at SEQ ID NO. 40533
  misc_feature (243)..(243): n is a, c, t, g, unknown, or other
  misc_feature (244)..(244): n is a, c, t, g, unknown, or other
  misc_feature (258)..(258): n is a, c, t, g, unknown, or other
gccccacctccgccgcacaaccgcgtccgcttcccccccgccacaggagatcccctgcgcccgccgcatccctgtagccgcccctgctgccgccggcgagcccgatccgcagccgccatgtcgccgtcggagccgacgcgtgaggagagcgtgtacatggcgaagctggcggagcaggcggagcggtacgaggagatggtggagttcatggagcgcgtggcgcgctcggcgggcggcggcggnngcggggaggagctntccggcgaggagcgcggcctggtgtccgtcgcctccgacaacgtcctcggcgcccgcagggcctcggggcggatcatctcctccatcgagcagaaggaggagggccgcgggaacgaggcccacgccccctccacccgggcttacttctccaagatcaaggcctag

SEQ ID NO: 40533 - protein, 101 aa, Panicum virgatum
  misc_feature: Ceres CLONE 2003536
  misc_feature: Useful for making plants with modulated water use efficiency
  misc_feature: The sequence is a functional homolog of SEQ ID NO 809 in the 11/479,226 US patent application
  misc_feature: Useful for making plants with modulated drought sensitivity
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 801 in the 11/479,226 US patent application
  misc_feature: The sequence is a functional homolog of SEQ ID NO 786 in the 11/479,226 US patent application
  misc_feature: The sequence is a functional homolog of SEQ ID NO 789 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
  misc_feature (43)..(43): Xaa is any aa, unknown, or other
MSPSEPTREESVYMAKLAEQAERYEEMVEFMERVARSAGGGGXGEELSGEERGLVSVASDNVLGARRASGRIISSIEQKEEGRGNEAHAPSTRAYFSKIKA

SEQ ID NO: 40534 - DNA, 531 bp, Panicum virgatum
  misc_feature: Ceres CLONE 2003542
  misc_feature: Encodes the peptide sequence at SEQ ID NO. 40535
accaaccaaaacccccaaccgccggggtcgttgcgcccgcgccgcccccctctactcgccgccggcgactccgcccgcccagcgacggcgatgtcgttccactaccccgaccacgggctcaccatggacgccgcggcggcggcagctgctgctgcggccgccgcggccgcgtcgtcgccgaaccctagcggcttctcccccggcgtcggcggggagagggagaaggcggccatcgcggcgcacccgctctacgagcgcctcctggaggcgcacgtcgcctgcctccgcgtcgccacccccgtcgaccagctcccacgcatcgacgcgcagatcgccgcgcggccccctccgctcgcggccgccgctggggccgcggccgcgggggggccctccggcggcgaggagctcgacctcttcatgacacattatgtgttgctcctttgctcattcaaggagcagctccagcagcatgtacgtgtacatgcaatggaagcggtgatgggttgctgggaccttgaacaatctttacaa

SEQ ID NO: 40535 - protein, 146 aa, Panicum virgatum
  misc_feature: Ceres CLONE 2003542
  misc_feature (42)..(86): Pfam Name: KNOX1 Pfam Description: KNOX1 domain
  misc_feature (96)..(146): Pfam Name: KNOX2 Pfam Description: KNOX2 domain
  misc_feature: The sequence is a functional homolog of SEQ ID NO 710 in the 10/374,780 US patent application
  misc_feature: Useful for making plants with altered lignin content
  misc_feature: Useful for making plants with altered sterol content
  misc_feature: Useful for making plants with altered terpenoid content
  misc_feature: Useful for making plants with modulated flowering time
  misc_feature: The sequence is a functional homolog of SEQ ID NO 490 in the 11/435,388 US patent application
  misc_feature: The sequence is a functional homolog of SEQ ID NO 76 in the 10/374,780 US patent application
  misc_feature: The sequence is a functional homolog of SEQ ID NO 882 in the 10/225,066 US patent application
  misc_feature: The sequence is a functional homolog of SEQ ID NO 713 in the 10/374,780 US patent application
  misc_feature: The sequence is a functional homolog of SEQ ID NO 711 in the 10/374,780 US patent application
  misc_feature: The sequence is a functional homolog of SEQ ID NO 1996 in the 10/374,780 US patent application
  misc_feature: The sequence is a functional homolog of SEQ ID NO 594 in the 11/479,226 US patent application
  misc_feature: The sequence is a functional homolog of SEQ ID NO 604 in the 11/435,388 US patent application
  misc_feature: The sequence is a functional homolog of SEQ ID NO 902 in the 10/225,066 US patent application
  misc_feature: Useful for making plants with altered carbohydrate content
MSFHYPDHGLTMDAAAAAAAAAAAAAASSPNPSGFSPGVGGEREKAAIAAHPLYERLLEAHVACLRVATPVDQLPRIDAQIAARPPPLAAAAGAAAAGGPSGGEELDLFMTHYVLLLCSFKEQLQQHVRVHAMEAVMGCWDLEQSL

SEQ ID NO: 40536 - DNA, 854 bp, Panicum virgatum
  misc_feature: Ceres CLONE 2003542-R
  misc_feature: Encodes the peptide sequence at SEQ ID NO. 40537
acaggagcgaccatgtctgatgatgaagataccaggttgatagtgaggccaacatgtttgatggaaacgaaggatcagatggtatgggctttgggcccctaatactgacagagggtgagcgatccttggttgaacgtgtacggcgggagctgaaaaatgagcttaagcagggatacaaagaaaagcttgttgatatcagagaagaaattctccgcaagcgcagagctggtaaacttcctggggatactgcatccatattgaaggcttggtggcaggctcattccaagtggccatatccaactgaagacgacaaggctcgactggtgcaggagacaggattacagctgaagcagatcaacaactggttcattaaccaacgcaaacggaactggcacagcaacccaacatcctcgggtgaaaagaccaagaagaaaaggtgaggacggccggagcaatcttgacgaagctagatatacacagtactatactttattggcacgcacgttctccctccctctagagatttggagacctacctgttgggagggaactttatggagtaatgaagatacgcgcgtcaccgggggaccttagcggtcacccattgccctagtttgacactttgaccacgtggtgggagtggaagttgtttatgacttttgcagtatagcgtttgctaatgtgatatggtgaatcatgtgttgtatgaccgaccgaacgggaggcagtaatttattttgtattgtacttgtgtatcctaccgtgtaatgatgttttaggaaggtttccaagattcagatcgtccgtttacagtatttgccggtgtaaaaatgtgctggctcaaagtttacccg

SEQ ID NO: 40537 - protein, 128 aa, Panicum virgatum
  misc_feature: Ceres CLONE 2003542-R
  misc_feature (32)..(53): Pfam Name: ELK Pfam Description: ELK domain
  misc_feature: The sequence is a functional homolog of SEQ ID NO 710 in the 10/374,780 US patent application
  misc_feature: The sequence is a functional homolog of SEQ ID NO 711 in the 10/374,780 US patent application
  misc_feature: Useful for making plants with altered lignin content
  misc_feature: Useful for making plants with altered sterol content
  misc_feature: Useful for making plants with altered terpenoid content
  misc_feature: Useful for making plants with modulated flowering time
  misc_feature: The sequence is a functional homolog of SEQ ID NO 490 in the 11/435,388 US patent application
  misc_feature: The sequence is a functional homolog of SEQ ID NO 76 in the 10/374,780 US patent application
  misc_feature: The sequence is a functional homolog of SEQ ID NO 882 in the 10/225,066 US patent application
  misc_feature: The sequence is a functional homolog of SEQ ID NO 713 in the 10/374,780 US patent application
  misc_feature: The sequence is a functional homolog of SEQ ID NO 1996 in the 10/374,780 US patent application
  misc_feature: The sequence is a functional homolog of SEQ ID NO 594 in the 11/479,226 US patent application
  misc_feature: The sequence is a functional homolog of SEQ ID NO 604 in the 11/435,388 US patent application
  misc_feature: The sequence is a functional homolog of SEQ ID NO 902 in the 10/225,066 US patent application
  misc_feature: The sequence is a functional homolog of SEQ ID NO 712 in the 10/374,780 US patent application
  misc_feature: Useful for making plants with altered carbohydrate content
  misc_feature: The sequence is a functional homolog of SEQ ID NO 709 in the 10/374,780 US patent application
MFDGNEGSDGMGFGPLILTEGERSLVERVRRELKNELKQGYKEKLVDIREEILRKRRAGKLPGDTASILKAWWQAHSKWPYPTEDDKARLVQETGLQLKQINNWFINQRKRNWHSNPTSSGEKTKKKR

SEQ ID NO: 40538 - DNA, 1308 bp, Panicum virgatum
  misc_feature: Ceres CLONE 2003543
  misc_feature: Encodes the peptide sequence at SEQ ID NO. 40539
agcgtcagccaagggcagccagccatgaacgcggcggcctccttcgtcgccgtggcgctggccctggcggccctcgtccccatctcgctgctgctcctgaaccggctcctctacggcaagctgccgccgggcccccgcccccgccccgtggtgggcaacctcttcgacgtgcagccggtgcgctgccgctgctaccaggagtgggcgcggcggtacgggcccatcatgacggtgtggctggggccggagccgacggtggtggtgtcgacggcggagctcgccagggaggtgctcaagacctacgaccagagcctcgccgaccgcaagcgcgaccgctcctcggagcgcttcagccgcggcggcaaggacctgatctgggccgactacggcccgcactacatcaaggtgcgcaagctctgcaacctcgagctcttcacaccgcgccgcctcgaggcgctcaggcccatccgcgaggacgaggtcaccgccatggtcgagtccgtgcacagggccgtcaccgcgccgggtacgcacacacactatcttccactgcttgctcgctctttgacttgttaattaagatagctgcttgctttagtttctgattgctcttgaaaacatcacttggcctcgcctcgctattgcttagtatgagattgctagctagaagtctagaactgaaagtagcgctacccattgattggacaaccgattcttgctgctgatgggcaacaaaaaatagatccacaacgacatgatggatttctggactgtggtccatggctgctggttggtggccagtcactgatcgagtcggcactgtattgtgtagaccatcctcttgtttagttgcaaagttcaaaatttcaaaaaaaattccgacacctgcatggagaattaaatctagacgaaataaaaaacgcattgcacagtttgcctataaattgcgatacgaatctaatgaacctaattatactgtaattagatgctaaattactacagtaatgctacagtaaccaacctctaatgatggattaattagactcattagattcgtctcgcgatttacagacgagttctgtaatttattttgtgattagtctatgtttaatatttcaaatgtaggaatgtgctctttcaaaaattttacacagcgcaactaaacaaggcccaggtgtgagtgaattttagcagaatcgaaggcaacaagctgcttaattaatgactgatgaatacttggcttttgtcatggggtgtgattacccgatttgccgaaactgatttttaaaatcttagctcattttccag

SEQ ID NO: 40539 - protein, 183 aa, Panicum virgatum
  misc_feature: Ceres CLONE 2003543
  misc_feature: SWISSPROT Homolog: EC 1.14.13.68 4-hydroxyphenylacetaldehyde oxime monooxygenase
  misc_feature: Useful for making plants with altered carbohydrate content
  misc_feature: Useful for making plants with altered lignin content
  misc_feature: The sequence is a functional homolog of SEQ ID NO 4 in US patent 7071376
  misc_feature: Useful for making plants with altered cell wall content and/or composition
  misc_feature: The sequence is a functional homolog of SEQ ID NO 6 in US patent 7071376
MNAAASFVAVALALAALVPISLLLLNRLLYGKLPPGPRPRPVVGNLFDVQPVRCRCYQEWARRYGPIMTVWLGPEPTVVVSTAELAREVLKTYDQSLADRKRDRSSERFSRGGKDLIWADYGPHYIKVRKLCNLELFTPRRLEALRPIREDEVTAMVESVHRAVTAPGTHTHYLPLLARSLTC

SEQ ID NO: 40540 - DNA, 549 bp, Panicum virgatum
  misc_feature: Ceres CLONE 2003557
  misc_feature: Encodes the peptide sequence at SEQ ID NO. 40541
gcggcttcttcctcccttcccacccctcccattccgcgccccgtgacgtcaccagccaccagcccaccaccagccgcctctctctgccgcccaccagaccgcgcgtcccgaggcggaggaggggaggggaggggagggcgatggcggtggtggggggcggggcgcggcgggggtggggggagggggggtgggccgcgctgcggagggggggggtgagggggggggaggggcggaagccggagcagctcctcggcctcgactcgctcatcatccccggcggcgagagcaccaccatggccaagctcgccaactaccacaacctgtttccagcacttcgagagtttgtcagtggtggaaagcctgtctggggaacctgtgctgggcttatctttcttgcaaacaaagcagtagggcaaaaaacagggggccaggaacttgtcggaggactagattgtactgtccaccgtaacttttttgggagtcagctccaaagctttgagacagagctttctgtgccgaagcttgctgagaaggaaggagggaatgata

SEQ ID NO: 40541 - protein, 136 aa, Panicum virgatum
  misc_feature: Ceres CLONE 2003557
  misc_feature (8)..(136): Pfam Name: SNO Pfam Description: SNO glutamine amidotransferase family
  misc_feature: SWISSPROT Homolog: EC 6.3.5.3 Phosphoribosylformylglycinamidine synthase
  misc_feature: Useful for making plants with modulated drought sensitivity
MAVVGGGARRGWGEGGWAALRRGGVRGGEGRKPEQLLGLDSLIIPGGESTTMAKLANYHNLFPALREFVSGGKPVWGTCAGLIFLANKAVGQKTGGQELVGGLDCTVHRNFFGSQLQSFETELSVPKLAEKEGGND

SEQ ID NO: 40542 - DNA, 724 bp, Panicum virgatum
  misc_feature: Ceres CLONE 2003565
  misc_feature: Encodes the peptide sequence at SEQ ID NO. 40543
aacaaagcccatccaacaaacaaaccttgaggcgcctggctgacagagaagagagacaagccgaggtaaccggctctagctttgcctcacgcttgtcccggtggcagggctaagcatggctaccgtggggcagcctggcgccctgagaaggatcaccgtgcactacgccaactcgcccacgcgcagcacgggagacgcggaccttgacgacctagacgacgacctgctccagtttgtgcttgctgatcttcttcctggccaggagggtctgcaccaatcgatcttggaagaagcatccagcaaccaaaaccacatgagaggtgccccatccgataattcacagtcacagcactaccatggggagagcagcactgctgcagctgcagcagcgactgcttccggaacttcaggaacggaagaacagatcgcctcggactttgagtacgccaagcggctgcaggagatggaggacctgagcatcgaggatgacgatatcagttgcgtgccctctccatcagactctgacgatgaccatgaccataacgacgaagaggctgacaggcaggatggtaatgatgacgatccagacaacatgacttatgagcaaaggcaagcactcgtggaagctgtggggactgaggacagaggtttacctgatgagctcatctcctatctgcatacatggacgtacaagggcttcagggttttttctcaggaagacaaa

SEQ ID NO: 40543 - protein, 202 aa, Panicum virgatum
  misc_feature: Ceres CLONE 2003565
  misc_feature: Useful for making plants with altered terpenoid content
MATVGQPGALRRITVHYANSPTRSTGDADLDDLDDDLLQFVLADLLPGQEGLHQSILEEASSNQNHMRGAPSDNSQSQHYHGESSTAAAAAATASGTSGTEEQIASDFEYAKRLQEMEDLSIEDDDISCVPSPSDSDDDHDHNDEEADRQDGNDDDPDNMTYEQRQALVEAVGTEDRGLPDELISYLHTWTYKGFRVFSQED

SEQ ID NO: 40544 - DNA, 926 bp, Panicum virgatum
  misc_feature: Ceres CLONE 2003567
  misc_feature: Encodes the peptide sequence at SEQ ID NO. 40545
aacaaacgctaaaaaagtaacagtttctgtactttattgaacagccacagacatgcccccgaaggcttccccgaagcccgctgccaagcccgccgccaaggccgccgcgcccgcgaaggccgctgcccccgctgccaagcaggcccctgccaagcaggcgcccgctaaggtcgcgccggccaagactgccgcgccggcggccaaggctgccgtgccggcggccaagcctgctgttgctggcaacggtgtgtacgtcaagggcctcggccaggccagcgttgatgccatcaagaccatcttccaggctgctggtaccgtcaccaacgtccgcgtccgccgcaacaagtacgccatcgtgttcttcgagaaccaggcgtccgtcaagaaggcgatcgaccagttcaacggcaaggaggttcagggccgcgaagttaccgtcaccgccgccaaggcggcgccgaagtcgacctcgtcgactgatgccgtgaccgtcttcgtctcgccgatcttccgccagaacacgacgcgcaaccaggtccgcgaggtcttcaagaactgcggtaagatcaccaagttgcgcacgtaccgcaccaaccacgccttcgtgaccttcgacaacgccgctgctgcccagaaggccatcaaggacatcaacggaaccaccttccgcaacaagaagctcctcgtgaaggcgtcggtgcgcaagtaagcgcaagtgtgtttcgttcgaagttttggcagaaggacgctatccgctaacggacggcttttggttctggtctgtcacacgcaggattttatccaacacgcgttgatcagttcctcgcgctgcggctcaatggccatccctctcgagggtacgacccccgcaggtcctttttcgtggcatggcatctgttcaacaaagaattcttcattccctcttc

SEQ ID NO: 40545 - protein, 218 aa, Panicum virgatum
  misc_feature: Ceres CLONE 2003567
  misc_feature (147)..(212): Pfam Name: RRM_1 Pfam Description: RNA recognition motif. (a.k.a. RRM, RBD, or RNP domain)
  misc_feature (66)..(129): Pfam Name: RRM_1 Pfam Description: RNA recognition motif. (a.k.a. RRM, RBD, or RNP domain)
MPPKASPKPAAKPAAKAAAPAKAAAPAAKQAPAKQAPAKVAPAKTAAPAAKAAVPAAKPAVAGNGVYVKGLGQASVDAIKTIFQAAGTVTNVRVRRNKYAIVFFENQASVKKAIDQFNGKEVQGREVTVTAAKAAPKSTSSTDAVTVFVSPIFRQNTTRNQVREVFKNCGKITKLRTYRTNHAFVTFDNAAAAQKAIKDINGTTFRNKKLLVKASVRK

SEQ ID NO: 40546 - DNA, 647 bp, Panicum virgatum
  misc_feature: Ceres CLONE 2003568
  misc_feature: Encodes the peptide sequence at SEQ ID NO. 40547
cagcaattgacatttggtctgctggatgtgtacttgctgagcttatgctaggacagcctttgtttcctggtgaaagtggtgtggatcaacttgttgaaatcatcaaggtccttggtacccctacaagggaagaaattaaatgcatgaacccgaattacactgagttcaaattcccacaaatcaaagcacacccatggcacaaggtatttcacaaaagaatggcaccggaagctgttgatctggtatcccggctgctccagtactcccccaatctgagatgcactgctgttgaggcacttgttcacccattctttgatgagcttcgagatcctaatacccgtcttccaaatggacgctttctgccaccccttttcaacttcaagccgcatgaactgaaaggagtcccagcagacattgtggcgaaattgatccctgaacatgcgaagaagcaatgcccctatgttggattgtaagatgatcgcgccttgaggctgaaaccacctgccaccgcaagtgtgaattttccctcgggatgttggatgattggcggcatgcacacctgtcggttgaagatgctaggttatacctgcgtgtacgacagctgtgacctgtgtagctgagtagtgtatgtcgcaatgacatgtacc

SEQ ID NO: 40547 - protein, 156 aa, Panicum virgatum
  misc_feature: Ceres CLONE 2003568
  misc_feature: SWISSPROT Homolog: EC 2.7.11.1 Non-specific serine/threonine protein kinase
  misc_feature: Useful for making plants with modulated water use efficiency
  misc_feature: Useful for making plants with modulated biomass
AIDIWSAGCVLAELMLGQPLFPGESGVDQLVEIIKVLGTPTREEIKCMNPNYTEFKFPQIKAHPWHKVFHKRMAPEAVDLVSRLLQYSPNLRCTAVEALVHPFFDELRDPNTRLPNGRFLPPLFNFKPHELKGVPADIVAKLIPEHAKKQCPYVGL

SEQ ID NO: 40548 - DNA, 497 bp, Panicum virgatum
  misc_feature: Ceres CLONE 2003571
  misc_feature: Encodes the peptide sequence at SEQ ID NO. 40549
gggccacgccgctgccggtcgtcgccttcggcggtagaaaacgtggactttcttccccccagcgcccgcttctggacgccgcggcggcgcagcccgagcagcagcgggtggcctcgctggacgtgttccgtggcttcaccgtcgccatgatgatactcgtggacgacgcgggtatcaaccacgcgccgtggttcggggtgacggtggcggacttcgtcatgcccgccttcctcttcatcatcggcgtctccgcggcactcgccttcaaggcacatctgacgttcccgtgtggggagtgaaatctgcttggtgctgtctcccactctacataaccgaatgccttgatgttagtttagtcggcaatttgagtagataagattattgactagcaggtttgtaaataatgtacgtattgtcataaggacacgtagactgcttacccgttctctttccagcaatgaaacaatgcgtttttccatcgactggtaagatctttc

SEQ ID NO: 40549 - protein, 98 aa, Panicum virgatum
  misc_feature: Ceres CLONE 2003571
  misc_feature: SWISSPROT Homolog: EC 2.3.1.78 Heparan-alpha-glucosaminide N-acetyltransferase
ATPLPVVAFGGRKRGLSSPQRPLLDAAAAQPEQQRVASLDVFRGFTVAMMILVDDAGINHAPWFGVTVADFVMPAFLFIIGVSAALAFKAHLTFPCGE

SEQ ID NO: 40550 - DNA, 678 bp, Panicum virgatum
  misc_feature: Ceres CLONE 2003604
  misc_feature: Encodes the peptide sequence at SEQ ID NO. 40551
agatgctattccctttcacttctcccattcaaactgtttcaaaatggactgttgacggaattattgctcatgtcaaatcagaaagtttgaaacattcgaagcataaggttgggcaatatgataaaagcacaaaagttaagctgaaattagatggtgacaaggatgttgggcgaaagaaccacagtgctgcatcaaagctatacaacgaggttgagcagcatggtaaaaacacgaaagataagctgaaattagatggtgacaagtctgttgggagaaaggactaccttgctgcatcaaagctctttggcgaggcaattgacctggatccaactgatgcaatactgtattcgaacaggagcttttgccttctgcaaattggtgaagcaacaaaggctctatctgatgccaattcttgcataaaggtgcggcctgaatgggtaaaaggttactacaggaaaggagccgccctcatgtcactcaaggagtataaagaagcatgtgatgcattccttgctgggttgaagctggaccctgcaaatgctgagatggagagaatgttccgggaggcagttgaggccatgaaggactgtgttggcttaaagaaccttgagtctatcgattagaggacccagcacgaaatatgcaagctctgggatttcttttgtgcggccagcccat

SEQ ID NO: 40551 - protein, 206 aa, Panicum virgatum
  misc_feature: Ceres CLONE 2003604
  misc_feature (146)..(179): Pfam Name: TPR_2 Pfam Description: Tetratricopeptide repeat
  misc_feature: SWISSPROT Homolog: EC 3.1.3.16 Phosphoprotein phosphatase
MLFPFTSPIQTVSKWTVDGIIAHVKSESLKHSKHKVGQYDKSTKVKLKLDGDKDVGRKNHSAASKLYNEVEQHGKNTKDKLKLDGDKSVGRKDYLAASKLFGEAIDLDPTDAILYSNRSFCLLQIGEATKALSDANSCIKVRPEWVKGYYRKGAALMSLKEYKEACDAFLAGLKLDPANAEMERMFREAVEAMKDCVGLKNLESID

SEQ ID NO: 40552 - DNA, 672 bp, Panicum virgatum
  misc_feature: Ceres CLONE 2003612
  misc_feature: Encodes the peptide sequence at SEQ ID NO. 40553
gcacggccaacatgtgggactacctgccggtgctgcggtggctcgacgtgttcggcgtgaggcacaagctcgtggccgcggtgaaccgaaggaatgcgttcctgcggcgactcgtcgacgcggaacggcggagagtgagcggcggcggcggcggcgacagtgagaagagcagcgtgattgccgtgctgctctcgctgcagaagtcggagccggaggtctacacggacaccatgatcctgtcgctgtgcgcgaatttgtttggcgccgggacggagacaatgtcgaccacgacggaatgggccatggcgctcctgctcaaccacccggagaagctcaagaaggcgcaggccgagatcgacgccgccgtgggcacctcccgcctcatcgccccggacgacttgccgcgcctcggctacctccagagcatcatcaacgagacgctccggctctacccggcggcgccgctgctcctgccgcaccagtcgtccgcggactgcaaggtgggcggctacgacgtgccccgcggcacgatgctgctggtgaacgtgtacgccatccacagggacccggcggtgtgggaggatccgaccgagttcaggccggagcgcttcgatgacggcaagaccgagggccggctgctgatgccgttcgggatggggcggcgcaagtgcc

SEQ ID NO: 40553 - protein, 223 aa, Panicum virgatum
  misc_feature: Ceres CLONE 2003612
  misc_feature (1)..(223): Pfam Name: p450 Pfam Description: Cytochrome P450
  misc_feature: SWISSPROT Homolog: EC 1.14.13.89 Isoflavone 2'-hydroxylase
  misc_feature: Useful for making plants with modulated nitrogen use efficiency
TANMWDYLPVLRWLDVFGVRHKLVAAVNRRNAFLRRLVDAERRRVSGGGGGDSEKSSVIAVLLSLQKSEPEVYTDTMILSLCANLFGAGTETMSTTTEWAMALLLNHPEKLKKAQAEIDAAVGTSRLIAPDDLPRLGYLQSIINETLRLYPAAPLLLPHQSSADCKVGGYDVPRGTMLLVNVYAIHRDPAVWEDPTEFRPERFDDGKTEGRLLMPFGMGRRKC

SEQ ID NO: 40554 - DNA, 680 bp, Panicum virgatum
  misc_feature: Ceres CLONE 2003623
  misc_feature: Encodes the peptide sequence at SEQ ID NO. 40555
acaatccaaaaccattggtataattaatcagaaaccaattccaaaacaatatataaatagctagtttcagtacaagctttgcaactcaattatagaagtgttaattaacaattaacaacaatggctgcctctatgatctcctcttcagctgtgactacagttaaccgcgcctcgtcggttcaatccggcgcggtggctccatttgttggactcaagtccatggctggcttcccagttacaaagatcaacaaggacattacctccattacaagcaatggtggaagagtaaactgcatgcaggtgtggcctcctattgggaagaagaagtttgagacactttcataccttccaccattgaccagagaacaattggcgaaagaagttgattaccttataaggaagggatgggttgcttgcttggaatttgagaccgagaaaggatttgtgtaccgtgagaaccacaagtcaccaggatactatgatggacgttactggacaatgtggaagttgcctttgtttggagcaaccgattcttctcaagtgttgaaggagcttgatgaagctattgctgcttaccctgatgcctttgtccgtatcatcggattcgacaacgttcgtcaagttcaatgcatcagtttcattgcacacacacctgcagtctactaaagtcattgcattgg

SEQ ID NO: 40555 - protein, 181 aa, Panicum virgatum
  misc_feature: Ceres CLONE 2003623
  misc_feature (69)..(178): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAASMISSSAVTTVNRASSVQSGAVAPFVGLKSMAGFPVTKINKDITSITSNGGRVNCMQVWPPIGKKKFETLSYLPPLTREQLAKEVDYLIRKGWVACLEFETEKGFVYRENHKSPGYYDGRYWTMWKLPLFGATDSSQVLKELDEAIAAYPDAFVRIIGFDNVRQVQCISFIAHTPAVY

SEQ ID NO: 40556 - DNA, 717 bp, Panicum virgatum
  misc_feature: Ceres CLONE 2003630
  misc_feature: Encodes the peptide sequence at SEQ ID NO. 40557
gcatcagcgtagcaggcaacagcaatctcgaggagcaggtagtagagcgctaagcttccggtgcgtggatcgaatagcggaagcgaagatggtgaagctcgcgttcgggagcgtcggcgactccttcagcgccacctccatcaaggcctacgtggccgagttcatcgccaccttgctcttcgtcttcgccggcgtcggttccgccatcgcctacgggcaactgacccatggcggcgcgctcgaccctgccggcctggtggcgatcgcgatcgcccacgcgctggccctcttcgtcggcgtctccatcgccgccaacatctccggcggccacctgaaccccgccgtgaccttcggcctcgccgtcggcggccacatcaccatcctcaccggcctcttctactgggtcgcccagctgctcggcgcctccgtggcgtgcctgctcctcaagttcgtcacccacggcaaggccatcccgacccacggcgtcgccggcatcagcgcgctggagggcgtggtgttcgagatcatcatcaccttcgcgctcgtctacaccgtgtacgccaccgccgccgaccccaagaagggctccctcggcaccatcgcccccatcgccatcggcttcatcgtcggcgccaacatcctcgccgccgggcccttcagcggcggctccatgaaccccgctcgctccttcggccccgccgtcgccgcgggcaactt

SEQ ID NO: 40557 - protein, 209 aa, Panicum virgatum
  misc_feature: Ceres CLONE 2003630
  misc_feature (11)..(209): Pfam Name: MIP Pfam Description: Major intrinsic protein
MVKLAFGSVGDSFSATSIKAYVAEFIATLLFVFAGVGSAIAYGQLTHGGALDPAGLVAIAIAHALALFVGVSIAANISGGHLNPAVTFGLAVGGHITILTGLFYWVAQLLGASVACLLLKFVTHGKAIPTHGVAGISALEGVVFEIIITFALVYTVYATAADPKKGSLGTIAPIAIGFIVGANILAAGPFSGGSMNPARSFGPAVAAGN

SEQ ID NO: 40558 - DNA, 566 bp, Panicum virgatum
  misc_feature: Ceres CLONE 2003633
  misc_feature: Encodes the peptide sequence at SEQ ID NO. 40559
ctagctagcgccggcgccgcagcctcctcctaccccccttccctcgcgcagccgcccaccgccgagatggccccgaagaaggacaaggccccgccgccgtcatcgaagccggccaagtctggcggtggcaagcagaagaagaagaagtggagcaagggaaagcaaaaggagaaggtgaacaactcggtgctcttcgaccagcccacctacgacaagctgctctccgaggtgcccaagtacaagcagatcaccccctccgtcctctctgagcgcctcaggatcaatggctccctggctcggagggcgatcaaggacctgatggctcgtggcctcatccggatggtctcggtgcactcaagccagcagatctacaccagggcaaccaacacctaaggctgtaatgcctttgtttgcctctgtagtaggaggtcctgctttagagcacttgtcatctttgccaagagtttgctaatgttgtcacctgtgatgactatctctatgtggctgagacatttcacagattttgcccattagttcggtactatggtttgcctgttacttgtttc

SEQ ID NO: 40559 - protein, 108 aa, Panicum virgatum
  misc_feature: Ceres CLONE 2003633
  misc_feature (1)..(106): Pfam Name: Ribosomal_S25 Pfam Description: S25 ribosomal protein
MAPKKDKAPPPSSKPAKSGGGKQKKKKWSKGKQKEKVNNSVLFDQPTYDKLLSEVPKYKQITPSVLSERLRINGSLARRAIKDLMARGLIRMVSVHSSQQIYTRATNT

SEQ ID NO: 40560 - DNA, 1466 bp, Panicum virgatum
  misc_feature: Ceres CLONE 2003634
  misc_feature: Encodes the peptide sequence at SEQ ID NO. 40561
ggggcggcgtttccaacatccacccgacgaccatcgcaccgactcctgcctgatccggcggcccaattagctgctgcgtaccatcaaagcccactccgatacgcagcctggccccgatgtgccggcattgacgccttgcctgttgctgatattccgcggtctctgtagagcggcttgctcttcctcgattcccgacaatgctgcaaccgcggttccggcccctgctggccggggcggcgcgggcggtctcgctacctgccctgtgccagagggctctccggctgaacaacaaccccatcaggcgctactcggccgagacacagatggctaccacgaaggcgtcgtcgggtgaagacggcaccgaggccgggccaccctcgaacgagatcgaggccgtcaagatgcgcacgtacaagccaaggacacccggtcttcggcatctcaagcggcccatcaacgagcacctatggaagggcaggccgtatctcccattgacgtttcccaaaaaaggccacggcaagggcggcagaaacaacaccggccggattaccatcagacatcgcggaggcggcgccaagcggaggattcggacggtcgacttcaagcggtggacgccggggccgcacacagtcgagcgcatcgagtacgacccgggccggagcgcgcacatcgccctgctgacggagcaggcgacgggcaagaagagctacatcgtggcggccgagggcatgcgcgccggagacgtggtgcagagctaccgggccggtatcccccaggacctgctcgacagcatgggaggtgttatcgatcccggtattctggccgccaagacggcgtggagaggaaactgcctgccgatgcacctgatccccgtcggcaccgtcgtgtacaatgtcgggtcgcggccggacggcggcgccgtcttctgccgcagcgccggcacgtacgcgaccattgtgtccaaggaggaggagacgcgggacgacggcaccaaggtcatgaccgggaagcacgtgattgtccggttgcagagcggcgagatccgcaaggtcagcaaggacgcctgcgcaaccattggcgttgccagcaacgtcatgcaccagtacaggcagctgggcaaggccgggcgcagccggtggctgaacatccggcccacggtgagaggcgtggccatgaacgcgaatgaccatccgcacggtggtggtcgtggcaagtcgaagggtaacaggaacccagtcagcccgtggggccagcccgccaagggcggcttcaagacgcgcaagaagcacaacatcaacaagtgggtggtcaccccgcgggtgcgcaacatgggcaagcggagagacaagaacatggcctagtggatgcggaggctgtgttggtgttggtgaggcgcgggcggatatggcttgtacattatgtagatttacgaacctgttattcccggacggcgggcttgatgagcg

SEQ ID NO: 40561 - protein, 387 aa, Panicum virgatum
  misc_feature: Ceres CLONE 2003634
  misc_feature (213)..(353): Pfam Name: Ribosomal_L2_C Pfam Description: Ribosomal Proteins L2, C-terminal domain
  misc_feature (110)..(186): Pfam Name: Ribosomal_L2 Pfam Description: Ribosomal Proteins L2, RNA binding domain
MLQPRFRPLLAGAARAVSLPALCQRALRLNNNPIRRYSAETQMATTKASSGEDGTEAGPPSNEIEAVKMRTYKPRTPGLRHLKRPINEHLWKGRPYLPLTFPKKGHGKGGRNNTGRITIRHRGGGAKRRIRTVDFKRWTPGPHTVERIEYDPGRSAHIALLTEQATGKKSYIVAAEGMRAGDVVQSYRAGIPQDLLDSMGGVIDPGILAAKTAWRGNCLPMHLIPVGTVVYNVGSRPDGGAVFCRSAGTYATIVSKEEETRDDGTKVMTGKHVIVRLQSGEIRKVSKDACATIGVASNVMHQYRQLGKAGRSRWLNIRPTVRGVAMNANDHPHGGGRGKSKGNRNPVSPWGQPAKGGFKTRKKHNINKWVVTPRVRNMGKRRDKNMA

SEQ ID NO: 40562 - DNA, 680 bp, Panicum virgatum
  misc_feature: Ceres CLONE 2003655
  misc_feature: Encodes the peptide sequence at SEQ ID NO. 40563
tttcatcaaaacactaaaacaaaatggaaggcaaaaagatcaaggttcaaaaccccgttgctgaactcgatggtgatgaaatgaccagaatcatctggaagctcatcaaggatgaactcatcactcctttcttggatctcaacatcctctacttcgatctcggtatggaacacagagacgccaccaacgatcaagtcactcttgatgctgctaaggccatcaaggaatgcaaagtcggtattaagtgcgccaccatcactcccgatgaggccagagttaccgaattcggcttgaaggaaatgtggaagtcccccaatggtaccatcagaaactacctcaacggtactgtcttcagagaacccatcatctgcaagaacgtccccaagctcgtccccggatggactaagcccatcgttatcggcagacacgctttcggtgatcaatacagagccactgatttcgtcgtcgacagacccggtaaatacgaaatcaccttcactccagaagacggaagtgcccccaagaaatacgaagtcttcaactatcccggcggtggtgttgccctcggtatgtacaatactgatgattccatcaaggaattcgctcatgcttctttcaagtatgccatcaacagaaagtaccccctctacttgtccaccaagaacaccatcctcaagaag

SEQ ID NO: 40563 - protein, 218 aa, Panicum virgatum
  misc_feature: Ceres CLONE 2003655
  misc_feature (7)..(218): Pfam Name: Iso_dh Pfam Description: Isocitrate/isopropylmalate dehydrogenase
  misc_feature: SWISSPROT Homolog: EC 1.1.1.42 Isocitrate dehydrogenase (NADP(+))
MEGKKIKVQNPVAELDGDEMTRIIWKLIKDELITPFLDLNILYFDLGMEHRDATNDQVTLDAAKAIKECKVGIKCATITPDEARVTEFGLKEMWKSPNGTIRNYLNGTVFREPIICKNVPKLVPGWTKPIVIGRHAFGDQYRATDFVVDRPGKYEITFTPEDGSAPKKYEVFNYPGGGVALGMYNTDDSIKEFAHASFKYAINRKYPLYLSTKNTILK

SEQ ID NO: 40564 - DNA, 531 bp, Panicum virgatum
  misc_feature: Ceres CLONE 2003681
  misc_feature: Encodes the peptide sequence at SEQ ID NO. 40565
agaaggaacagcaagaacagaaaaccaaaggagcaatcccagcaatggcagcaaggtgtgctctttctgccccatccagcttggttcgccaacccctctgcggcaacaagctcgccaagaaactcactccatgcctgccgtcgccaagagccgtgagggtgagagtgaatgctgcaaagcttcctccaggggttgaggtgcccagggtgcagccgaagctgagcgagcccttcttggggttcacccagactgccgagatctggaactccagggcctgcatgatgggcctcatcggcaccttcatcgtggagctggtgctgaacaaggggattcttcagataattggggtggaggtggggaagggcctcgaccttcctctttaattgccattggcaaagctagctgattgcaagccttactatctctcttttttaaacctacctattatattgctctaaacattattctgtcgaatgaagatactcatgcaattctgttgcgtaaccatatgacagagttttttaagttctc

SEQ ID NO: 40565 - protein, 112 aa, Panicum virgatum
  misc_feature: Ceres CLONE 2003681
  misc_feature: SWISSPROT Homolog: EC 4.99.1.1 Ferrochelatase
MAARCALSAPSSLVRQPLCGNKLAKKLTPCLPSPRAVRVRVNAAKLPPGVEVPRVQPKLSEPFLGFTQTAEIWNSRACMMGLIGTFIVELVLNKGILQIIGVEVGKGLDLPL

SEQ ID NO: 40566 - DNA, 719 bp, Panicum virgatum
  misc_feature: Ceres CLONE 2003689
  misc_feature: Encodes the peptide sequence at SEQ ID NO. 40567
tccctgccccaaagcagagctgaaacaagaccatgtcgtcgtccaaggtcttcaccctcgaggaggtcgctaagcacaacaccaaggacgactgctggctcatcatcgctggcaaggtgtacaatgtgaccaagtttcttgaggatcaccctggaggtgatgatgttctgttgtcctccactgccaaggatgctactgatgacttcgaagatgtgggccacagcaccactgctcgtgcgatgatggacgagtacttagtcggtgaaattgatgcaactacaatacccactaaggtgaagtacatgcccccgaagcagccgcactacaaccaggataagacccctgagttcatcatcaagattctccagtttttggtccccttggcgatattgggcttggctgtcgccgtaaggatctacaccaagtcggaatccacctaattattgtcatcacttggccaaagattacaactgaataagttagtgaggattgtacgagcgagcatggcctgtcatgaatttggaaactttagtctctgtgatggtatgattacgtgcaacatctattggtaaattgagactcgagtgaagtggatggatattcagttttatttttccttattccttaggaatgtcgagatgcacattattgttgttctgtgccgtttgttttctatgttgtcacctgttcttagcgatatatgttttgctacatactcc

SEQ ID NO: 40567 - protein, 135 aa, Panicum virgatum
  misc_feature: Ceres CLONE 2003689
  misc_feature: SWISSPROT Homolog: EC 1.7.1.1 Nitrate reductase (NADH)
MSSSKVFTLEEVAKHNTKDDCWLIIAGKVYNVTKFLEDHPGGDDVLLSSTAKDATDDFEDVGHSTTARAMMDEYLVGEIDATTIPTKVKYMPPKQPHYNQDKTPEFIIKILQFLVPLAILGLAVAVRIYTKSEST

SEQ ID NO: 40568 - DNA, 1098 bp, Panicum virgatum
  misc_feature: Ceres CLONE 2003694
  misc_feature: Encodes the peptide sequence at SEQ ID NO. 40569
aagcgaaaaagagttatttactctatactttaagaggttcctgtgccacgatggatcctcgtatggctcgtctgttcgggcagggcggcggtatgcccggaatggggatgggtccgccgccggaccgcaacgtcgctgacacggccgaaaccacgcacatctcatcgctcgctctcctcaaaatgctcaaacacggccgcgccggtgtgccgatggaggttatggggctgatgctcggcgacttcatcgacgaatacacggttcaggtcgttgatgtgttcgcgatgccgcagtccggtaccggtgtgtccgtcgaagccgtcgatccggtatttcagatgaaaatgcttgaaatgttgaaaatcacgaatcgaccgcagatggtggtggggtggtaccactcccatccgggctttggatgttggttgtccggcgtcgacgtcaacacacagcaatccttcgaacagctcaacaaacgcgccgtcgccgtcgtcgtcgatccgattcagtccgtgaaaggcaaagtcgtgattgacgccttccgcctcatcaatccgcaattgatgatgatgggtcaggcgccgcgtcagacgacgtccaatttgggtcatctccgaaaaccgtcgattcaggcgctcattcacaatctgaaccgacactattactcgatcaacattgattaccgcaaaaacgagctcgaacagaagatgctcctcaatctccataaaaagagttgggcgcacggcctgaaaatcacgaaccccgaagaacactccaaacagaacgagaaaacgatgacgtcgctgttggacttctcgaagcagtacaacaaacgattggaagaggaagaaacgaagacgccggacgaagtcgcactcctcaatgtcggaaagctcgatccgaagaagcatttggaaaacgacgtcgaagagttgatggcgagcaacatcaatcagcttttgggcacaatgctcgacaccgtcgtcttttagatttgttcgcagtcctctccgacaaacagaacattttccgtcctctcttcttttcgtaccttttcgcgccgccgttcttgcgtccccgtaaatggttcttgtctcc

SEQ ID NO: 40569 - protein, 313 aa, Panicum virgatum
  misc_feature: Ceres CLONE 2003694
  misc_feature (30)..(143): Pfam Name: Mov34 Pfam Description: Mov34/MPN/PAD-1 family
  misc_feature: Useful for making plants with altered terpenoid content
  misc_feature: Useful for making plants with altered alkaloid content
MDPRMARLFGQGGGMPGMGMGPPPDRNVADTAETTHISSLALLKMLKHGRAGVPMEVMGLMLGDFIDEYTVQVVDVFAMPQSGTGVSVEAVDPVFQMKMLEMLKITNRPQMVVGWYHSHPGFGCWLSGVDVNTQQSFEQLNKRAVAVVVDPIQSVKGKVVIDAFRLINPQLMMMGQAPRQTTSNLGHLRKPSIQALIHNLNRHYYSINIDYRKNELEQKMLLNLHKKSWAHGLKITNPEEHSKQNEKTMTSLLDFSKQYNKRLEEEETKTPDEVALLNVGKLDPKKHLENDVEELMASNINQLLGTMLDTVVF

SEQ ID NO: 40570 - DNA, 976 bp, Panicum virgatum
  misc_feature: Ceres CLONE 2003705
  misc_feature: Encodes the peptide sequence at SEQ ID NO. 40571
agccagccaccaccaccaccagccagccatgctcgcccgccgccgcgggtgaggcgaggcggggctgggcccttccgagagacgcgacgccgtccaccgcgcgcgccgccggcatggatccggcgtccgaggagctcgagcgccgcacccgctacctcagctcgctcatccgccgcaccaagctcggagccgccccggcgcccgctcctcttcccgtgccggagcccgaggcggcggcaccgaaccctgagccggagccggagcccgccgtcgggaggcgcggggaagtcaagcctgcgctggcggcggtggaagaggaggagaagcgggggctcagaggggagggcggcggcgccaaggggaaagagatcaaggcgaaagttgaggggggtctcaaggaggagggcggcgccaggaaggtgtcggtgcgggtgcgggcggccgacatggccctgccgctgcagcgccgcgccgtccggctcgcctgcgaggccatcgccgccatgccgcgcctcgacagcaagcgcctcgcgctcgcgctcaagaaggaatttgacacagcatatggccctgcttggcattgcattgttggaacaagctttggttcctatgtgactcactcattgggaggtttcttgtacttctcagtggacaaggcctatattcttctcttcagaaccgctgttgagccattaggccatccatgatgaggggccatgaaccagtctgctagctagtgtactctgtattcctcatttaactgcagaaggtttaaggagagtagagcaatcatcgccctccatgcaaatatgtaggacccaatctgttcatctgttgtaaccatcttcatgtactatgtactaatctgccatgtgaaccttaacattagctttcgggatgttacttgactcggttcttcagtgcgaggggaatttctttcgcatcctgcaatgtccagtaaccttgttcgctttgg

SEQ ID NO: 40571 - protein, 197 aa, Panicum virgatum
  misc_feature: Ceres CLONE 2003705
  misc_feature (100)..(190): Pfam Name: Dynein_light Pfam Description: Dynein light chain type 1
MDPASEELERRTRYLSSLIRRTKLGAAPAPAPLPVPEPEAAAPNPEPEPEPAVGRRGEVKPALAAVEEEEKRGLRGEGGGAKGKEIKAKVEGGLKEEGGARKVSVRVRAADMALPLQRRAVRLACEAIAAMPRLDSKRLALALKKEFDTAYGPAWHCIVGTSFGSYVTHSLGGFLYFSVDKAYILLFRTAVEPLGHP

SEQ ID NO: 40572 - DNA, 771 bp, Panicum virgatum
  misc_feature: Ceres CLONE 2003707
  misc_feature: Encodes the peptide sequence at SEQ ID NO. 40573
cgggtagtacacggcagtagcgaaacggtgggtagctctagctcgagcaggcagccatccctggcgccggaacggagcacacacatcgatcgctagctgtaagtgtcctctctgtccctgagatggcgggagcgaaggtgtactcgttccaggaggtggggaagcacaacgaccgcaaggattgctggctcatcatcgccggcaaggtgtacgacgtcacgccgttcatggaggagcaccccggcggcgacgaggtcctgctggcgtgcacaggcaaggacgcgacggccgactacgtggacatcggccacagcgagtccgccaaggagctcatggcgcagtactgcatcggcgaggtcgacgcggccaccgtcccggccaagctcacctacacctaccccagcgacgcgagcctcgagaagccgtcgacgggctcgggcgcctgggccacgacgctcctgcaggtcgccgcgcccctcctgctgctggcgctggccttgggggtgcagacctacggcaaggtcaaggcagagtagacggcgagcacgagatgccgtcgttgattccgcggggccgcatcgctgcagcctcttggaagcatctgggagttagttgatgtgtttgcttgtgacgatgtggtccacctcaactgctgcgtatgctaaatttaagaattcctggatactgtgacgaagtatatgtatgtcgaacagggtgtgtactgctaatcacgttttcgtggtttctaaaaaataatctgaattttgtttc

SEQ ID NO: 40573 - protein, 137 aa, Panicum virgatum
  misc_feature: Ceres CLONE 2003707
  misc_feature: SWISSPROT Homolog: EC 1.7.1.1 Nitrate reductase (NADH)
MAGAKVYSFQEVGKHNDRKDCWLIIAGKVYDVTPFMEEHPGGDEVLLACTGKDATADYVDIGHSESAKELMAQYCIGEVDAATVPAKLTYTYPSDASLEKPSTGSGAWATTLLQVAAPLLLLALALGVQTYGKVKAE

SEQ ID NO: 40574 - DNA, 626 bp, Panicum virgatum
  misc_feature: Ceres CLONE 2003713-R
  misc_feature: Encodes the peptide sequence at SEQ ID NO. 40575
ccgtcatcaagtccgccacctcctcctcatcgtcctcgtcccgcggccgcgaggctgcccccgctcctgctcctgcggccgccgccgcacccgcgtcgccggctccggctaagcccgccgccgccgcgatcgacatggacgtggtgctcggggtgatgggcgccggcggcgccgccgtgtcggtggggttcgaggaggccgcggcgctgttcgacgaggaggaggcgaccgtggaggaggcccgcgccgcgttcgcggtcttcgaccgcgacggcgacgggttcatcgacgccgcggagctccggagcgtgctcgggtcgctcgggctcggcgccgccgccggcgccgcggagtgccagcgcatgatcgacgcgtacgacgaggacagggacggcaggatcgacttcagcgagtttgtcaagctcatggagacgagctcgtgagttagaatagggactaattggacagccgggccggaggcccggatgactcggtcggatttgttcagagattctttgttcgtttgttctttctatgtttttcttggccggaatcgagccgaatgatgcatacagtacatgtgtatactcaaaatctagatatggatacatgattttctgaagatc

SEQ ID NO: 40575 - protein, 146 aa, Panicum virgatum
  misc_feature: Ceres CLONE 2003713-R
  misc_feature (79)..(107): Pfam Name: efhand Pfam Description: EF hand
  misc_feature (117)..(145): Pfam Name: efhand Pfam Description: EF hand
VIKSATSSSSSSSRGREAAPAPAPAAAAAPASPAPAKPAAAAIDMDVVLGVMGAGGAAVSVGFEEAAALFDEEEATVEEARAAFAVFDRDGDGFIDAAELRSVLGSLGLGAAAGAAECQRMIDAYDEDRDGRIDFSEFVKLMETSS

SEQ ID NO: 40576 - DNA, 594 bp, Panicum virgatum
  misc_feature: Ceres CLONE 2003713
aaccatcgaacgccaaaccctccggccaccatcggtgtcgcggaagtccagagggagtcgatccaaggcggcgcgctgcaggacgccgacgcggcgggatcaaggaagaaaggaaccagggcaagcgagcgaggttctcataggctccgacgaccgccatggacatggcctccgcgtccgcgcccagcacctcctcccacaacatctccctggcgcaggccgtgctgacgctctccatcaacgccgtcctcgtcttcctcaccgccgtcatcaagtccgccacctcctcctcatcgtcctcgtcccgcggccgcgaggctgcccccgctcctgctcctgcggccgccgccgcacccgcgtcgccggctccggctaagcccgccgccgccgcgatcgacatggacgtggtgctcggggtgatgggcgcgggcgcggaggccatgtccgtggcggtcgtcggagcctatgagaacctcgctcgcttgccgtggttcctttcttccttgatcgcgccgcgtcggcgtcctgcagcgcgccgccttggatcgactccctctggacttccgcgacaccgatggtggccggagggtttgg

SEQ ID NO: 40577 - DNA, 518 bp, Panicum virgatum
  misc_feature: Ceres CLONE 2003716
  misc_feature: Encodes the peptide sequence at SEQ ID NO. 40578
acccccaccagttcaccgtgcccgccgcgccctcattccccgcaggccgcagcaagcagatcgccttccagaaccttctcgccgccgtcgtagccgaagcaatggccggattcggatcgaaggccctcgccgtggtcgccgtcctggcggctgccgccctctccgtggcctccgctgccgacgcgccggcgcccagccccgtctccgccgccggcgccgcggccccgcccttcgccgccgccctcgtggcctccgccgccgccttcctcttcgccgccgtccgccactgagcccgcggatgggcagtaccgctaccgccgcctagatctatttactttattagagatggatttctgggatgtgtttctaccgcgtcgtggtgtgtcgggttgcgtgatcccccttgtagatagtctgctatctcgttcgtgagtgggatggttcggtctggttgctactgatattatcaatattattatctgtcccatttgagatgatgatgatgatgccttgctgtt

SEQ ID NO: 40578 - protein, 62 aa, Panicum virgatum
  misc_feature: Ceres CLONE 2003716
  misc_feature: Useful for making plants with altered carbohydrate content
MAGFGSKALAVVAVLAAAALSVASAADAPAPSPVSAAGAAAPPFAAALVASAAAFLFAAVRH

SEQ ID NO: 40579 - DNA, 683 bp, Panicum virgatum
  misc_feature: Ceres CLONE 2003738
  misc_feature: Encodes the peptide sequence at SEQ ID NO. 40580
aaccatcccaaacacaggctactcagaagcttgctgtagcaagcagctcatagcacacttgaagctatagctagctaatagaaatggcgcagcatgccctgtttctcgccctgactgtcctcgccttcgcggcggcagtgcacggctgtacgccgtcctgtcctaccccaccagtggttcccaccccgtcggtcgtgccgccgccgtccggtggcggcggttcctgcccaatcaacgcactgaagctggaggtgtgcgccaatgtgttgaacctcctgaagctcaacatccctgtctcggggaacgaccagtgctgcccgctgctgcaggggctcgtcgaccttgacgccgcagtctgtctctgcactgctatcaaggccaatgtcctcggcatcaacctcaatgtgcccatcgacctgagcctcctcctcaaccactgtggcaagatctgccctgcagatttcacctgccccaactaactagctactgaaacgttccacacgcccatgcatcatctgaatcttcatccatccactgccttgttgcctacgatcttgtgcacctatatatgccttctgtctgtgttggtttgcatcagcatgcacccctatatgtgttctcttctgttaaggttcgagtgatgcatggctcaagagaggtgatgtcatgcaaagtgttgttct

SEQ ID NO: 40580 - protein, 131 aa, Panicum virgatum
  misc_feature: Ceres CLONE 2003738
  misc_feature (48)..(129): Pfam Name: Tryp_alpha_amyl Pfam Description: Protease inhibitor/seed storage/LTP family
  misc_feature: Useful for making plants with modulated biomass
  misc_feature: Useful for making plants with modulated flowering time
  misc_feature: Useful for making plants with modulated salt sensitivity
MAQHALFLALTVLAFAAAVHGCTPSCPTPPVVPTPSVVPPPSGGGGSCPINALKLEVCANVLNLLKLNIPVSGNDQCCPLLQGLVDLDAAVCLCTAIKANVLGINLNVPIDLSLLLNHCGKICPADFTCPN

SEQ ID NO: 40581 - DNA, 686 bp, Panicum virgatum
  misc_feature: Ceres CLONE 2003743
  misc_feature: Encodes the peptide sequence at SEQ ID NO. 40582
aggtggaagaacccccacgcccggagcggaggggaggagaaggaaaggacgagatgacgatccggttcgtgctgttcgtgaacaagcagggccagacgcgggtggcgcagtactacgagcacctctccctcgacgagcgccgcgccctcgagggcgagatcgtccgcaagtgcctcgcccgcacagaccagcagtgctcgttcgtggagcaccggaactacaaggtcgtgtacaggcgctacgcctctctcttcttcctcgtcggcgtcgacaacaatgagaatgagttagctatccttgaattcatacatcttttggtggagactatggatcgccactttggcaatgtgtgcgagcttgacatcatgttccacctggagaaggtgcactttatgctggaagagatggtgatgaatggttgcattgtggagacaagtaaacagaacatcttggcaccgatccagcttatggagaaatcttcttaaagtattcagtctgtctggttttccatcctctgataattcaacaagtaatgatcaaatgtgcatgtgtggagattttgttggtttcataaatgatgcaagacagacttgatgaagtattttgtcatcacgattatttgatagtcatgaagttagcaagcctgtatgatttacatgttctagtgtaatagatgcaattgttgt

SEQ ID NO: 40582 - protein, 143 aa, Panicum virgatum; identical to SEQ ID NO: 29153
  misc_feature: Ceres CLONE 2003743
  misc_feature (2)..(143): Pfam Name: Clat_adaptor_s Pfam Description: Clathrin adaptor complex small chain
  misc_feature: Useful for making plants with modulated oxidative stress sensitivity

SEQ ID NO: 40583 - DNA, 680 bp, Panicum virgatum
  misc_feature: Ceres CLONE 2003744
  misc_feature: Encodes the peptide sequence at SEQ ID NO. 40584
gcaaaagccacacacgcgcatccgggaaagcggagccctaatctcaaggccgcggctgccagcgctccctctcctccccagccgcctgccgagctcgccggcgcgctcgcctacctccccgctcctccgggttctcgggatggaggccgaggcggcggccaagagggcgcgggagacctcggaggacgccgtggcggcgggggtggggaccgattcggcggccggtgccggcgagcaggcggggatctccgccgtcatccccggatggttctccgagatcagccccatgtggcccggtgaggcgcactctttgaaggtggagaaggtgctgttccaagggaagtcggactaccaaaatgtcatggttttccagtcctctacgtacggcaaggtgctggtgctggatggagtgatccaggttactgagagggatgaatgcgcataccaagagatgatcacccatctccccctttgctccatcaaagatcccaagaaggtgttagttataggaggaggagatggtggtgttctgcgtgaggtttcacgacattcctctgtggaacaaattgacatttgtgaaattgacaagatggtggtagatgtctccaagcaatttttccctcatctggctgttggatttgaagaccctcgtgtgtcattacacattggagatggcgtgg

SEQ ID NO: 40584 - protein, 180 aa, Panicum virgatum
  misc_feature: Ceres CLONE 2003744
  misc_feature (42)..(180): Pfam Name: Spermine_synth Pfam Description: Spermine/spermidine synthase
  misc_feature: SWISSPROT Homolog: EC 2.5.1.16 Spermidine synthase
MEAEAAAKRARETSEDAVAAGVGTDSAAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGV

SEQ ID NO: 40585 - DNA, 1043 bp, Panicum virgatum
  misc_feature: Ceres CLONE 2003747
  misc_feature: Encodes the peptide sequence at SEQ ID NO. 40586
ctctcccccggtcaaagccagcacgacaacacacgagtccgcccagcttgcccccctcgctcgcttctctccctgcccgctgccggcccgggcctccatccccccgccacgcctcccgcgtgccggccccggccccgcattcctccccgcgccgctccgccgccgaatcgggcggaatccgagaggggggatggggtcgccgggggcggggagcagcggcggcggccacgagtgctccttcaagatcctcctcatcggggactcgggcgtcggcaagagcagcctcctcgtcagcttcgtcgccgcctcccacctcgacgacgacatcgcgccgaccatcggagtggattttaaaatcaaattccttacagttggtggaaagaaactaaagttgacaatatgggatactgctggccaagagaggtttaggacaatcactagttcttactacagaggtgctcagggaattattctagtatatgatgttacaaagcgtgagagtttctcaaatttggctgatgtgtggactaaggaaattgaagcaaactcaacaaacaaagactgcataaaaatgcttgttggaaacaaagttgacaaggatgatgaaagaatggtcacaagagaagaaggccttgcctttgcagaagaatctgggtgtctatttctcgagagcagtgcaaaaacacgagaaaatgttgagaaatgttttgaagaacttgcattaaagattctcgaggtcccaagtctcctggaggaagggtcttcttcggttgtcaagaggaacatcctcaaacagaagcaggaaaatcatgcaaagcacggtggtggatgctgtcaataaatgagccaatcccctcggcacgtttggtcgtcttcgtgtgagctgcccttatgttctgctgtaaatgatttgtatctacatggtctatgagtaaaaagggggttacataatcagcttgggggttttttggttagtgattacaattgatttgtacaaaggagatgtggcctcttttcggtgttattcaattttttttcgatcc

SEQ ID NO: 40586 - protein, 216 aa, Panicum virgatum
  misc_feature: Ceres CLONE 2003747
  misc_feature (18)..(182): Pfam Name: Ras Pfam Description: Ras family
  misc_feature (18)..(135): Pfam Name: Miro Pfam Description: Miro-like protein
  misc_feature: SWISSPROT Homolog: EC 2.7.11.1 Non-specific serine/threonine protein kinase
  misc_feature: Useful for making plants with altered lignin content
MGSPGAGSSGGGHECSFKILLIGDSGVGKSSLLVSFVAASHLDDDIAPTIGVDFKIKFLTVGGKKLKLTIWDTAGQERFRTITSSYYRGAQGIILVYDVTKRESFSNLADVWTKEIEANSTNKDCIKMLVGNKVDKDDERMVTREEGLAFAEESGCLFLESSAKTRENVEKCFEELALKILEVPSLLEEGSSSVVKRNILKQKQENHAKHGGGCCQ

SEQ ID NO: 40587 - DNA, 574 bp, Panicum virgatum
  misc_feature: Ceres CLONE 2003750
  misc_feature: Encodes the peptide sequence at SEQ ID NO. 40588
atctcctcatcaaaagcttccaagtcatctctcgagcacaagtctgctcatctccaagacagcaatcttggttcgcggagagttaattaagagcaagactgcggttgacggcaatccattgcagatcatgatgaggtcgacgtggttggcgtttgccgtggcggcgctcctcgtcgcctcggtggcacacgcctcgccgccggcgaagctgaaggtagggttctacaaggactcgtgcccgcaggccgaggagatcgtgcgcaacgccgtccgccgcggcctcgagcgcaacccgggcgtcggcgccggcctcatccggatgcacttccacgactgcttcgtccgcggctgcgacgcctccatcctcatcaactccacgccgggcaacaaggccgagaaggactccgtggctaacaaccccagcatgcgcggcttcgaggtcatcgacgacgccaaggccgtcctcgaggcgcactgcccgcgcaccgtctcctgcgccgacatcgtcgcgttcgcggcgcgcgacggcgccgacctcgccggcggcatcaagtaccaggtcccctcgggccgc

SEQ ID NO: 40588 - protein, 147 aa, Panicum virgatum
  misc_feature: Ceres CLONE 2003750
  misc_feature (43)..(147): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MRSTWLAFAVAALLVASVAHASPPAKLKVGFYKDSCPQAEEIVRNAVRRGLERNPGVGAGLIRMHFHDCFVRGCDASILINSTPGNKAEKDSVANNPSMRGFEVIDDAKAVLEAHCPRTVSCADIVAFAARDGADLAGGIKYQVPSG

SEQ ID NO: 40589 - DNA, 838 bp, Panicum virgatum
  misc_feature: Ceres CLONE 2003755
  misc_feature: Encodes the peptide sequence at SEQ ID NO. 40590
gatattgatgatactgctcttggctggcgagggtgtgcagggggagggggctgagctgagttgagccatgggggcggcgggcgaggagatggcggcggaggcaaaggaggagaggatactggtgtcagtgcgcctcaggccgctcaacggcagggaggccggggacagctccgactgggagtgcatcagccccacaaccatcatgttccggagcaccgtgcccgagcgcgccatgttccccaccgcctacacctacgatagggtgtttggccccagttgctctacacggcaagtctatgaagaaggggcaaaagaagttgctctatcagttgtcagtggaattaactcaagcatatttgcctatgggcaaacaagcagtggaaagacttacacaatgacgggaattactgagtatagcatgctagacatctatgattacattcataagcatcctgaaagagagttcattttgaaattctcggccatagagatatacaatgaagctgtgagggaccttctgagccatgactcgacacctcttagacttctagatgatccagagaaagggactactgtagaaagactcactgaggaaactttaagggactacaatcatcttagggatcttctaacagtatgtgaagctcaaaggcagattggagaaactgctttgaatgaaacaagttccagatcccatcaaatactcagattgacaattgaaagttctgctaggcagtatttaggaagaggcaactcgagcacccttgtggcttgtgtgaactttgttgatctagcgggaagtgagcgtgcatctcagaccagccaaatcattcttatc

SEQ ID NO: 40590 - protein, 256 aa, Panicum virgatum
  misc_feature: Ceres CLONE 2003755
  misc_feature (22)..(255): Pfam Name: Kinesin Pfam Description: Kinesin motor domain
MGAAGEEMAAEAKEERILVSVRLRPLNGREAGDSSDWECISPTTIMFRSTVPERAMFPTAYTYDRVFGPSCSTRQVYEEGAKEVALSVVSGINSSIFAYGQTSSGKTYTMTGITEYSMLDIYDYIHKHPEREFILKFSAIEIYNEAVRDLLSHDSTPLRLLDDPEKGTTVERLTEETLRDYNHLRDLLTVCEAQRQIGETALNETSSRSHQILRLTIESSARQYLGRGNSSTLVACVNFVDLAGSERASQTSQIIL

SEQ ID NO: 40591 - DNA, 711 bp, Panicum virgatum
  misc_feature: Ceres CLONE 2003758
  misc_feature: Encodes the peptide sequence at SEQ ID NO. 40592
ttcagtttactacaactctacaacaccaccacccactacatcatcaacaatgggagacgaggttcaggctctggtcatcgacaacggttcgggcatgtgcaaggctggcttcgccggtgatgacgccccgcgcgctgtgttcccctcgatcgtcggtcgcccgcgccacaccggcgtgatggtgggcatgggccagaaggactcgtacgtcggcgacgaggcccagtccaagcgtggtatcctcaccctcaagtaccccatcgagcacggcatcgtgaccaactgggacgacatggagaagatctggcaccacaccttctacaacgagctccgcgtggcccccgaggagcaccccgtgctgctcactgaggcccccctcaaccccaaggccaaccgcgagaagatgacccagatcatgttcgagaccttcaacacccccgccatgtacgtcgccatccaggccgtgctctcgctctacgcctccggccgtaccaccggcatcgtcttggactccggcgatggtgtgacccacaccgtgcccatctacgagggctatgccctgccccacgccatcctgcgtctcgatctcgccggtcgcgatctcactgactacctcatgaagatcctcaccgagcgcggctactcgttcaccaccaccgccgagcgcgagatcgtgcgcgacatcaaggagaagctgtgctacgtcgccct

SEQ ID NO: 40592 - protein, 220 aa, Panicum virgatum
  misc_feature: Ceres CLONE 2003758
  misc_feature (2)..(220): Pfam Name: Actin Pfam Description: Actin
  misc_feature: SWISSPROT Homolog: EC 2.7.10.2 Non-specific protein-tyrosine kinase
  misc_feature: Useful for making plants with modulated biomass
  misc_feature: Useful for making plants with modulated flowering time
MGDEVQALVIDNGSGMCKAGFAGDDAPRAVFPSIVGRPRHTGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVTHTVPIYEGYALPHAILRLDLAGRDLTDYLMKILTERGYSFTTTAEREIVRDIKEKLCYVA

SEQ ID NO: 40593 - DNA, 652 bp, Panicum virgatum
  misc_feature: Ceres CLONE 2003768
  misc_feature: Encodes the peptide sequence at SEQ ID NO. 40594
gctaaacctagggtttcttagtcgagagccgccgccgccgccgccggagggagcagggagggagtgccgcgatggcggagaagaagcagcgccccggcggtgccaggaaggacgaggtggtcacccgcgagtacaccatcaacctccacaagcgcctccacggatgcaccttcaagaagaaggctcccaacgccatcaaggagatcaggaagtttgcacagaaggcgatgggcaccacagatgtcaggatcgacgtgaagctcaacaagcacatctggagcagtggtatccgcagcgtcccaaggcgtgtccgcgtcaggatcgcacgcaagaggaatgatgaggaagacgccaaggaggagctcttctctctggtcactgtcgctgagatccccccggaggggctcaagggtctgggcaccaagattgtcgaggacgatgaatagatctgcctgtgtacctgccttccacaatgaaagtaaattttggtgtttttgagtttgttaggttcaatatccctatgaggaaacgtgtggtgtctcatgatgtctccattgctttctcagcttggtattgaactcttcaagataccttgttggtttgtggatccagatcgtttgtgcagctatgctagatgtctcttactcttacg

SEQ ID NO: 40594 - protein, 124 aa, Panicum virgatum
  misc_feature: Ceres CLONE 2003768
  misc_feature (12)..(106): Pfam Name: Ribosomal_L31e Pfam Description: Ribosomal protein L31e
MAEKKQRPGGARKDEVVTREYTINLHKRLHGCTFKKKAPNAIKEIRKFAQKAMGTTDVRIDVKLNKHIWSSGIRSVPRRVRVRIARKRNDEEDAKEELFSLVTVAEIPPEGLKGLGTKIVEDDE

SEQ ID NO: 40595 - DNA, 700 bp, Panicum virgatum
  misc_feature: Ceres CLONE 2003772
  misc_feature: Encodes the peptide sequence at SEQ ID NO. 40596
ttcaaagcttatgctcaagcagcggatggcatgacacaggagtttaatcattttgttcatagtgatgctaatctttttgagaacaatgaggtgccgacttctgagattactggggtggaatgtaatcaagatgcctctggttttcttcaaccaacagaggatgaaattgcagtgtctgctatgggagataattctggcttccaagaaaacaacatgggttctcttatggatttggatatggtgaatgactatggactaaaagagtgcaacgattttggaagtgcaattcatggtgttgatacagattttctgaactatgatgatgatggggactttgatgatgcaaataatgatgagcaaaatcctgatgaattcgagtctcttgacaacagtggttggtcatctcgaactaggggtgttgcaagatatctgaagactttattcgatgaagaatctggtcttgggagaaagagtgtcgccgttgaccaccttgtacgtggaaagactcggaaggaagcctcaagaatgttcttcgagaccttggtcctgacgacaaaggactacatcagcgtggatcaaccaaaccccttcgattttgtgaacataaagccgggaccaaagctcctgaagtcagaattctagatcatcagtcagcttagcctggtgcgatacatacatcttaccatatccatcacaccaa

SEQ ID NO: 40596 - protein, 213 aa, Panicum virgatum
  misc_feature: Ceres CLONE 2003772
  misc_feature (154)..(208): Pfam Name: Rad21_Rec8 Pfam Description: Conserved region of Rad21 / Rec8 like protein
FKAYAQAADGMTQEFNHFVHSDANLFENNEVPTSEITGVECNQDASGFLQPTEDEIAVSAMGDNSGFQENNMGSLMDLDMVNDYGLKECNDFGSAIHGVDTDFLNYDDDGDFDDANNDEQNPDEFESLDNSGWSSRTRGVARYLKTLFDEESGLGRKSVAVDHLVRGKTRKEASRMFFETLVLTTKDYISVDQPNPFDFVNIKPGPKLLKSEF

SEQ ID NO: 40597 - DNA, 755 bp, Panicum virgatum
  misc_feature: Ceres CLONE 2003793
  misc_feature: Encodes the peptide sequence at SEQ ID NO. 40598
acagcacacagcagctatccagactcacactactgtcgcacacacactactgcagcatttgctttgcttagcacgaccgccgatcgataattaataataatacaacgataatggcggctctgatgatgaagaacaagaagcagatgcaggcggtggtggccttggccgttgtggtggcggcggcggcgctggtggcgtcggcgtcggcggccatcacctgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagcgcggaccggcaggcggcgtgccggtgcctcaagagcctggccagcaccgtcaagtcggtgaacatgggcaccgtcgccaccatccccggcaagtgcggcgtctccgtgccattccccatcagcatgtccactgactgcaacaaggtcaactaataaattgtgcatcaatataataatcctaccagctgatgaggaagctcagctcgatccgctcagaaggcgagctatattcaggagaataaaataaagttgaggcatcatcagcagcacatcatctatatatattattgttgtactcgatctgtgtgtacgtgcgcgtatacatacatgcatgcttatacgatcgatgtatatatatgtgctgcttctctcacaagtacgtgtgctcatatacatacatacatgtgtgctagcttt

SEQ ID NO: 40598 - protein, 126 aa, Panicum virgatum
  misc_feature: Ceres CLONE 2003793
  misc_feature (37)..(122): Pfam Name: Tryp_alpha_amyl Pfam Description: Protease inhibitor/seed storage/LTP family
MAALMMKNKKQMQAVVALAVVVAAAALVASASAAITCGQVGSALAPCIPYATGKASALPSSCCGGVRSLNSAARTSADRQAACRCLKSLASTVKSVNMGTVATIPGKCGVSVPFPISMSTDCNKVN

SEQ ID NO: 40599 - DNA, 668 bp, Panicum virgatum
  misc_feature: Ceres CLONE 2003795
  misc_feature: Encodes the peptide sequence at SEQ ID NO. 40600
aatattctgaccttccccatcaccacccgcgcatatccccgttcgtcctcctctgcatccaccccgctatttatctcgcctcctctccggcctccccccacacccgcattccattccaccacgaatttccccaccaattcgattccaattctggtctctcccacttgccacaatgaagttcggcaagagcctgaacaaccagatcgtggagacgctgcccgagtggcgcgacaagttcctgtcctacaaggacctcaagaagcggctgaagcgtatcggcgccggcgacgcggacggcgagcggcggagcaagcgccagcgcgtgggggacggcggcggctccccgccggcgatgaccgcggaggagtccgggttcgtcgccctcctcgacgccgagctcgacaagttcaacgccttcttcctcgagaaggaggaggagtacgtcatccggcagaaggagctgcaggacagggcggtgagcgcggcggagacggggtcggcggaggagctgctgcgggtgcggaaggagatcgtcgacttccacggcgagatggtgctgctcgagaactacagcgcgctcaactacaccggactggtcaagatcctcaagaagtacgacaagaggaccggtgcgctgatccggctgcccttcatccagaacgtgatgc

SEQ ID NO: 40600 - protein, 165 aa, Panicum virgatum
  misc_feature: Ceres CLONE 2003795
  misc_feature (1)..(165): Pfam Name: SPX Pfam Description: SPX domain
  misc_feature: SWISSPROT Homolog: EC 3.1.4.46 Glycerophosphodiester phosphodiesterase
MKFGKSLNNQIVETLPEWRDKFLSYKDLKKRLKRIGAGDADGERRSKRQRVGDGGGSPPAMTAEESGFVALLDAELDKFNAFFLEKEEEYVIRQKELQDRAVSAAETGSAEELLRVRKEIVDFHGEMVLLENYSALNYTGLVKILKKYDKRTGALIRLPFIQNVM

SEQ ID NO: 40601 - DNA, 691 bp, Panicum virgatum
  misc_feature: Ceres CLONE 2003807
  misc_feature: Encodes the peptide sequence at SEQ ID NO. 40602
gacacaaccaaccacactagcactgagctagctagctagctaccagccaagatggcggccaagcgtctggcgcttgccatcctcgtcctccttagcgtaggcatggtggccgctgctgctggcacccgcaagctgggctatggtcccggaggaggaggaggcggtggcggtagcggtggaggcggagggggtggctatgggggatcaggctatgggtccgggtcagggtacggtgagggcggtggaagtgggggtgctgctggtgggtacggacatggcggtggcggcggaggcggcggcggtgagggcggcggtgctggcggctctgggtatgggtctggccaaggctctggctatgggtccggcagtggtggtgctggtgggtatggaagtggtggaggcggcggaggtggcggcggccaaggtggtggttccggctatggccatggaggtggcgagggttatggctccggctccggctatggaggtggtgctagtggtggcggcagcggcggtggaacacggtggcggcggctgtggtggccaaggtgggtcgggtcatggctccggctccggggtacggatcaggtgaagggtatgggcagggtggagctcatggaggaagctatggcagttggcgggcggtgggggcgggcgggcggcggccaaggtgggtggctctgggctatgg

SEQ ID NO: 40602 - protein, 213 aa, Panicum virgatum
  misc_feature: Ceres CLONE 2003807
  misc_feature: Useful for making plants with modulated nitrogen use efficiency
  misc_feature: Useful for making plants with altered lignin content
  misc_feature: Useful for making plants with altered alkaloid content
  misc_feature: Useful for making plants with altered terpenoid content
MAAKRLALAILVLLSVGMVAAAAGTRKLGYGPGGGGGGGGSGGGGGGGYGGSGYGSGSGYGEGGGSGGAAGGYGHGGGGGGGGGEGGGAGGSGYGSGQGSGYGSGSGGAGGYGSGGGGGGGGGQGGGSGYGHGGGEGYGSGSGYGGGASGGGSGGGTRWRRLWWPRWVGSWLRLRGTDQVKGMGRVELMEEAMAVGGRWGRAGGGQGGWLWAM

SEQ ID NO: 40603 - DNA, 700 bp, Panicum virgatum
  misc_feature: Ceres CLONE 2003810
  misc_feature: Encodes the peptide sequence at SEQ ID NO. 40604
gaggaagaagtcttaagaggccaggaattggaaaatgcagtatcagattctgactatacaaaagcaatacaacttgcatttgagcttagaagaccacacaggctcctagagttattctcacagcttgccaggagtgctgattcagaggatccaatagaaaaggctcttcttggacttacaaaggatggccttcgtgtgcttcttgagtacatccgtgaatggaatacgaagcccaagttctgtcatgttgcacagtttgtgctttttcgggtattgaggtgtttgcctcccactgatatcctggagataaagggcatcagcgagctccttgagggtcttattccgtattcgcagaggcatttcagcagagttgatagactagtgcgaagcacatttctgttggactatacattgatgcgaatgtccgtggtagatccagatgtagatgcaggcacagccaaagatgacatgaatggttcatcagtggagaatgatgaaaccgcagaggcttggcctgcttcgcctgtaacagagaaatcgggcaagaagagaaaacagggcaaatcaagcaaaaagggcaaggagaagaagatgaaggttctttcaaaggatgtttcagttgaggcctgaatagatagctaagaaaatagcttatgggcacccgccattttgtagttgttgtaattgtaattgacattgt

SEQ ID NO: 40604 - protein, 209 aa, Panicum virgatum
  misc_feature: Ceres CLONE 2003810
  misc_feature (7)..(142): Pfam Name: Utp13 Pfam Description: Utp13 specific WD40 associated domain
EEEVLRGQELENAVSDSDYTKAIQLAFELRRPHRLLELFSQLARSADSEDPIEKALLGLTKDGLRVLLEYIREWNTKPKFCHVAQFVLFRVLRCLPPTDILEIKGISELLEGLIPYSQRHFSRVDRLVRSTFLLDYTLMRMSVVDPDVDAGTAKDDMNGSSVENDETAEAWPASPVTEKSGKKRKQGKSSKKGKEKKMKVLSKDVSVEA

SEQ ID NO: 40605 - DNA, 685 bp, Panicum virgatum
  misc_feature: Ceres CLONE 2003825
  misc_feature: Encodes the peptide sequence at SEQ ID NO. 40606
attcagagctctcgcttcgaaactgaaccagcacacccagctgccgttgccgtttctagagaactccctgccgttcgagatcccgctcgccacgatgcctgccctcgccaagcccgcctcgcggcccgccaagaccgccgcggcgccgaagccgaagcccgccgccgccaagcccaaggccgcggccgccgctggcgcctcgcacccgccctacttcgagatgatcaaggaggcgatcacggcgctcaaggagaggaccggctcgagctcgcacgccatcgccaagtacatggaggacaagcacggcccgtcgctgccggccaactacaagaagatgctctccatccagctccgcgggttcgccgccaagggcaagctcgtcaaggtcaaggcctcgtacaagctctccgacgccgccaagaaggaggcgcccaaggccaagcccgctgccgccaagaccgccgcggccaagccagccaaggccgccgcgaagccgaagaagactgccgccaagcccaagaagaccgccctcgccgggaccaagcgcaaggcgccggagaagaaggtcgtcgcgaagccgaagaagtcccccgcggcgaaggcgaaggccaagcccaagacggtcaagtccccctcctccaagaaggcccggaaggttgccgcatgagatggttccgtaggtcgt

SEQ ID NO: 40606 - protein, 190 aa, Panicum virgatum
  misc_feature: Ceres CLONE 2003825
  misc_feature (36)..(106): Pfam Name: Linker_histone Pfam Description: linker histone H1 and H5 family
MPALAKPASRPAKTAAAPKPKPAAAKPKAAAAAGASHPPYFEMIKEAITALKERTGSSSHAIAKYMEDKHGPSLPANYKKMLSIQLRGFAAKGKLVKVKASYKLSDAAKKEAPKAKPAAAKTAAAKPAKAAAKPKKTAAKPKKTALAGTKRKAPEKKVVAKPKKSPAAKAKAKPKTVKSPSSKKARKVAA

SEQ ID NO: 40607 - DNA, 810 bp, Panicum virgatum
  misc_feature: Ceres CLONE 2003827
  misc_feature: Encodes the peptide sequence at SEQ ID NO. 40608
ctttttccctgacgaccaaccctctccacataattccttcgatgatgaggtcgcatatctcaaagcacatttccctgaaggtgacccttatatttttggccctcgaagttgtgatcatcattattattttgtttactatacacgacaaccaaatccttacgcaggaacaaatgttgacccgggagcatggattgcatcagatcgccatcaaactcttgaaatcttaatgactggaatgaatcgtgaagtaatggaacaattttacatgtcagataagtttgtctcgagtcaagaaacaaccaaatcgacaggaattcaatctttgttcacggatgaaacattggttgacgcgcatcaatttaaacctcttggatactccatgaatggtttagatgatcaaatttattatacaattcatataactccacaacctgaatgttcatttgtttcttttgaaacaaatcttgtaattaaagattatccttctttggtacaaagggttgtggatgttttccaacctgaatgttttacggtcctccttgtcagggatggagtaaacgaagaaaagggatcatcttacagtggcttttatgcgagaaatcatgctcatcataacttcaaaggatctcatcatcatttgtcgttttttagttttcgtcgacacggaaaattgcaaaattctcatcgtcctttgcctgttcgtgaaaatgtcactatcgcaaccccaatcaatccttttgctgatgtctcttgatttagtgccttagtttcagtatttgtaaaaaatgtgttatttataaatcgagtttc

SEQ ID NO: 40608 - protein, 250 aa, Panicum virgatum
  misc_feature: Ceres CLONE 2003827
  misc_feature (1)..(222): Pfam Name: SAM_decarbox Pfam Description: Adenosylmethionine decarboxylase
  misc_feature: SWISSPROT Homolog: EC 4.1.1.50 Adenosylmethionine decarboxylase
FFPDDQPSPHNSFDDEVAYLKAHFPEGDPYIFGPRSCDHHYYFVYYTRQPNPYAGTNVDPGAWIASDRHQTLEILMTGMNREVMEQFYMSDKFVSSQETTKSTGIQSLFTDETLVDAHQFKPLGYSMNGLDDQIYYTIHITPQPECSFVSFETNLVIKDYPSLVQRVVDVFQPECFTVLLVRDGVNEEKGSSYSGFYARNHAHHNFKGSHHHLSFFSFRRHGKLQNSHRPLPVRENVTIATPINPFADVS

SEQ ID NO: 40609 - DNA, 679 bp, Panicum virgatum
  misc_feature: Ceres CLONE 2003830
  misc_feature: Encodes the peptide sequence at SEQ ID NO. 40610
ggaacccacgcacaaacaagtaaatgacgacgacgatgatgaggctgaggcagcagctggcctcccctatttatacctccgccatcgccaggatcggcagcagagcccatcaccaccgtctccccatcgcgccaccgcaaaagccgcgaccaaaccgaaccatgtcgtcgtcctcgtcctctgcctccgacgccgccgcttcggcgccgttcgagaagcccagggccgtggtcaagaagcccctcgccgagtcgcagtccgagggacagggcgccaccgtccggaggagcatcggcaggcatgagctcaggaacctggaccccttcctcatgctcgacgagttctcagtctccaagcccgccgggttccccgaccatccccacagaggattcgagaccgtcacctacatgctcgagggcgccttcacccaccaggactttgcaggccacaagggcaccatcagggcaggggatgtccagtggatgactgccgggcgtggcatcgtgcactcggagatgccggcgggggacggggtgcagaagggcctgcagctgtggatcaacctctcctccaaagacaagatgatggagccccggtaccaggagctccagagcaaggacatcagccgcgccgaaaaggacggcgtcgaggtccggatcatcgccggcgaggccttcgg

SEQ ID NO: 40610 - protein, 172 aa, Panicum virgatum
  misc_feature: Ceres CLONE 2003830
  misc_feature (37)..(133): Pfam Name: Pirin Pfam Description: Pirin
MSSSSSSASDAAASAPFEKPRAVVKKPLAESQSEGQGATVRRSIGRHELRNLDPFLMLDEFSVSKPAGFPDHPHRGFETVTYMLEGAFTHQDFAGHKGTIRAGDVQWMTAGRGIVHSEMPAGDGVQKGLQLWINLSSKDKMMEPRYQELQSKDISRAEKDGVEVRIIAGEAF

SEQ ID NO: 40611 - DNA, 618 bp, Panicum virgatum
  misc_feature: Ceres CLONE 2003838
  misc_feature: Encodes the peptide sequence at SEQ ID NO. 40612
gggcgacctgttcgatcagctatctagctaccataccaagcaccaccagcagcaaggcggcaagagagagagaggaaaagctagaggcatggcggccggcggcaacaccattgcccgggtccacaccggcatcaacagcagcaacaagacgctgctcaagagcgaggccctctacaagtacgtgctggacacgtcggtgctgccgcacaagccggagtgcatgcgtgagctgcggctggtgacggacaagcacgagtgggggttcatgcagtcgtccccggacaaggcgcagctgctgcggatgctcatcaagctgacgggcgcgcgcaacacgctggaggtgggcgtgttcacgggctactctctcctcgccaccgcgctcgcgctccccgaggacggccgggtggtcgccgtcaacgtgaaccgcgactactacgagatcggccggcccttcatcgaaaaggccggcgtggcgcacaaggtggacttccgcgagggccccgcgctggaccacctggacgcgctcctcgccaacgagcgcaacctgggcgccttcaacttcgccttcgtcgacgccaacaagccccactacgtgcgctaccacgagcagctgctccg

SEQ ID NO: 40612 - protein, 176 aa, Panicum virgatum
  misc_feature: Ceres CLONE 2003838
  misc_feature (33)..(176): Pfam Name: Methyltransf_3 Pfam Description: O-methyltransferase
  misc_feature: SWISSPROT Homolog: EC 2.1.1.104 Caffeoyl-CoA O-methyltransferase
  misc_feature: Useful for making plants with altered carbohydrate content
  misc_feature: Useful for making plants with altered cell wall content and/or composition
  misc_feature: Useful for making plants with altered lignin content
MAAGGNTIARVHTGINSSNKTLLKSEALYKYVLDTSVLPHKPECMRELRLVTDKHEWGFMQSSPDKAQLLRMLIKLTGARNTLEVGVFTGYSLLATALALPEDGRVVAVNVNRDYYEIGRPFIEKAGVAHKVDFREGPALDHLDALLANERNLGAFNFAFVDANKPHYVRYHEQLL

SEQ ID NO: 40613 - DNA, 544 bp, Panicum virgatum
  misc_feature: Ceres CLONE 2003855
  misc_feature: Encodes the peptide sequence at SEQ ID NO. 40614
accaagccacagcaagcatccatctctgagctagctacctcctcacttcttcagtagcatcaccaccactctcggaaggagaatgtcttgctgcagcggcaagtgcgggtgcggcgccggctgccagtgcggcagcggctgcggcggctgcaagatgttccccgacgttgaggccaccgccggcgccgccgccatggtcatgcccactgccgcccacaaggccacctcaggcgggttcgagatggccggggaggccggcggctgcgactgcaccacctgcaagtgcggcaccgcctgcggctgctcctgctgcagctgcaagtgaagaccgccgcccggccggtcggtcggcgagcatgaggacaaggaggacaaccccaccaccgccaccacccagcagcgtgtcactagctgctgctaaataaaataaccaccgttcgttccttaattctgtacgtgagtctcgcgtgcgtcgtcgccatgatcgatcgatccatgtcctccctcatgactccaggcttaatatatgcgcctcaactttgat

SEQ ID NO: 40614 - protein, 80 aa, Panicum virgatum
  misc_feature: Ceres CLONE 2003855
  misc_feature (1)..(79): Pfam Name: Metallothio_2 Pfam Description: Metallothionein
MSCCSGKCGCGAGCQCGSGCGGCKMFPDVEATAGAAAMVMPTAAHKATSGGFEMAGEAGGCDCTTCKCGTACGCSCCSCK

SEQ ID NO: 40615 - DNA, 626 bp, Panicum virgatum
  misc_feature: Ceres CLONE 2003868
  misc_feature: Encodes the peptide sequence at SEQ ID NO. 40616
acacagactccgtctctggtctctctcctcccccgccctctctctcgtctgatctgcatctgctttttcttccccccttgtctctgtcccttctggcgtgcgcaaagatttgtttttttttctctctctcgaggaggcggagcggcggagcaggagcaggacaagcagcaggcgaagacgagcacgacgagctcgctcccctccagcagcgagcgctcctccagctccgcacccaacaacctcagggaaggaggggtggagagcgacgaggagatacggcgggtgccggagatgggcggcgcgtcggcgtcggcctcgtcgggcgcgggcgcggacgagcgccccaaggaggacggcaagcaggggcagctggtggcggcaacgggggcgcaggggcagccgccggcggcggggaagaagcgcgggcgcaccgccggggacaaggagcagaaccggctcaagcggctgctccggaaccgcgtctcggcgcagcaggcgcgggagcggaagaaggcgtacctgacggagctcgaggcgaaggctaaggacctcgagctccgcaatgccgagctcgagcagcgggtctccacgctccagaacgagaacaacacgctccgccagatttt

SEQ ID NO: 40616 - protein, 208 aa, Panicum virgatum
  misc_feature: Ceres CLONE 2003868
  misc_feature (147)..(201): Pfam Name: bZIP_2 Pfam Description: Basic region leucine zipper
  misc_feature: The sequence is a functional homolog of SEQ ID NO 206 in the 10/225,066 US patent application
  misc_feature: The sequence is a functional homolog of SEQ ID NO 2356 in the 10/374,780 US patent application
  misc_feature: The sequence is a functional homolog of SEQ ID NO 827 in the 11/479,226 US patent application
  misc_feature: Useful for making plants with modulated light quality sensitivity
TQTPSLVSLLPRPLSRLICICFFFPPCLCPFWRAQRFVFFSLSRGGGAAEQEQDKQQAKTSTTSSLPSSSERSSSSAPNNLREGGVESDEEIRRVPEMGGASASASSGAGADERPKEDGKQGQLVAATGAQGQPPAAGKKRGRTAGDKEQNRLKRLLRNRVSAQQARERKKAYLTELEAKAKDLELRNAELEQRVSTLQNENNTLRQI

SEQ ID NO: 40617 - DNA, 637 bp, Panicum virgatum
  misc_feature: Ceres CLONE 2003869
  misc_feature: Encodes the peptide sequence at SEQ ID NO. 40618
ctccctcctcttcccgatcattccattccggcgttccccaacccttcgaccgcacgaggaagaaaaaaagttgaagcatggggaagagaaagtcagctgctaagccacctcctaagaagcggatggacaagcttgacactgtcttttcctgcccattctgcaatcacgggaacagtgttgagtgccgtattgacatgaagaatttgattggcgaggcttcttgcagaatctgtcaggaaaacttcagcactactgttaatgcactcactgagcctattgacatatatagtgaatggattgatgagtgtgagcgtgtcaacactgttgaaggtgatgatgatgcgtgagcattcccccatgctgatggaacggttacttgcaactgtattgtaccggcatttttgaatgccatagtcagccatggcttgtaatacgttgtaagggagaattggctgtctgatatgccattaggcagtatcagtttatctggcacttaataaactctaaaaaaatacatgtatgcctagtagtgactctgcgtttttctacgcaactagcgactgcctacaatgatgtaaacaggttttctgtgagtatgttctcatgttttaaaccactctagatttcagtgccagcg

SEQ ID NO: 40618 - protein, 89 aa, Panicum virgatum
  misc_feature: Ceres CLONE 2003869
  misc_feature (8)..(68): Pfam Name: Elf1 Pfam Description: Transcription elongation factor Elf1 like
MGKRKSAAKPPPKKRMDKLDTVFSCPFCNHGNSVECRIDMKNLIGEASCRICQENFSTTVNALTEPIDIYSEWIDECERVNTVEGDDDA

SEQ ID NO: 40619 - DNA, 719 bp, Panicum virgatum
  misc_feature: Ceres CLONE 2003872
  misc_feature: Encodes the peptide sequence at SEQ ID NO. 40620
gcccagttaagcaaagcaagcaagctactgatcgagctagcagctggctagtctgctagtggtcctggatcagttacctattaattagctgctataaatctggccatggcgacttcgttccggacatggcattgcttgatgctcgccttgctcctgctcgctccggcggcgaacgggcagctctcgccgtcgttctacgcgaggagctgccccacgctggggctcatcgtgcgcgccaccatgatcagggccctcctcgccgagcgccgcatgggcgcctccctcataaggctcttcttccacgactgcttcgtccagggctgcgacggctcgattcttcttgacgacgtgggcagcttcgtcggcgagaagggcgccggccccaacgtcaactccgtccgcggctacgaggtcatcgaccagatcaaggccagcgtcgaggccgtctgccccggcgtcgtctcctgcgccgacatcgtcgccctcgccgcgcgggacagcaccttcctgctcggaggaccgacttgggcggtgccgctcggccggcgcgactcgacgacggcgagccagagcctggcgaacagcgacctcccgtcgccggcttccgacctcgccaccctcatctcggcgttcggcaacaaaggcctgagcccgcgagacctgacggcgctctccggcgcgcacaccatcggcttctcgcagtgccagaacttccgcga

SEQ ID NO: 40620 - protein, 204 aa, Panicum virgatum
  misc_feature: Ceres CLONE 2003872
  misc_feature (42)..(204): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
MATSFRTWHCLMLALLLLAPAANGQLSPSFYARSCPTLGLIVRATMIRALLAERRMGASLIRLFFHDCFVQGCDGSILLDDVGSFVGEKGAGPNVNSVRGYEVIDQIKASVEAVCPGVVSCADIVALAARDSTFLLGGPTWAVPLGRRDSTTASQSLANSDLPSPASDLATLISAFGNKGLSPRDLTALSGAHTIGFSQCQNFR

SEQ ID NO: 40621 - DNA, 608 bp, Panicum virgatum
  misc_feature: Ceres CLONE 2003873
  misc_feature: Encodes the peptide sequence at SEQ ID NO. 40622
ccaaggaggctgcaagcttcacctcccaggtcatcatcatgaaccaccctgggcagatcggcaatggctatgccccagtgctggactgccacacctcccacattgctgtcaagttcgctgagctcattaccaagatcgacaggcgatctggcaaggagcttgagaaggagcccaagttcctcaagaacggtgatgctggtatggtcaagatggttcccaccaagcccatggtggtggagaccttctctgagtaccctcctcttggtcgctttgctgtccgtgacatgaggcaaacggtcgctgtgggagtcatcaagagtgtggagaagaaggacccgaccggcgccaaggtgaccaaggctgctgccaagaagaaatgatgtgcctggtgttttatcctgcgtctgcttttgcgatacctagatacctttccgttatctcataagttttgtctgcggttgttgctgttgtcgttcaacttttagtgtctgccggcggtgtgccatttgtatgtttaggtactttttttttcagcctcgcgaaacttgaatgctctaagacctatggtgtgcccttgtgggcgtcgttaaacgtatttctcaggagtc

SEQ ID NO: 40622 - protein, 125 aa, Panicum virgatum
  misc_feature: Ceres CLONE 2003873
  misc_feature (1)..(108): Pfam Name: GTP_EFTU_D3 Pfam Description: Elongation factor Tu C-terminal domain
  misc_feature: The sequence is a functional homolog of SEQ ID NO 576 in the 10/666,642 US patent application
KEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 40623 - DNA, 746 bp, Panicum virgatum
  misc_feature: Ceres CLONE 2003880
  misc_feature: Encodes the peptide sequence at SEQ ID NO. 40624
tcaaccaaatggattgcccatcgatccgtgcatcctcccgagagtataactgcgcccagtaaatcgttgcatgcgaccgtgtgctagctagcttcttctcgattggtagctacgacctagctcgggaccacttcttccatggcggcggctgcagcttgccacgccaagctctcgtgcccgacacttttgagcttgctcctgctgctccgggtgctcgtcgtggagccggcggccgccacgtgctccgtggacgcgatctacagcttcggcgactcgatcgcggacacgggcaacctgctgcgcgagggccccgtggggttcttcgcctccatcggcagctacccgtacggccagaccatccggaagcccaccggccggtgctccgacggcctcctcatcatcgactacttcgcgatggcgctgaatttgtctctggtgagcccgtacatggacaaggacgccgacttcgccagcggcgtcaacttcgcggtggccggcgccacggcgctcggccgggccgtcctgctccagggcggcgtcatgatgccgccggcgagcgtgccgctcagcacccagctcgactggttcaggtcgcacctcaacgccacctgcgcctcagaagaagattgcgcgaagaagctcgccggagcgctgttctttgggggggagattgggggaaacgactacaactacgggcttcttcagggggacaaggtccatcgaggacatggaagacttacgtgcct

SEQ ID NO: 40624 - protein, 202 aa, Panicum virgatum
  misc_feature: Ceres CLONE 2003880
  misc_feature: SWISSPROT Homolog: EC 3.2.1.51 Alpha-L-fucosidase
MAAAAACHAKLSCPTLLSLLLLLRVLVVEPAAATCSVDAIYSFGDSIADTGNLLREGPVGFFASIGSYPYGQTIRKPTGRCSDGLLIIDYFAMALNLSLVSPYMDKDADFASGVNFAVAGATALGRAVLLQGGVMMPPASVPLSTQLDWFRSHLNATCASEEDCAKKLAGALFFGGEIGGNDYNYGLLQGDKVHRGHGRLTC

SEQ ID NO: 40625 - DNA, 663 bp, Panicum virgatum
  misc_feature: Ceres CLONE 2003889
  misc_feature: Encodes the peptide sequence at SEQ ID NO. 40626
attctatttctgccattctcgcccagcgcccagcgcccagcgcgcagagaagacgatacgaactccagcggcggagggagctagaactagaagaagtagagtccagggagaaccggagaagccatggccggcaggagcttcttgatccggtctcccaaggaggagtccgacgccgccgtcaaagaggctgtactattgggagcgaagaatgctgcaatagctggttctgtggtagcagttcccacgttggtcggctgccgtgtccttccttgggctaaggctaatctcaactacactgcacaagcactcatcatatctgcagcctgtatcgctggcttcttcatcactgccgataaaaccattctccggaacgcaagacaaaacaccattgggaagcttgagaagtagacttgcagatatatggctgtaatggctcaccgattttggtgtttcgctacacaagccagttgtgctgtaaagacttgcttacctgacggactcaaccggtgcatccagttttcccccaatttaatttggaataaaatatggggctaatgggtatacgcttgtgtaatgtggaatacgacacctgcttctttgtcacttgtcaggggttgtaagactgttgagtaaaatgctagtatatggtattttttttcttcc

SEQ ID NO: 40626 - protein, 94 aa, Panicum virgatum
  misc_feature: Ceres CLONE 2003889
  misc_feature (10)..(88): Pfam Name: ENOD93 Pfam Description: Early nodulin 93 ENOD93 protein
MAGRSFLIRSPKEESDAAVKEAVLLGAKNAAIAGSVVAVPTLVGCRVLPWAKANLNYTAQALIISAACIAGFFITADKTILRNARQNTIGKLEK

SEQ ID NO: 40627 - DNA, 713 bp, Panicum virgatum
  misc_feature: Ceres CLONE 2003895
  misc_feature: Encodes the peptide sequence at SEQ ID NO. 40628
atcactttgctgtctgctctgctctgctctgcttgcggcggccttggactcccctgttcggccatacctctccccctgccccgcctccggtcctcgtcctcgcctctgttcggcggagatcatggggctactcagcatcatcaggaagatcaagcgcaaggagaaggagatgcgcatcctcatggtgggtctggacaactcggggaagacgaccatcgtgctcaagatcaacggggaggacaccagcgtcatcagccccaccctcggcttcaacatcaagactatcaagtaccacaaatactcattgaacatttgggacgttggaggacagaagactatccggtcttattggagaaattactttgagcatactgatgggctagtttgggtggtcgatagttcagacatacgaaggcttgatgattgccatgctgaactccacaatctcttgaaagaagagagactagccggagcttcattgctagtttttgcaaacaaacaagacatacaaggagctctaaaaccagccgaaattgctaaggttctgaatctggaggtgatgggcaggagcaggcactggaagattgttggctgcagcgcctataccggcgaggggctcctcgacggattcgattggctcgtgcaggacatagcttctcggatctacgtccttgactgatattttgtcgtaccctgtctcgcgtctgctctta

SEQ ID NO: 40628 - protein, 185 aa, Panicum virgatum
  misc_feature: Ceres CLONE 2003895
  misc_feature (3)..(177): Pfam Name: Arf Pfam Description: ADP-ribosylation factor family
  misc_feature: Useful for making plants with altered alkaloid content
  misc_feature: Useful for making plants with altered lignin content
MGLLSIIRKIKRKEKEMRILMVGLDNSGKTTIVLKINGEDTSVISPTLGFNIKTIKYHKYSLNIWDVGGQKTIRSYWRNYFEHTDGLVWVVDSSDIRRLDDCHAELHNLLKEERLAGASLLVFANKQDIQGALKPAEIAKVLNLEVMGRSRHWKIVGCSAYTGEGLLDGFDWLVQDIASRIYVLD

SEQ ID NO: 40629 - DNA, 570 bp, Panicum virgatum
  misc_feature: Ceres CLONE 2003903
  misc_feature: Encodes the peptide sequence at SEQ ID NO. 40630
agtgtgctccatcgccaagcaaagcaacctcgctcgctctcccaatcatccttatcagatcatcttcttccaagatgtcttgcagctgccgatcaagctgcgactgcggctccagctgcaactgcggcaagatgtaccctgaccttgacgagaacagcagcgggggtgctcatgccaccgtcgtcctcggcctggccccggagaagaaggccggccacttcgaggcggcggtggagtccggtgagaccgcccacggctgcaagtgcggcaacagctgcacctgcgacccctgcaactgctgatttggatggggaacgtgcacacctgcgtgcatgctacctactgcctactctgcttgagggtgacttgatagaacaagaataaggatgagcctgagccaacgtgcccgatgtatcgggttggctccggcctcatccagcatgcatgcgtcgtctgcccttatgagcgctgtgctacctcgatattaccgagtgcttggcgtcagtcatgtatctgtatgtgtctgtatgtgttgatcattgcaataaaccatgcaggcacgatgcatct

SEQ ID NO: 40630 - protein, 75 aa, Panicum virgatum
  misc_feature: Ceres CLONE 2003903
  misc_feature (1)..(75): Pfam Name: Metallothio_2 Pfam Description: Metallothionein
MSCSCRSSCDCGSSCNCGKMYPDLDENSSGGAHATVVLGLAPEKKAGHFEAAVESGETAHGCKCGNSCTCDPCNC

SEQ ID NO: 40631 - DNA, 639 bp, Panicum virgatum
  misc_feature: Ceres CLONE 2003904
  misc_feature: Encodes the peptide sequence at SEQ ID NO. 40632
gctcgagtcctgcgagcacccacgtccactaccaggcgagaaggccggctgcgccacctcgctcgagtccctcgcgaagctccctgctgccctcctcggcacgcgcaacgtccgcgctttctccggcgacatgcccgtcgacccggcgggcacggcggctcgacgggggaggcacaacgtcacggccgtgcggaagctatccgagtcgccggtcgccgcgacgtgccatgacctgacctacccctatgcggtgttctactgccacacgaccaagcaggtggcgacgtaccaggtgacgctggcggcggccgagggcggcagagcgccggcgatggaggcgctggcagtgtgccacctcgacacatcacagtggacacccaggcaaccgttcttagtggcgcacaacctaaagccaggtgatgtggcggtttgccattttctttctaagctcagcgtcatctgggtcccggccggcgacggcgagcaaggaggcgcacgtgaagcctggtagaacacgaagtacccgagagagcattatttgtgtgagctctgacctgtggcttttgtttgtaacgcgtatggaacacaacgtgactttttagtactaaataaaagccgcgtgaacgtgttgtgattgtg

SEQ ID NO: 40632 - protein, 169 aa, Panicum virgatum
  misc_feature: Ceres CLONE 2003904
  misc_feature (1)..(157): Pfam Name: BURP Pfam Description: BURP domain
LESCEHPRPLPGEKAGCATSLESLAKLPAALLGTRNVRAFSGDMPVDPAGTAARRGRHNVTAVRKLSESPVAATCHDLTYPYAVFYCHTTKQVATYQVTLAAAEGGRAPAMEALAVCHLDTSQWTPRQPFLVAHNLKPGDVAVCHFLSKLSVIWVPAGDGEQGGAREAW

SEQ ID NO: 40633 - DNA, 735 bp, Panicum virgatum
  misc_feature: Ceres CLONE 2003924
  misc_feature: Encodes the peptide sequence at SEQ ID NO. 40634
atcgagcccatctccacccgactccccgagtacccctcgagctcggccgcatcgcaatccagcaggcagccgccgcagattcccccctgctcccctccgcgcctgccccgccggccgccgccggggcttccagtctagcgcgtgcagccctctcccctccgtccccacaaccatggcggaggagccgaaggcgacgccgtccaccaccgtagcggaggaggcacaggaggcgccgccggccaccgcggcggaggccaaggcgccgccgcagctggagctgttcaactccatgacgaagacgaaggagcccttccagccgctggtggaggggaaggtcgccatgtacgtctgcggcgtcacgccctacgacttcagccacatcggccacgcgcgtgcctacgtcgccttcgatgtcctctacaggtaccttaaaattctggggtatgaagttgagtatgttcgtaatttcacagacattgacgacaagattatcaagcgtgcaaatgaacgtggtgaaactgttacaagtttgagtagtcggtttatcaatgagtttcttcttgatatgactgagctccagtgcttgcctcctactcgcgagccacgcgtaacagatcacattgagcatatcatagagttgataacaaagataatggagaatgggaaagcctatgctatggaaggagatgtttacttttcagtagatagttttcccgagtatctgagtttgtctgg

SEQ ID NO: 40634 - protein, 187 aa, Panicum virgatum
  misc_feature: Ceres CLONE 2003924
  misc_feature (46)..(187): Pfam Name: tRNA-synt_1e Pfam Description: tRNA synthetases class I (C) catalytic domain
  misc_feature: SWISSPROT Homolog: EC 6.1.1.16 Cysteine--tRNA ligase
MAEEPKATPSTTVAEEAQEAPPATAAEAKAPPQLELFNSMTKTKEPFQPLVEGKVAMYVCGVTPYDFSHIGHARAYVAFDVLYRYLKILGYEVEYVRNFTDIDDKIIKRANERGETVTSLSSRFINEFLLDMTELQCLPPTREPRVTDHIEHIIELITKIMENGKAYAMEGDVYFSVDSFPEYLSLS

SEQ ID NO: 40635 - DNA, 664 bp, Panicum virgatum
  misc_feature: Ceres CLONE 2003930
  misc_feature: Encodes the peptide sequence at SEQ ID NO. 40636
atcacaggaactcagcaattgagttgattgatcacttctgctctgtgcgcctgtggcccagtaatttccgcagagcgaaatggcaggcaaggcctcggtcgcgctgttcctggccgtcaacatggtcgtgttcgccatggccaccccatccacgccgaccccgacgccggcgtcgagaggcaggtgcccccgcgacgcgctgaagctgggcgtgtgcgccaacgtgctgggcctgatcaaggccaaggtcggcgtgccgccggcggagccctgctgcccgctgctggaggggctcgtcgacctcgaggccgccctgtgcctctgcaccgccatcaagggcaacatcctcggcatcaacctgaacctgcccatcgacctcagcctcatcctcaactactgcggcaagaccgtgcccactggcttcaagtgcctctaagcatgcgtccggccgcggggtcacgagtttattatgcacacgcgtgcgttgatcgtttgaatcctggtgtgtttggttaatctgcattcgtggtggtctgcactctgcacgtgctcatgcatgcgcggtcgccgcatgtaccgatcgatctctcgttcgatcagctctattttgtttccattgcttgatctattgttcgtttccagtttactatctatccagtttccc

SEQ ID NO: 40636 - protein, 118 aa, Panicum virgatum
  misc_feature: Ceres CLONE 2003930
  misc_feature (36)..(117): Pfam Name: Tryp_alpha_amyl Pfam Description: Protease inhibitor/seed storage/LTP family
  misc_feature: Useful for making plants with modulated biomass
  misc_feature: Useful for making plants with modulated flowering time
  misc_feature: Useful for making plants with modulated salt sensitivity
MAGKASVALFLAVNMVVFAMATPSTPTPTPASRGRCPRDALKLGVCANVLGLIKAKVGVPPAEPCCPLLEGLVDLEAALCLCTAIKGNILGINLNLPIDLSLILNYCGKTVPTGFKCL

SEQ ID NO: 40637 - DNA, 681 bp, Panicum virgatum
  misc_feature: Ceres CLONE 2003936
  misc_feature: Encodes the peptide sequence at SEQ ID NO. 40638
gctggcatcgcatcttctctcgctctctgttgtgtgactgattgccaagaacgctctctgcttgcttgtgttccagcctctgaatctcgtgaggatgtcgtgctgcggaggcaactgcgggtgcggctccggctgcaagtgcggctccggctgcggagggtgcaagatgtacccggacatgactgagcagggcaccaccaccaccacccagactgtcatcatgggcgttgcaccaaccaacaaggggcacgccgagggcggatttgaggccggcgccggagccgagaacggctgcaagtgcggtgccaactgcacctgcaacccctgcacctgcaagtgaggagctcatggccatggccggaccggaggagatctgaagctagtatagcggcgttgtgtgtgcgtcgttcgtttgtctgaaagtgtgtgtggcatgcttaataacggtggtgcgcgtgctgctagtagatggtactgatggggaacaataataatgatggtgctgagatgtcgtcggcgtcgccgccgccgtcgtgtccttcctccccggccggtcgggcacctgtggcggtgctctagcagtgtgttgtgtgtgcagcaggccatgctctgatctttgtggtgtatgtgtgtggcctgctgcttggtatccctagtgtcatgtcaactcatgtgttacca

SEQ ID NO: 40638 - protein, 81 aa, Panicum virgatum
  misc_feature: Ceres CLONE 2003936
  misc_feature (1)..(80): Pfam Name: Metallothio_2 Pfam Description: Metallothionein
MSCCGGNCGCGSGCKCGSGCGGCKMYPDMTEQGTTTTTQTVIMGVAPTNKGHAEGGFEAGAGAENGCKCGANCTCNPCTCK

SEQ ID NO: 40639 - DNA, 567 bp, Panicum virgatum
  misc_feature: Ceres CLONE 2003963
  misc_feature: Encodes the peptide sequence at SEQ ID NO. 40640
aaaaatccgcaggccacgaactcacgaagcggcagcgagagccgagagaagccatggcgctgtccctctccctcgcgcgcgccgcgcccctcgccttccctcccaagtccttcttcggcgcgcctctggccgccaccgccgcctccgtcgcgtcgccgctcccgcgcaagccggccacctccccctcgctcgcggtcgtcgcggcgggcaagaaggggtacaagatgaagacccacaaggcgtcggcgaagcggttcagggtgacggggaggggcaagatcgtgcgccggtgcgccgggaagcagcacctgctcggcaagaagaacaccaagcgcaagaagaggctctccaagatggtccaagtaaacaagagtgactacgacaatgtgacaggcgcactgccctacctcaaagtgaataggaaagtagactgagttcttcttggtcttcaaaagccattctgtttcattccaccaacctgtaattttgtgtattttccgctgtattacctttcgaatatggaggctgtaattcatttcaagaaagcataaaaaactcttcgtaccg

SEQ ID NO: 40640 - protein, 126 aa, Panicum virgatum
  misc_feature: Ceres CLONE 2003963
  misc_feature (58)..(116): Pfam Name: Ribosomal_L35p Pfam Description: Ribosomal protein L35
MALSLSLARAAPLAFPPKSFFGAPLAATAASVASPLPRKPATSPSLAVVAAGKKGYKMKTHKASAKRFRVTGRGKIVRRCAGKQHLLGKKNTKRKKRLSKMVQVNKSDYDNVTGALPYLKVNRKVD

SEQ ID NO: 40641 - DNA, 686 bp, Panicum virgatum
  misc_feature: Ceres CLONE 2003977
  misc_feature: Encodes the peptide sequence at SEQ ID NO. 40642
accatcacaagcactcagcaaccgagcaaccgatcaggagctagctcctcttgaagctcgctctctctgctccgtgcttgtggtcaggctactgttattgctgtgctgaaaatggcaggcaaggcctcgatcacgctgttcctggccgtcaacatggtcgtgttcgccatggccagcgcctgcggcggcaactgccctccttcgacgccgtcgaccccatcgacgccgaccccgacgccggcctcgaaaggcaagtgcccccgcgacgcgctgaagctgggcgtgtgcgccaacgtgctgggcctcatcaaggccaaggtcggcgtgccgccggcggagccctgctgcccgctgttggaggggctcgtcgacctagaggccgccgtgtgcctctgcaccgccatcaagggcaacatcctcggcatcaacctgaacctgcccatcgacctcagcctcatcctcaactactgcggcaagaccgtgcccaccgggttcaagtgcctctaagcgctgaccgtcgcgttcgtgtctggcttggcatggcatgagcagagcatgccgacgggttctttaatttgattttcatacgcatgtagccggttttaccaccattcgcttgttggtgttttctgtgtgcgtcgctcgtgtccctgaactatttggattattattcttttatttgtatc

SEQ ID NO: 40642 - protein, 131 aa, Panicum virgatum
  misc_feature: Ceres CLONE 2003977
  misc_feature (49)..(130): Pfam Name: Tryp_alpha_amyl Pfam Description: Protease inhibitor/seed storage/LTP family
  misc_feature: Useful for making plants with modulated biomass
  misc_feature: Useful for making plants with modulated flowering time
  misc_feature: Useful for making plants with modulated salt sensitivity
MAGKASITLFLAVNMVVFAMASACGGNCPPSTPSTPSTPTPTPASKGKCPRDALKLGVCANVLGLIKAKVGVPPAEPCCPLLEGLVDLEAAVCLCTAIKGNILGINLNLPIDLSLILNYCGKTVPTGFKCL

SEQ ID NO: 40643 - DNA, 591 bp, Panicum virgatum
  misc_feature: Ceres CLONE 2003988
  misc_feature: Encodes the peptide sequence at SEQ ID NO. 40644
gacggacaggcgacgggatgcaaggggaggatcgccaggtgccggtgtacgcgtcgggcatcgaggtactcgaaaagcttcaggagaaatgggaatccacccagcgacggtacccggcaatgtactccagtgtcgttggtggcatcgtccttgatccatccatgatggtgatccccatcgacgaccacatggtccaccgcggccatggcgtcttcgacaccgccaccatatctgatggatgcttgtacgaactggattcacacctggatcggctgctagcatctgcatccaaagcaaagatcgatccaccgttctcgcgagagacgatgcgagaaattctgatccagatgaccgctgcctccggatgcaaggacgggtcgatcaagtactggctgagcgccggccccggcgacttcctgctgtccccgacgggctgcacgggacccgcgttctacgccgtcgtcatagccgccgcctccgcctccggcgccggccgccgctctcagcggaacgatggcgtcaaggcgatcacgaccgccgtgccgatgaagcacccgttcttcgcggggatcaagagcgtcaactacctcc

SEQ ID NO: 40644 - protein, 191 aa, Panicum virgatum
  misc_feature: Ceres CLONE 2003988
  misc_feature: SWISSPROT Homolog: EC 2.6.1.21 D-amino-acid transaminase
MQGEDRQVPVYASGIEVLEKLQEKWESTQRRYPAMYSSVVGGIVLDPSMMVIPIDDHMVHRGHGVFDTATISDGCLYELDSHLDRLLASASKAKIDPPFSRETMREILIQMTAASGCKDGSIKYWLSAGPGDFLLSPTGCTGPAFYAVVIAAASASGAGRRSQRNDGVKAITTAVPMKHPFFAGIKSVNYL

SEQ ID NO: 40645 - DNA, 767 bp, Panicum virgatum
  misc_feature: Ceres CLONE 2003997
  misc_feature: Encodes the peptide sequence at SEQ ID NO. 40646
aagaagctcacggggccatcaaaatcgaagcgagggggaggagagggaggcctcctgctcgatccagcgcccgccgcagccgacttcgccgccgccgacgggacaggatgtttctcacgaggacggagtacgaccgcggggtgaacaccttctcgccggaggggcggctgttccaggtcgagtacgccatcgaggccatcaagttgggatctactgcgattgggttgaggacaaaggatggcgttgtccttgctgttgagaaacgtgtcacctcgccacttctggaaccaagcagtgtcgagaaaatcatggaaattgatgagcacataggctgtgccatgagtggacttattgctgatgctagaacgctagtcgagcatgctcgtgttgagacccagaatcataggttctcatatggggagccaatgaccgtagaatcttctacacaagctatctgtgacttggctctgcgctttggcgaaggtgacgaggagtcaatgtcacggccgtttggagtctctctcctaattgctggacatgatgagaatggacctagcttgtactacaccgacccatctgggaccttttggcaatgcaatgctaaggcaattggatcaggctctgaaggagctgatagctccttgcaggagcagtataacaaggacctgaccctccaggaggcggagaccatagccctttctattctgaagcaggttgtgggaagagaaggtgaccccaaacaatgttgatattgccaaggtcgcccc

SEQ ID NO: 40646 - protein, 213 aa, Panicum virgatum
  misc_feature: Ceres CLONE 2003997
  misc_feature (31)..(207): Pfam Name: Proteasome Pfam Description: Proteasome A-type and B-type
  misc_feature: SWISSPROT Homolog: EC 3.4.25.1 Proteasome endopeptidase complex
MFLTRTEYDRGVNTFSPEGRLFQVEYAIEAIKLGSTAIGLRTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKDLTLQEAETIALSILKQVVGREGDPKQC

SEQ ID NO: 40647 - DNA, 570 bp, Panicum virgatum
  misc_feature: Ceres CLONE 2004031
  misc_feature: Encodes the peptide sequence at SEQ ID NO. 40648
ggctgtgatgccatctccatatgagatgggtgggatgccaattagagatgctggcgtgtcacaacctgttccaattggggcactagccactgcgcttgccaacgccccaccggatcagcagaggctgatgcttggtgagaacctgtatcctctagttgatcagctggagcatgagcaggctgccaaggtgactggcatgcttttggagatggaccagacggaggtcctgcacctgctggagtcaccagatgcgctcaaggccaaggttgctgaagccatggaggtcctccgctccgcccagcatctccagccgaccaatgcttcccccgagcagcagctggctaatctgtccctgaatgacggcgtcgtctccagctgaatgtgtccgatgacttgatagattggaggctgctggcaatttttgcttgatacctatcctatctagagtgcaatgacttggtttgcttggtttattggagttttagcttgctctataattagctgaactagggttggtctagatttgtcatggattggttgttttggttgtatggatatgttgtttcatcg

SEQ ID NO: 40648 - protein, 125 aa, Panicum virgatum
  misc_feature: Ceres CLONE 2004031
  misc_feature (25)..(96): Pfam Name: PABP Pfam Description: Poly-adenylate binding protein, unique domain
AVMPSPYEMGGMPIRDAGVSQPVPIGALATALANAPPDQQRLMLGENLYPLVDQLEHEQAAKVTGMLLEMDQTEVLHLLESPDALKAKVAEAMEVLRSAQHLQPTNASPEQQLANLSLNDGVVSS

SEQ ID NO: 40649 - DNA, 685 bp, Panicum virgatum
  misc_feature: Ceres CLONE 2004041
  misc_feature: Encodes the peptide sequence at SEQ ID NO. 40650
atctccggcagcccatccagatcgtcggcggcgaactccctccattgacacacaactaacgtagcgatggagctcgtcaagtccagggccgccgcgtgcgctctcctgcttgtgctgctcgtcctcacacacgacggcggcggcggcgggatggtggcggtggaggcgcgggtgtgcacggggaagagccagcaccactccttccactgcatctccgaccgcctctgcacccgcaactgcgtcagcgagggcggcggatggaccgccggctactgccaccacaggttctgcacctgccagaaggcatgctagctgatcgtgatcctcacctcgcggcagcgggggatcggccagctcgtccgctcccaccttccttccgacaatcttcgccgcacgtatgcgctgcgctctgttgtcagtgcagaaccatgcatgggtgtcgccatgtaagagtaatgatatactacaacaggaataataagagcaggaccggcggcgcccgtgtgtgtgtgcacccgcgcaatggtcaactgtactgcccctcaaaaaaaaaagcccgttggcttgaaatggcccattacatcaatcagcctgacttatcatcacattatcatacacgaaaacagtagaattttatcaagttttcaggaaaatcataaagaaggatattgtagcactcttttaa

SEQ ID NO: 40650 - protein, 81 aa, Panicum virgatum
  misc_feature: Ceres CLONE 2004041
  misc_feature (35)..(81): Pfam Name: Gamma-thionin Pfam Description: Gamma-thionin family
MELVKSRAAACALLLVLLVLTHDGGGGGMVAVEARVCTGKSQHHSFHCISDRLCTRNCVSEGGGWTAGYCHHRFCTCQKAC

SEQ ID NO: 40651 - DNA, 608 bp, Panicum virgatum
  misc_feature: Ceres CLONE 2004049
  misc_feature: Encodes the peptide sequence at SEQ ID NO. 40652
gcaagcaagctcgaggcgacagaggcaagccaagaaaagcagcagcagccagccaagctcgccgccgcggctcttcttgctcgcctccggccgttccgttcccgtcccgccgagcttccacagaagggatggagatgaagaagatcgcctgcgccgtcctcgtcgctgcctcggccaccgtggcgctcgccgcggacgccccggccccggcccccaccagcgggtcctccgccgtcgcgcccgccgtcggcgccgcgctcggggccgccgtggcctccttcttcgcctactacattcagtgagccgctggaacggccggcccggcgggaggaggacgaggaggaagagaccagggggagacatggcggcgctgattccgaacaccgcaagcgcattccgatgcgtgcgtgggtttcgatttgacacggctttctcttcttcttttttcccccctctttctccttgatttaacgaattgatcgatgtcgctgatgcaccagtttaatttggtgccttgttatttgttcttcaatcccttcgagagagggaccgacacctgtaccattgcttgccatttgtttggatcaattcaacaattcgatttaatc

SEQ ID NO: 40652 - protein, 57 aa, Panicum virgatum; identical to SEQ ID NO: 36286
  misc_feature: Ceres CLONE 2004049
  misc_feature: Useful for making plants with altered carbohydrate content
  misc_feature: Useful for making plants with altered cell wall content and/or composition

SEQ ID NO: 40653 - DNA, 671 bp, Panicum virgatum
  misc_feature: Ceres CLONE 2004060
  misc_feature: Encodes the peptide sequence at SEQ ID NO. 40654
aggcgtcgaattcagtatcccggttccttctaccatcaagcgcatcttctcgccaccatggtgtccttcaagtctctcctcgttgccgcggctacggtaacctccgttctcagtgctccgttcgatttcgttgagcgtgacaatggaaactcgaccgaggtcctcgagaggcgccaggtaacgccgaactcgcagggcacccacaacgggtacttctactcgtggtggtctgacggaggcggccaggtcacctacaccatgggtgaaggcagtcgctaccaggttagctggagaaacactggcaactttgtcggtggcaagggctggaaccctggtaacggccggaccatcaactatggcggtgcgttcaacccgagcggcaacgggtatctggccgtctacggctggactcgcaacccgctcgtcgagtactacgtcattgagtcctacggcacctacaaccccagcagcggagcgcagtacaaaggacaggtccagactgacggtggcacctacaacctctacgtttcgactcgctacaaccagccctctatcgatggtacccggaccttccagcagtactggtctgttcgcacctccaagcgcgtcggaggcgcggtcaccatgcaaaatcacttcaacgcctgggcttccgttggtctgaaccttgg

SEQ ID NO: 40654 - protein, 204 aa, Panicum virgatum
  misc_feature: Ceres CLONE 2004060
  misc_feature: SWISSPROT Homolog: EC 3.2.1.8 Endo-1,4-beta-xylanase
MVSFKSLLVAAATVTSVLSAPFDFVERDNGNSTEVLERRQVTPNSQGTHNGYFYSWWSDGGGQVTYTMGEGSRYQVSWRNTGNFVGGKGWNPGNGRTINYGGAFNPSGNGYLAVYGWTRNPLVEYYVIESYGTYNPSSGAQYKGQVQTDGGTYNLYVSTRYNQPSIDGTRTFQQYWSVRTSKRVGGAVTMQNHFNAWASVGLNL

SEQ ID NO: 40655 - DNA, 750 bp, Panicum virgatum
  misc_feature: Ceres CLONE 2004071
  misc_feature: Encodes the peptide sequence at SEQ ID NO. 40656
agagtctctcaccggcgcgttcagtagaaaccctaaaaaaccccgtctcctcctttcgcccgtggagccatcccctcgccggggggtagggctaagtggtttccgcccgccatggacgccatgcggaagcagctggacgtgctcatgggcgccaaccgcaacggcgacgtggaggaggtcaaccggaactactacgaccgcgacgtctgccgcctcttcctcgcgggtctatgcccgcacgacctcttccagctcacgaaaatggatctcggaccttgttccaagattcactcgcttcagctacggaaagactatgaagaagcgaaatcaaagggatcagagaattttgatagagagcttgaggatatgatagaaaggctcatcgtagagtgtgataggaaaattcaaagggccctgaaacggcttgcggatgacgatgccaaggctgctattgcaatatctgtgtctgaggttactctgacagacgagatactgcagctgtcaaaacaaatcaaggagaaaatgaaagaagttgatacttttgattttgaggggagaactgatgataaaataaaggcccaggaagttgtggaagaactgagagctaaaagggctgatatgcacgctaccctcttgcttgatgcttttaacaaggacagagcttcattacctacacctgctccacctcctcaagtagcagcgccacctcctcctccccctgatgcccgtactcaggaaatgattaatgaa

SEQ ID NO: 40656 - protein, 212 aa, Panicum virgatum
  misc_feature: Ceres CLONE 2004071
  misc_feature (1)..(208): Pfam Name: LUC7 Pfam Description: LUC7 N_terminus
MDAMRKQLDVLMGANRNGDVEEVNRNYYDRDVCRLFLAGLCPHDLFQLTKMDLGPCSKIHSLQLRKDYEEAKSKGSENFDRELEDMIERLIVECDRKIQRALKRLADDDAKAAIAISVSEVTLTDEILQLSKQIKEKMKEVDTFDFEGRTDDKIKAQEVVEELRAKRADMHATLLLDAFNKDRASLPTPAPPPQVAAPPPPPPDARTQEMIN

SEQ ID NO: 40657 - DNA, 668 bp, Panicum virgatum
  misc_feature: Ceres CLONE 2004074
  misc_feature: Encodes the peptide sequence at SEQ ID NO. 40658
gaaaaccctaccctccatcccccacccgccgcgcctcaaccctacccagccgccgctgtcgccgccgccgccgcgcggaggcgaccccctaccgccgccaagatccaggacaaggagggcatccccccggaccagcagcggctcatcttcgccggcaagcagctcgaggacggccgcaccctcgccgactacaacatccagaaggagtccaccctccacctggtgctccgcctccgcggtggcgccaagaaacgcaagaagaagacctacaccaagcccaagaaaatcaagcacaagcataagaaggtgaagctcgccgtgcttcagttctacaaggtcgacgacgccactggcaaggtcacccgcctccgcaaggagtgccccaacgccgactgcggcgcgggtaccttcatggccaaccacttcgaccgccactactgcggcaagtgcggcctcacctacgtctacaaccagaaggcgtaatcgcttgcatcgctttgcttagcattacccgcctatctatcatgaaattgaactgttggtttctcgaattgaatatcatttagatctgtttgaggttgaaacttaaatggagtagcagtatctatcttcttggaacgcctgttactgagctgttgcgtgatgcaagtttaattttggttccattt

SEQ ID NO: 40658 - protein, 160 aa, Panicum virgatum
  misc_feature: Ceres CLONE 2004074
  misc_feature (106)..(153): Pfam Name: Ribosomal_S27 Pfam Description: Ribosomal protein S27a
  misc_feature (27)..(79): Pfam Name: ubiquitin Pfam Description: Ubiquitin family
ENPTLHPPPAAPQPYPAAAVAAAAARRRPPTAAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNADCGAGTFMANHFDRHYCGKCGLTYVYNQKA

SEQ ID NO: 40659 - DNA, 687 bp, Panicum virgatum
  misc_feature: Ceres CLONE 2004076
  misc_feature: Encodes the peptide sequence at SEQ ID NO. 40660
acaacactaccaagaacagagcacccagcacaaggaagccgacccgacccgccctccccgtcgccgtcgggatggcttcctcggcggcgtaccccgacgcggacgagaatcttgaggccatcatcacccgcatcgagcagaagtcccgcaagatcgagaccctcctcaagcagtcgaagccggtggaagccctgaagacggcgctcgagtggtcgcccctcaagacccgcgacgagcgatgcaagtcggcgaactggatcgtggtgcaccgggcgatgatggcgatcagggacgtcgacggcatgttcaactccctagatcccgagtactacgacatcctgatgaagtacctttatagaggattatcgacaggggacaggccaacttgtgaccagtgcctcaaaattcatgaaaaactgactgagaaagcaggcttaggatgtatattgcggtcgcttgccgatactgtaaacactgtatgagcttgtgagcttcatctatgaggttggacagaacacagtttccttcctgctctgtgctgcgataaatcacagcagacaacttagctgtatgaaaattgttggctagttatttagatctcatctggcagtttcggttagagcatcattgtaccttactagaatggctgaatctgaacttatgtagtattatgttgttttgaactcc

SEQ ID NO: 40660 - protein, 136 aa, Panicum virgatum
  misc_feature: Ceres CLONE 2004076
  misc_feature (3)..(135): Pfam Name: P16-Arc Pfam Description: ARP2/3 complex 16 kDa subunit (p16-Arc)
MASSAAYPDADENLEAIITRIEQKSRKIETLLKQSKPVEALKTALEWSPLKTRDERCKSANWIVVHRAMMAIRDVDGMFNSLDPEYYDILMKYLYRGLSTGDRPTCDQCLKIHEKLTEKAGLGCILRSLADTVNTV

SEQ ID NO: 40661 - DNA, 638 bp, Panicum virgatum
  misc_feature: Ceres CLONE 2004083
  misc_feature: Encodes the peptide sequence at SEQ ID NO. 40662
cattttctccctactcaccacagctcccccaccccgccgccaccagccgctcctcctcaccgtggcggcattatccttggcaccccggagatgggaccctccacgcgcgccttgctggggacgggttcgttctccgcgcgccgctggggactgggtcctcagctcgcgctccgccgccggggactgggtccttcactcgcgcaagccggaagtgcttccgcagctgccgcggggatggggtcctacgcacacgcacaccgcgggggacgtggtcctctgtgtactacatgttttggtagtttatttggttccgattagtgccaaggtgctcacgagggtgtgcacggggaagatccaggtgcagcagaagtgcaggaccaggaccaccctctcccaagtcatggatccaggcgctaagagtaacacatcacatcaatacctgggctccgattcctttatttttctcttgtataaggagtatcttggcaataattgctttcttaatgccatcctgcaggcacttggcagctgtgataattttgtttcctttctagataatctgcttgcaattgacggcttgctacctgaagaaaaggctaaaagaatgcctcttcttcttgctcttaagttctcttgca

SEQ ID NO: 40662 - protein, 212 aa, Panicum virgatum
  misc_feature: Ceres CLONE 2004083
  misc_feature: SWISSPROT Homolog: EC 3.1.2.15 Ubiquitin thiolesterase
IFSLLTTAPPPRRHQPLLLTVAALSLAPRRWDPPRAPCWGRVRSPRAAGDWVLSSRSAAGDWVLHSRKPEVLPQLPRGWGPTHTHTAGDVVLCVLHVLVVYLVPISAKVLTRVCTGKIQVQQKCRTRTTLSQVMDPGAKSNTSHQYLGSDSFIFLLYKEYLGNNCFLNAILQALGSCDNFVSFLDNLLAIDGLLPEEKAKRMPLLLALKFSC

SEQ ID NO: 40663 - DNA, 531 bp, Panicum virgatum
  misc_feature: Ceres CLONE 2004084
  misc_feature: Encodes the peptide sequence at SEQ ID NO. 40664
ggtacggggagctcgtcaaggcgggggaggtggaggcgaaggtgaggctggtgatggacaccgaggaagggaaggtgctgagggagcggctcgcggtcaccaaggagaaggccttggaggctattaaggaatgcgggtcttctgaagaggcattcgcaaagtttatcagagatttggggcagattagtagcacttgaaatggttactgatggggtggtgagacagatgaacaacaaaattgacagtatcatggagccagcactcgaggattcagatttcaaaactgcgtcatcaacacaaataaatggttaatcatgtgagtagaatttgatcagttagttggggcaagtcatcaagcggcaatgtgctagtatattgaagagctgacttccattactgaattttcaagaatgtcgattcaccgaatattgtgtccactgtccagtatagcatattgtgagaagaggctgtattttgtctcacaactttgtatcgtggattaatctaatcgataattgtgtctcctttttc

SEQ ID NO: 40664 - protein, 64 aa, Panicum virgatum
  misc_feature: Ceres CLONE 2004084
  misc_feature: Useful for making plants with altered carbohydrate content
YGELVKAGEVEAKVRLVMDTEEGKVLRERLAVTKEKALEAIKECGSSEEAFAKFIRDLGQISST

SEQ ID NO: 40665 - DNA, 660 bp, Panicum virgatum
  misc_feature: Ceres CLONE 2004102
  misc_feature: Encodes the peptide sequence at SEQ ID NO. 40666
atgtgctggccgtcgccgagcgatccgaaccttcgcgcccacccgacactctgccccgcgcatcaacacaagtcgtgcgccctgcctgtcccagcaccatccggggtgtgcagaccagtataaagccgcgccacatctctgtgcttcgccgcaccaccaatcgaccaaccaccgcaccctaccgatcgatcactagcaagctcctttccaagaagaagctctagatagtagatcgagcggcagatagcaacaatggcggcgcggctgcctccgctggctctgctcgcggcgtccctcgccgtcatggcggccgtcgcgtcggccgactcctggctctacgagaagttcaacacggacggcaccgtccgcgcggactacgacgcgtcgggccagcaggtcgccatgctcaacctcgaccggagctccggcgccgggttcaactccaaggagcagtacctctacggcgagttcagcatccagatgaagctcatccccggcaactccgccggcaccgtctcgtgcttctacctctcttccggtgacagcgacgaccacgacgagatcgacatggagttcatgggcaactcgagcgggcagccggtggtgctcaacaccaacgtgtgggccagcggcgacggcaagagggagcaccagttcgac

SEQ ID NO: 40666 - protein, 135 aa, Panicum virgatum
  misc_feature: Ceres CLONE 2004102
  misc_feature (28)..(135): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MAARLPPLALLAASLAVMAAVASADSWLYEKFNTDGTVRADYDASGQQVAMLNLDRSSGAGFNSKEQYLYGEFSIQMKLIPGNSAGTVSCFYLSSGDSDDHDEIDMEFMGNSSGQPVVLNTNVWASGDGKREHQF

SEQ ID NO: 40667 - DNA, 659 bp, Panicum virgatum
  misc_feature: Ceres CLONE 2004132
  misc_feature: Encodes the peptide sequence at SEQ ID NO. 40668
atcccattccccttccttccagaggagagagagagagagaagaaaagataagctcaggctcagctcgcaagcaagtggagatgcggagcccacgaggagcagcagcagccgggcgctgcggcgcccaggagcacgtcgacctgatcccgggcatccccgacgacgtcgccgtcgactgcctggcgcgcgttccccacgcgtcccaccgcgcgctccgccgcgtctgccgcggctggcgcagcgccgccgccaagccggccttcgcctcggcgcgcgccgccgcgggcgccaccgaggacctcgtctacctcctgcagttcggcaacccctccgccgccgacgacgacggggcgcctaaggacggcgccgacgcgccgccgcccagcgcgccggcctacggcgtcgccgtctacaacgtgaccacgggcgagtggcgccgggagcgcggcgcgccgcccgtgctccccgtcttcgcgcagtgcgccgcggtgggcacccgcgtggccgtgctcggcggctgggacccgcgcaccttcgagcccgtcgccgacgtgcacgtcctcgacgccgccaccggcgcgtggcgccgcgccgcgccgatgcggcccgcgcggtccttcttcgcgtccgtccgcatctgaagatctggatctcggccg

SEQ ID NO: 40668 - protein, 186 aa, Panicum virgatum
  misc_feature: Ceres CLONE 2004132
  misc_feature (20)..(67): Pfam Name: F-box Pfam Description: F-box domain
MRSPRGAAAAGRCGAQEHVDLIPGIPDDVAVDCLARVPHASHRALRRVCRGWRSAAAKPAFASARAAAGATEDLVYLLQFGNPSAADDDGAPKDGADAPPPSAPAYGVAVYNVTTGEWRRERGAPPVLPVFAQCAAVGTRVAVLGGWDPRTFEPVADVHVLDAATGAWRRAAPMRPARSFFASVRI

SEQ ID NO: 40669 - DNA, 645 bp, Panicum virgatum
  misc_feature: Ceres CLONE 2004139
  misc_feature: Encodes the peptide sequence at SEQ ID NO. 40670
acttcggcagatttggtcgaatcgtagatgcatatattccaaaggaccctaaaagaagtggccaccgaggttttggttttgtcaccttcgctgatgagggtgtggcagaacgtgtagctcgcagaagccatgaaattctgggacaagaggttgcaatagacacagctgcaccgcttgagagcgattcaactggtggcggcgcttacattgatcccatggacctttatggtgcttatggttcaatgcgatcttttggcaggttctgtggcagtctagattataattatgggtatggtcccagcagcggaagcagcagatcaagaggggattggcgataccgaccttactgaacaaatcgtgcgtctcggttattgtcaagtgctgttttagttcacctctaggggaggaaactgtggaggtggggaaaagaaatacttttgagaatgctaagtggtacctcaaagtggtatgtgaatcttaagtggggcgtgtggaacctatctatttgttcatgttgtaatttttgacatggaaatgctatggtgctatttctttgtcgcaattaaagattggtgctaaaagatgaaggcagccttgtagttattgtgtagaactgctgcctgtaataaaaaaaattgttagccg

SEQ ID NO: 40670 - protein, 115 aa, Panicum virgatum
  misc_feature: Ceres CLONE 2004139
  misc_feature: SWISSPROT Homolog: EC 5.2.1.8 Peptidylprolyl isomerase
  misc_feature: Useful for making plants with altered lignin content
  misc_feature: Useful for making plants with modulated biomass
FGRFGRIVDAYIPKDPKRSGHRGFGFVTFADEGVAERVARRSHEILGQEVAIDTAAPLESDSTGGGAYIDPMDLYGAYGSMRSFGRFCGSLDYNYGYGPSSGSSRSRGDWRYRPY

SEQ ID NO: 40671 - DNA, 684 bp, Panicum virgatum
  misc_feature: Ceres CLONE 2004157
  misc_feature: Encodes the peptide sequence at SEQ ID NO. 40672
agcctccgtcgtggccctggcggccctggtggtctgcctcgccgtgccggcggcggcggcggggaacaagaccgggcaggtgaccgtgttctggggccggaacaaggacgagggcacgctccgggaggcctgcgactccggcctctacaccatggtcatcatgtccttcctcgacgtctacggccagggcaggtaccacctcgacctctccggccaccccctcgccggcatcggcaccgacatcaagcactgccagtacaagggcgtccccgtgtcgctctccgtcggcggcttcggctccggctactcgctcccgtccgagcaggcggcgttcgacctcttcgaccacctctggaacgcctacttcggcggccgcaagccgggcgtccgccggcccttcggcgacgcgtggctcgacggcgtcgacctcttcctggagcgcggcacggcggcggaccggtacgacgtgctggcgctggagctcgccaagcacaacatccgcggcgggcccgggaagccgctgcacctgacggcgacgccgcggtgcgcgttcccgccggcggggtacctgaagcgggcggtggacacgggcatcttcgagcgcgtgcacgtcaggatctacgacgaccccgactgcgaggcgtactggcacctgcggtgggacgagtggacggcggcgtaccc

SEQ ID NO: 40672 - protein, 227 aa, Panicum virgatum
  misc_feature: Ceres CLONE 2004157
  misc_feature (25)..(221): Pfam Name: Glyco_hydro_18 Pfam Description: Glycosyl hydrolases family 18
  misc_feature: SWISSPROT Homolog: EC 3.2.1.14 Chitinase
ASVVALAALVVCLAVPAAAAGNKTGQVTVFWGRNKDEGTLREACDSGLYTMVIMSFLDVYGQGRYHLDLSGHPLAGIGTDIKHCQYKGVPVSLSVGGFGSGYSLPSEQAAFDLFDHLWNAYFGGRKPGVRRPFGDAWLDGVDLFLERGTAADRYDVLALELAKHNIRGGPGKPLHLTATPRCAFPPAGYLKRAVDTGIFERVHVRIYDDPDCEAYWHLRWDEWTAAY

SEQ ID NO: 40673 - DNA, 667 bp, Panicum virgatum
  misc_feature: Ceres CLONE 2004159
  misc_feature: Encodes the peptide sequence at SEQ ID NO. 40674
accgagagagcttcttcattcttgtcgatctcttgcttgagcagtcagtcctcgattcggcggttccatcgatcgagctgctgcctagctactagctatctacctggtggtccatatcgaccgatcgagaggagctgctagctagcttagctcatcgaggccggccggccggcgacgatatatgatgatggagatggagatggagatgatgatgtcgcaggcggcgacgtcgcagctgccgccggggttccggttccaccccaccgacgaggagctcatcctgcactacctccgcaaccgcgccgcctccgcgccgtgccccgtccccatcatcgccgacgttgacatctacaagttcgacccatgggacctcccctccaaggcgctttccggcgacggcgagtactacttcttcagcccgcgcgaccgcaagtaccccaacggcatccgccccaaccgcgcggcggggtccggctactggaaggccaccggcaccgacaagcccatccacgacagcgccaccggcgagggcgtcggcgtcaagaaggcgctcgtcttctacaagggccgcccgcccaggggcaccaagaccaactggatcatgcacgagtaccgcctcgccgccgccaacccgctcgccaccgccgcctaccgcccgccctccaag

SEQ ID NO: 40674 - protein, 161 aa, Panicum virgatum
  misc_feature: Ceres CLONE 2004159
  misc_feature (19)..(147): Pfam Name: NAM Pfam Description: No apical meristem (NAM) protein
  misc_feature: The sequence is a functional homolog of SEQ ID NO 851 in the 10/374,780 US patent application
  misc_feature: The sequence is a functional homolog of SEQ ID NO 1012 in the 11/435,388 US patent application
  misc_feature: The sequence is a functional homolog of SEQ ID NO 854 in the 10/374,780 US patent application
  misc_feature: Useful for making plants with modulated oxidative stress sensitivity
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered alkaloid content
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with altered cell wall content and/or composition
  misc_feature: Useful for making plants with altered lignin content
  misc_feature: The sequence is a functional homolog of SEQ ID NO 853 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 890 in the 10/374,780 US patent application
  misc_feature: The sequence is a functional homolog of SEQ ID NO 891 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated light quality response
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: Useful for making plants with altered terpenoid content
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 852 in the 10/374,780 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: Useful for making plants with modulated nitrogen use efficiency
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: Useful for making plants with altered carbohydrate content
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 612 in the 11/435,388 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: Useful for making plants with modulated light quality sensitivity
  misc_feature: The sequence is a functional homolog of SEQ ID NO 476 in the 10/666,642 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 1729 in the 11/479,226 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: Useful for biocontainment applications
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 854 in the 11/435,388 US patent application
  misc_feature: The sequence is a functional homolog of SEQ ID NO 310 in the 10/666,642 US patent application
  misc_feature: The sequence is a functional homolog of SEQ ID NO 344 in the 10/666,642 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
  misc_feature: The sequence is a functional homolog of SEQ ID NO 745 in the 11/479,226 US patent application
  misc_feature: The sequence is a functional homolog of SEQ ID NO 582 in the 10/666,642 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
MMMEMEMEMMMSQAATSQLPPGFRFHPTDEELILHYLRNRAASAPCPVPIIADVDIYKFDPWDLPSKALSGDGEYYFFSPRDRKYPNGIRPNRAAGSGYWKATGTDKPIHDSATGEGVGVKKALVFYKGRPPRGTKTNWIMHEYRLAAANPLATAAYRPPS

SEQ ID NO: 40675 - DNA, 660 bp, Panicum virgatum
  misc_feature: Ceres CLONE 2004168
  misc_feature: Encodes the peptide sequence at SEQ ID NO. 40676
gcatcagcatagcaggcaacagcaatctcgaggagcaggtagtagagcgctaagcttccggtgcgtggagcgaatagcggaagcggaagcgaagatggtgaagctcgcgttcgggagcgtcggcgactccttcagcgccacctccatcaaggcctacgtggccgagttcatcgccaccttgctcttcgtcttcgccggcgtcggttccgccatcgcctacgggcaactgacccatggcggcgcgctcgaccctgccggcctggtggcgatcgcgatcgcccacgcgctggccctcttcgtcggcgtctccatcgccgccaacatctccggcggccacctgaaccccgccgtgaccttcggcctcgccgtcggcggccacatcaccatcctcaccggcctcttctactgggtcgcccagctgctcggcgcctccgtggcgtgcctgctcctcaagttcgtcacccacggcgaggccatcccgacccacggcgtcgccggcatcagcgcgctggagggcgtggtgttcgagatcatcatcaccttcgagatcatcatcgcccccatcgccatcggcttcatcgtcggcgccaacatcctcgccgccgggcccttcagcggcagctccatgaaccccgctcgctccttcggccccgccgtcgc

SEQ ID NO: 40676 - protein, 188 aa, Panicum virgatum
  misc_feature: Ceres CLONE 2004168
  misc_feature (11)..(188): Pfam Name: MIP Pfam Description: Major intrinsic protein
MVKLAFGSVGDSFSATSIKAYVAEFIATLLFVFAGVGSAIAYGQLTHGGALDPAGLVAIAIAHALALFVGVSIAANISGGHLNPAVTFGLAVGGHITILTGLFYWVAQLLGASVACLLLKFVTHGEAIPTHGVAGISALEGVVFEIIITFEIIIAPIAIGFIVGANILAAGPFSGSSMNPARSFGPAV

SEQ ID NO: 40677 - DNA, 648 bp, Panicum virgatum
  misc_feature: Ceres CLONE 2004174
  misc_feature: Encodes the peptide sequence at SEQ ID NO. 40678
gacccatccttttgttctgttaatctgaccgaatattaattttttcaaacacaaaaacaaacgcaggagcgaacccaacccaggatgcgatctacttgtttcttcttcaatctcctcaagaatttgtgaaatctgcagctttaaatacaaatatctagttaagcaaatcatctggctgtagaggagaatggcagaaacgatatctagcttctggggtccagttacatcaactattgagtgttgtgaaaaaaattatgcatactcttcttatattgcagaattcttcaacacaatatccaacattccgaccattctcctggctttcattggtcttataaatgcttttagacaacggtttgagaaaagatttagtgttcttcatgtatcaaatatgacgcttgcctttggaagcatgctataccatgctaccttacaacatgtgcaacagcagagtgatgaaacacctatggtgtgggagattctgctgtacatgtacattctctactctccagattggcactaccgtagtacaatgcccatcttcctatttttctatggtgctgcttttgctggtgtccattcatttgtccgtttcgacattggcttcaaagtccattatgtcattctctgtctcctctgcattccaag

SEQ ID NO: 40678 - protein, 153 aa, Panicum virgatum
  misc_feature: Ceres CLONE 2004174
  misc_feature (6)..(153): Pfam Name: aPHC Pfam Description: Alkaline phytoceramidase (aPHC)
  misc_feature: SWISSPROT Homolog: EC 3.5.1.23 Ceramidase
MAETISSFWGPVTSTIECCEKNYAYSSYIAEFFNTISNIPTILLAFIGLINAFRQRFEKRFSVLHVSNMTLAFGSMLYHATLQHVQQQSDETPMVWEILLYMYILYSPDWHYRSTMPIFLFFYGAAFAGVHSFVRFDIGFKVHYVILCLLCIP

SEQ ID NO: 40679 - DNA, 658 bp, Panicum virgatum
  misc_feature: Ceres CLONE 2004187
  misc_feature: Encodes the peptide sequence at SEQ ID NO. 40680
cttgcccacccctcgccgccgccgcagacgcctccctccgcctcgaggcttccgctcgccggtcgcagccatggtgagatccccctcccccgtcttctctctcgcgcgcgcgttgcatcctggttgccgccatggatttgacctcgcccttgccgactcctgccttgcggcggcgcttgcttgcttttgtttccaggtgaagtactcgacggagccgtccaactccaccaagtccgccaaggccatgggccgggacctccgtgttcacttcaagaacacccgtgagacagcgtttgccctcaggaagttgtcactcactaaggccaagaggtaccttgaggatgtgattgcccacaagcaggccatccccttccgcaggtactgtggcggtgttgggcgtactgctcaggctaagtcgcgccactcaaatggacaggggcgctggcctgccaagtctgctagattcattcttgatcttcttaagaatgctgagagcaatgctgaggtcaaaggtcttgatgtcgataccctctatgtgtcgcacattcaagtgaaccaggctcagaagcagcggcgcaggacctaccgggctcacggccgcatcaacccttacatgtcctccccgtgccacattgagctgatcttgtcagagaaggaa

SEQ ID NO: 40680 - protein, 195 aa, Panicum virgatum
  misc_feature: Ceres CLONE 2004187
  misc_feature (58)..(194): Pfam Name: Ribosomal_L22 Pfam Description: Ribosomal protein L22p/L17e
MVRSPSPVFSLARALHPGCRHGFDLALADSCLAAALACFCFQVKYSTEPSNSTKSAKAMGRDLRVHFKNTRETAFALRKLSLTKAKRYLEDVIAHKQAIPFRRYCGGVGRTAQAKSRHSNGQGRWPAKSARFILDLLKNAESNAEVKGLDVDTLYVSHIQVNQAQKQRRRTYRAHGRINPYMSSPCHIELILSEK

SEQ ID NO: 40681 - DNA, 650 bp, Panicum virgatum
  misc_feature: Ceres CLONE 2004199
  misc_feature: Encodes the peptide sequence at SEQ ID NO. 40682
gaggagagtttgcttatacaagagatggcctgcttaagaaagaatttcttgatgttcttatctcaatgcgccgagaaccacttaagcatccccacttctactgcaccatttgtcctattgaacgaatgaagatggaagtaaactctgtgaaacctgatgcttgtaaagggcatattattaagaaatttatcaaggaatgctggagaaaatgtggctgcagcagaaattgcggaaaccgtgtcgttcagcgaggcattactcggaatctgcaggtgttcttgacccctggaaaaaaggggtggggcctgcgccctgctgaaaaactcccccaaggtgcctttgtttgtgagtatgttggtgaaatattgacaaacactgagctatatgagcgtaaccaaattactggtaaaactaagcatacatatcctgtgacactggatgctgactggggcacagaaggtgttctgaatgatgaagaaaccctctgtctagatgctaccttttatgggaatgtggcgaggtttataaaccataggtgctttgatggtaacatcattgatgttcctgttgagattgagacgcctgaccaccactactatcatgtggctttcttcacaactagggaagtagatgctttcaaggagctgaca

SEQ ID NO: 40682 - protein, 215 aa, Panicum virgatum
  misc_feature: Ceres CLONE 2004199
  misc_feature (81)..(214): Pfam Name: SET Pfam Description: SET domain
  misc_feature: SWISSPROT Homolog: EC 2.1.1.43 Histone-lysine N-methyltransferase
GEFAYTRDGLLKKEFLDVLISMRREPLKHPHFYCTICPIERMKMEVNSVKPDACKGHIIKKFIKECWRKCGCSRNCGNRVVQRGITRNLQVFLTPGKKGWGLRPAEKLPQGAFVCEYVGEILTNTELYERNQITGKTKHTYPVTLDADWGTEGVLNDEETLCLDATFYGNVARFINHRCFDGNIIDVPVEIETPDHHYYHVAFFTTREVDAFKEL

SEQ ID NO: 40683 - DNA, 688 bp, Panicum virgatum
  misc_feature: Ceres CLONE 2004209
  misc_feature: Encodes the peptide sequence at SEQ ID NO. 40684
gctacggcgcccagcagtacggtgcgccctacggcgccccgccgccctcgtccgccctcctcccagccccggctccggctacccctacggccccgccgccgggggaagcggaggctacggcgccccgccgccgtacggctcctcccccgccccctccgccccgccctacggcgacaagctccccaaggaaggcaagacctcctcctcctcctccgcgccgccggcgtacggggccccgggcgggtacggcgggagccccttcgcgtcgctggtcccgtccgcgttcccgcccggcaccgaccccaacgtggtggcctgcttccaggcggcggaccgcgacggcagcgggatgatcgacgacaaggagctgcagtccgcgctctccggctacaaccagagcttcagcctccgcaccgtccacctcctcatgtacctattcaccaacaccaacgtccgaaagatcgggcccaaggaatttacttctgtgttttacagtcttcagaattggagagcaatatttgaaaggtttgatcgtgatcggagtggtaagattgactcatctgaactccgtgatgctcttctcagtctgggatattctgtctctccaactgtgctggatctgcttgtgtctaaatttgacaagactgggggcaagagcagagcaattgaatatgataacttcattgaa

SEQ ID NO: 40684 - protein, 228 aa, Panicum virgatum
  misc_feature: Ceres CLONE 2004209
  misc_feature (168)..(196): Pfam Name: efhand Pfam Description: EF hand
  misc_feature: SWISSPROT Homolog: EC 3.4.22.52 Calpain-1
LRRPAVRCALRRPAALVRPPPSPGSGYPYGPAAGGSGGYGAPPPYGSSPAPSAPPYGDKLPKEGKTSSSSSAPPAYGAPGGYGGSPFASLVPSAFPPGTDPNVVACFQAADRDGSGMIDDKELQSALSGYNQSFSLRTVHLLMYLFTNTNVRKIGPKEFTSVFYSLQNWRAIFERFDRDRSGKIDSSELRDALLSLGYSVSPTVLDLLVSKFDKTGGKSRAIEYDNFI

SEQ ID NO: 40685 - DNA, 667 bp, Panicum virgatum
  misc_feature: Ceres CLONE 2004232
  misc_feature: Encodes the peptide sequence at SEQ ID NO. 40686
agcaggccaacggcaacggcgagcagaagacgcgccactcctacccagatctcccggacccgttcagcgccaactgtagcgtcggcgatggccagcacggcggcggagcagccggcgcaggagcagcaggccaacggctcaagagcgacgacctctaccagtacatcctggacacgagcgtgtacccgcgggagcccgagagcatgaaggagctccgcgagatcaccgccaagcacccctggaacctgatgacaacgtcggcggacgaggggcagttcctcaacatgctcatcaagctcatcggcgccaagaagaccatggagatcggcgtctacaccggctactccctcctcgccaccgcgcttgccctccccgaggacggcacgatcttggccatggacatcaaccgcgagaactacgagctcggcctgccctgcatcgagaaggccggcgtcgcccacaagatcgacttccgcgagggccccgcgctccccgtcctcgacgacctcatcgccgacgagaagaaccacggcaccttcgacttcgtcttcgtggacgccgacaaggacaactacctcaactaccacgagcgactgctcaagctcgtcaagctcggcggccttatcggctacgacaacacgctgtggaacggctccgttgtgctccc

SEQ ID NO: 40686 - protein, 221 aa, Panicum virgatum
  misc_feature: Ceres CLONE 2004232
  misc_feature (56)..(221): Pfam Name: Methyltransf_3 Pfam Description: O-methyltransferase
  misc_feature: SWISSPROT Homolog: EC 2.1.1.104 Caffeoyl-CoA O-methyltransferase
  misc_feature: Useful for making plants with altered carbohydrate content
  misc_feature: Useful for making plants with altered cell wall content and/or composition
  misc_feature: Useful for making plants with altered lignin content
QANGNGEQKTRHSYPDLPDPFSANCSVGDGQHGGGAAGAGAAGQRLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGTFDFVFVDADKDNYLNYHERLLKLVKLGGLIGYDNTLWNGSVVL

SEQ ID NO: 40687 - DNA, 1254 bp, Panicum virgatum
  misc_feature: Ceres CLONE 2004240
  misc_feature: Encodes the peptide sequence at SEQ ID NO. 40688
atctaaatctcaataattcattacaatggactctcagcaaatctctcatcctacgtacaaagttgttgatgaatctcaagccgatgccatcgcatgggcctttgttgacaccgaaaacatgaagagacttcccatcaagttcccggagctcaagcctaatgaagccagagctagagtcacctacactggtctttgtcatagtgactgtcacacagttagagaagaatggggcccatgtctccatcctattgcacctggccatgaaattgtcggtgtggttactgaaattggttctgaagttagggacctgaaaattggtgacaaagttggatttggagctcaaagagaatgctgcgaaaaatgtgaatactgtaagcaatcacacgaacaactctgtacgggtaaggcaaacattgaacaggcctacacttacggagataaatattggggaggttatgcatcccatattcaacatcctgctagtttctacttcaagcttcctacgaatcttcctgaagacaagatccctcctctcttctgtgctggagctaccacttattctcctattgccagatatgctaagccaggccaggaagtagccgtacttggtgttggtggtcttggacatcttgctgtgaagtttgccaaagcttggggatgcagagtcactgggttcacaaccagcaaagataaggagaagttcatcttggggcttggagctgacagagttgttatttcaactccagagaacatgaaagctgaagctggcaagtatcacttggtacttaacaccctcccagaaggacaacgtatgaatgaatatgtgtctcttacaagaccacttggaactttctgccaattaggtggtcctcctgctgacaaaccatgccctttcaatcctgctgttcttatctttggccaaattaactttgttgggtccctgattggatcaaggaaagaaatcagagaaatgctggcgttctgtggcaagcacaacattgttcctatgtgtgaaacatttgactttgaagaattccctaaggcatatgataggctccttaatggtaagcctgtttttagatgtgttgttgatgccaccaaagtcagtcttaagcatcattaaactcatgcatattgatattatttgcacttgattgatgtattacaaatacaatctttcgtgttaatgcataactaaaaatattcaacataatcgttttcacatagatgagaactaaaatcggatttgcttcc

SEQ ID NO: 40688 - protein, 365 aa, Panicum virgatum
  misc_feature: Ceres CLONE 2004240
  misc_feature (187)..(322): Pfam Name: ADH_zinc_N Pfam Description: Zinc-binding dehydrogenase
  misc_feature (44)..(158): Pfam Name: ADH_N Pfam Description: Alcohol dehydrogenase GroES-like domain
  misc_feature: SWISSPROT Homolog: EC 1.1.1.255 Mannitol dehydrogenase
MDSQQISHPTYKVVDESQADAIAWAFVDTENMKRLPIKFPELKPNEARARVTYTGLCHSDCHTVREEWGPCLHPIAPGHEIVGVVTEIGSEVRDLKIGDKVGFGAQRECCEKCEYCKQSHEQLCTGKANIEQAYTYGDKYWGGYASHIQHPASFYFKLPTNLPEDKIPPLFCAGATTYSPIARYAKPGQEVAVLGVGGLGHLAVKFAKAWGCRVTGFTTSKDKEKFILGLGADRVVISTPENMKAEAGKYHLVLNTLPEGQRMNEYVSLTRPLGTFCQLGGPPADKPCPFNPAVLIFGQINFVGSLIGSRKEIREMLAFCGKHNIVPMCETFDFEEFPKAYDRLLNGKPVFRCVVDATKVSLKHH

SEQ ID NO: 40689 - DNA, 694 bp, Panicum virgatum
  misc_feature: Ceres CLONE 2004250
  misc_feature: Encodes the peptide sequence at SEQ ID NO. 40690
taatgtgattggccagggtggtgcaggcaaggtgtacaaggctgttgtcgggtctcagggtgaggccatggctgtcaagaaactctggcctatcggtgtggcaagcaaaaggatagacacatttgaggctgaggttgccacactaagcaaagtgaggcacaagaacattgtaaagcttgcctgcagtattacaaacacagtctgcaggttgcttgtctatgagtacatgccaaatggtagcttgggggatatgcttcacggtgcaaagcgcatcatcttggattggccgatgaggtataagattgctgtcaacgctgctgaaggactctcctatttgcaccatgactgtaagcccccaatcatccatcgggacgtgaagtcaaacaacatcctgcttgatgcagagtatggtgccaaggttgcagattttggtgttgcaaagactattggggatggcccagccaccatgtcgataatcgcaggatcttgtgggtacatcgcacctgaatatgcttacactctccatgtgactgaaaagagtgacatatatagctttggtgtggtgatgttggagcttgtcactggtatgaagccgatggcaccggagattggcgaggtggaccttgtgacgtgggtgtctgccactattgagcagaacgggctggagtctgtgctcaagaagactctcgctgag

SEQ ID NO: 40690 - protein, 230 aa, Panicum virgatum
  misc_feature: Ceres CLONE 2004250
  misc_feature (2)..(227): Pfam Name: Pkinase Pfam Description: Protein kinase domain
  misc_feature: SWISSPROT Homolog: EC 2.7.11.1 Non-specific serine/threonine protein kinase
NVIGQGGAGKVYKAVVGSQGEAMAVKKLWPIGVASKRIDTFEAEVATLSKVRHKNIVKLACSITNTVCRLLVYEYMPNGSLGDMLHGAKRIILDWPMRYKIAVNAAEGLSYLHHDCKPPIIHRDVKSNNILLDAEYGAKVADFGVAKTIGDGPATMSIIAGSCGYIAPEYAYTLHVTEKSDIYSFGVVMLELVTGMKPMAPEIGEVDLVTWVSATIEQNGLESVLKKTLA

SEQ ID NO: 40691 - DNA, 792 bp, Panicum virgatum
  misc_feature: Ceres CLONE 2004257
  misc_feature: Encodes the peptide sequence at SEQ ID NO. 40692
aggaggagggatgagcaactgaattaggacgaaagcaacggaaccgaaccgggggagacgacgacgacgtcgtagccggcagcagcgccagcacagcagctggaggagaagaaacgaggagggagggatctacgtgagttggaggaggggggacaggacgagccatggaggcggcgatggatctgatgcggcggatgccgccggccagcgccgagacggcgctcaacgcgctgctctccctcctccccgatcactcgctcgacctcctctcccaggtcgacctcccgctccaggtttgcatggataaggagactttgaaggaatacattctatgcgagtataaccgtgatgctgactcctaccgatcaccttggtcgaacaaatatgaccctcctttggaagatggtacagttccctctgaagagatgaggaatcttgagatcgaggcaaatgaagttttctctgtctatcgtgaccagtactatgaaggtgggatttcatctgtgtacgtttgggaggatgaagataatggtggttttattgcatgcttcttaattaagaaagatggaaaaggaacacgagggtacatgcagattggttcatgggatgccattcatgttattcaggttggtcctgaagaagaaggagcagcacattactgcttgaacagcactgtgatgctgtcattgacaactgacaacaagcagtctggaaccttcaacttgtctggatcgattagacggcagatgagtatgactctcgctgtagcagatgggcacctcgttaatatgg

SEQ ID NO: 40692 - protein, 209 aa, Panicum virgatum
  misc_feature: Ceres CLONE 2004257
  misc_feature (1)..(209): Pfam Name: F_actin_cap_B Pfam Description: F-actin capping protein, beta subunit
MEAAMDLMRRMPPASAETALNALLSLLPDHSLDLLSQVDLPLQVCMDKETLKEYILCEYNRDADSYRSPWSNKYDPPLEDGTVPSEEMRNLEIEANEVFSVYRDQYYEGGISSVYVWEDEDNGGFIACFLIKKDGKGTRGYMQIGSWDAIHVIQVGPEEEGAAHYCLNSTVMLSLTTDNKQSGTFNLSGSIRRQMSMTLAVADGHLVNM

SEQ ID NO: 40693 - DNA, 725 bp, Panicum virgatum
  misc_feature: Ceres CLONE 2004260
  misc_feature: Encodes the peptide sequence at SEQ ID NO. 40694
gcggacacggatcgactctctaagaagacccccgccctcgccccgctccgcctcgtccgccgcttcgccgccatggccgccggcgccgccgaggagttcgtcaagggccgcgtcttccccaacggcgtcgccgtcatcacgctcgaccgccccaaggccctcaacgccatgaacctcgaaatggacattagatacaaggcacttcttgatgaatgggaaacaaatccaagtgtcaagtgtattcttgtggaaagcagctctccccgtgccttctcagctgggatggatattaagggtgttgccgcggaaatacaaaaggacaaaaacacaccacttgtgcaaaaggttttcacagcagaatactcgttgatttgcaagatacatgagtatgcaaaaccttatatatgcttgatggatggagtgacgatgggatttggaattggtctgtcaggacatggccgctaccgtattattactgagaagacactcctagccatgcctgaaaatggtattggcctgttcccagatgttggctttgcttacattggtgcaaaagccccaggagggggtgcaattggagcttaccttgagattacaggaaaaaggatatcatcacctgctgatgctctattcataggccttggtactcactatgtaccttctggaaatttgtggtctctgaaggaatccctcttgagtgctaactttacaaatgatcctcacag

SEQ ID NO: 40694 - protein, 217 aa, Panicum virgatum
  misc_feature: Ceres CLONE 2004260
  misc_feature (20)..(196): Pfam Name: ECH Pfam Description: Enoyl-CoA hydratase/isomerase family
  misc_feature: SWISSPROT Homolog: EC 3.1.2.4 3-hydroxyisobutyryl-CoA hydrolase
MAAGAAEEFVKGRVFPNGVAVITLDRPKALNAMNLEMDIRYKALLDEWETNPSVKCILVESSSPRAFSAGMDIKGVAAEIQKDKNTPLVQKVFTAEYSLICKIHEYAKPYICLMDGVTMGFGIGLSGHGRYRIITEKTLLAMPENGIGLFPDVGFAYIGAKAPGGGAIGAYLEITGKRISSPADALFIGLGTHYVPSGNLWSLKESLLSANFTNDPH

SEQ ID NO: 40695 - DNA, 1029 bp, Panicum virgatum
  misc_feature: Ceres CLONE 2004272
  misc_feature: Encodes the peptide sequence at SEQ ID NO. 40696
aaccgagcagacgacaacctcagcaacgccgaagcggtcgacaatccgacaagccgacaagatgactgtggtttctacgacctcccgaccaagaacgatgttctcgttcctgagactctcctgaagaagcgcaagtcgcaggagaaggcccgcgccgagcgcgccgccgagcaggagaagcggaagaaggccaacaaggagaagcgcggcgtcatcttcaagcgtgctgagaagtacgtcaaggagtaccgcgatgccgagcgcgagaagatccgccttgctcgcgttgccaagcagaacggctcgttctacatccccgctgaggccaagctgatcttcgtcatccgcatcaagggtatcaacaagatccctcccaagccgcgcaagatccttcagctcctgcgtctcctgcagatcaacaacggcgtctttgtccgcgtcaccaaggccaccgccgagatgatcaaggtcgtcgagccgtgggttgcctacggctaccccaacctcaagagcgtcaaggagctcatctacaagcgcggctacggcaaggtcaacggccagcgcatcgctcttaccgacaacgccatcatcgaggagaacctgggcaagtacggcatcatctgcatggaggatctcatccacgagatcttcaccgtcggccccaacttcaagcaggcctccaacttcctgtggcccttcaagctcagcaaccccaccggcggcttccgcccccgcaagttcaagcacttcattgagggtggtgaccttggcaaccgggaggagcacatcaacgccctcatccggcagatgaactaaaagggttgctctggttgtttgtgggttcggtcttggtcaatgggaagtggcatgggtgctcggcgtttaacgggagagccagggtggctcacagggaatgaattaaacacgatgttgttcttgcgcactacatctgatccaccacccgaggactgatgatctagtctgctcccgctggccagggtacggcccaatgctacagagttgtcggcg

SEQ ID NO: 40696 - protein, 271 aa, Panicum virgatum
  misc_feature: Ceres CLONE 2004272
  misc_feature (39)..(109): Pfam Name: Ribosomal_L30_N Pfam Description: Ribosomal L30 N-terminal domain
  misc_feature (111)..(162): Pfam Name: Ribosomal_L30 Pfam Description: Ribosomal protein L30p/L7e
NRADDNLSNAEAVDNPTSRQDDCGFYDLPTKNDVLVPETLLKKRKSQEKARAERAAEQEKRKKANKEKRGVIFKRAEKYVKEYRDAEREKIRLARVAKQNGSFYIPAEAKLIFVIRIKGINKIPPKPRKILQLLRLLQINNGVFVRVTKATAEMIKVVEPWVAYGYPNLKSVKELIYKRGYGKVNGQRIALTDNAIIEENLGKYGIICMEDLIHEIFTVGPNFKQASNFLWPFKLSNPTGGFRPRKFKHFIEGGDLGNREEHINALIRQMN

SEQ ID NO: 40697 - DNA, 467 bp, Panicum virgatum
  misc_feature: Ceres CLONE 2004285
  misc_feature: Encodes the peptide sequence at SEQ ID NO. 40698
tgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttctgcttcgtcaccttctcgagcgagcaggcgatgcgcgatgccatcgaggggatgaacggcaaggacctggacggccgcagcctcaccgtcaacgaggcccagtccctcggcggcccgcgctccggcggcggccgccgcggccggcaccggcgccgcgagggcggcggtggctaccgtagccgcggctgcggtcgccgctagggcggaagtggctacggca

SEQ ID NO: 40698 - protein, 117 aa, Panicum virgatum
  misc_feature: Ceres CLONE 2004285
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with altered alkaloid content
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAASDVEYRCFVGGLAWATDDNSLHNAFSPFGEVLESKIILDRETQRSRGFCFVTFSSEQAMRDAIEGMNGKDLDGRSLTVNEAQSLGGPRSGGGRRGRHRRREGGGGYRSRGCGRR

SEQ ID NO: 40699 - DNA, 652 bp, Panicum virgatum
  misc_feature: Ceres CLONE 2004287
  misc_feature: Encodes the peptide sequence at SEQ ID NO. 40700
gcgccgaggtaagagcagcagcaacccggccattccccgccccccgttccttctcccgtgaggttggtggatcacggccgcgcccgcctcgctgctccgcagacatggcatcaactgttaccttcagctcagttagtgctcaggcggggctgatccaaaagccaaggaacaatggtgtcacaagctactctggtttaaagacatcatcatcaactgttagctttggattggagtcgtcattcctgggcaggaatgcatccctccgggcatctgttgctccaaggattgtgccgaaagcagtgtctgggtctcagatttctccccaggcatcttacaaagtggccgtacttggtgctgccggtggaatcggacaacccctaggccttttgatcaagatgtcccctctcgtgtcagagctgcatctgtatgatattgcaaatgtcaagggtgttgccgcggatctcagccattgcaacacacctgctcaggttctggacttcactggcccctcggaattggcaaactgcttgaaaggtgtggatgttgttgtcatccctgccggagtaccaaggaagccgggcatgactcgtgatgacctctttaacatcaatgcaagcatagtcaagtcactttgtgaggctgttgcagacaa

SEQ ID NO: 40700 - protein, 182 aa, Panicum virgatum
  misc_feature: Ceres CLONE 2004287
  misc_feature (77)..(182): Pfam Name: Ldh_1_N Pfam Description: lactate/malate dehydrogenase, NAD binding domain
  misc_feature: SWISSPROT Homolog: EC 1.1.1.37 Malate dehydrogenase
MASTVTFSSVSAQAGLIQKPRNNGVTSYSGLKTSSSTVSFGLESSFLGRNASLRASVAPRIVPKAVSGSQISPQASYKVAVLGAAGGIGQPLGLLIKMSPLVSELHLYDIANVKGVAADLSHCNTPAQVLDFTGPSELANCLKGVDVVVIPAGVPRKPGMTRDDLFNINASIVKSLCEAVAD

SEQ ID NO: 40701 - DNA, 624 bp, Panicum virgatum
  misc_feature: Ceres CLONE 2004298
  misc_feature: Encodes the peptide sequence at SEQ ID NO. 40702
atctcctccctctgtttctcttctcaaacccttcccttctctcgaagagaaactctctcctgatctcctcccttgctcgagatcttccttccctggcgacgacgactgggcgggcggtggcccagccctttaccggcgacgagcgcatcctccagaattatcgggtgggtgtacatgtgtacacccatgtcctatgttgggtccgcccctgactctaatgctctggtattgctcttgctctttctgaaattctgatctcaaaggtcatggcagagaccatagatttatcaggggacggaggtgttcttaagacggtggtccggaaagcaaaggatgatgctatagcgccatctgatagtctgcccctggttgatgttcattacgaaggcacacttgctgagaatggtgaagtttttgacaccacccatgaagacaactctattttctcatttgaaattggacagggggctgtcatcaaagcatgggatatagccttaagaactatgaaggttggcgaggttgcaaaacttacgtgcaagccagaatatgcatatggaactgcgggctcaccaccggagatacctcctaatgcaaccctcatttttgaggtggagttagttgctt

SEQ ID NO: 40702 - protein, 119 aa, Panicum virgatum
  misc_feature: Ceres CLONE 2004298
  misc_feature (15)..(118): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
  misc_feature: Useful for making plants with modulated biomass
MAETIDLSGDGGVLKTVVRKAKDDAIAPSDSLPLVDVHYEGTLAENGEVFDTTHEDNSIFSFEIGQGAVIKAWDIALRTMKVGEVAKLTCKPEYAYGTAGSPPEIPPNATLIFEVELVA

SEQ ID NO: 40703 - DNA, 727 bp, Panicum virgatum
  misc_feature: Ceres CLONE 2004306
  misc_feature: Encodes the peptide sequence at SEQ ID NO. 40704
atatcgagggatcgagcaagatgaggagcggcaaggctctccttgtcgccgtgctcttggtgggcgtcgcctcccggtgctccggcagcaggggcctgcagggggatcacatcgctgagcagaagtacggtggcgctgggtacggtggcggcggcggatacggcggtggcggtgggtacggcggcggaggtagtggcggtgggtacggaggcggcagcggcggtggcggcggcggctacacgcccggctactccggcaccggaacctgcgactactggaagagccacccggacgcgatcatctcgtgcatcgggtcgctgggcagcatcctagggtcctttggcgacgtgtgcagcgccttcttcgggagcaagctgcagacgctgcaggacgcgctgtgcaacacccgcaccgactgctacggcgacctcctccgcgagggcgccgccgcctacctcaactccgtcgcctcccagaagtacgcctacaccacgcagcaggtcaaggactgcatcgccgtcgcgctcacctccgaggccgccgccgccgcgcaggccgccatgttcaagaaggccaactacgcctgccactactaatcgatcgatgacgaaggagcgagctgcttcctccatctatcatttcgtcagtgtagcgtgcttgttaaataagatgtgtgtacgtgactgtgtttgtgtgtgtgtccgatccccagctagcgtcgccttcg

SEQ ID NO: 40704 - protein, 191 aa, Panicum virgatum
  misc_feature: Ceres CLONE 2004306
  misc_feature (1)..(81): Pfam Name: GRP Pfam Description: Glycine rich protein family
MRSGKALLVAVLLVGVASRCSGSRGLQGDHIAEQKYGGAGYGGGGGYGGGGGYGGGGSGGGYGGGSGGGGGGYTPGYSGTGTCDYWKSHPDAIISCIGSLGSILGSFGDVCSAFFGSKLQTLQDALCNTRTDCYGDLLREGAAAYLNSVASQKYAYTTQQVKDCIAVALTSEAAAAAQAAMFKKANYACHY

SEQ ID NO: 40705 - DNA, 712 bp, Panicum virgatum
  misc_feature: Ceres CLONE 2004314
  misc_feature: Encodes the peptide sequence at SEQ ID NO. 40706
acaagaaaagttttccagagatatgatcccaatttcatcgcaacaagtctagatgaagcatacctcaacataacaaatgtctgcgctgaaagaggcatgacaggagaggaggttgctactgagcttagagctgccatacaccaggaaactggtctaacatgtagtgcaggggttgccccaaaccgcatgattgcaaaggtttgttctgatattaacaaacccaatggacagtttattttgccaaatgatcgagaagctgtatggacatttgtatctacattgcctataagaaagataggtggcataggtaaggtgactgaacagatgttacgtcaggttcttggaatcagtacatgtcaggagatgctgcagaaggctgctttcttatgtgctcttttttctgaatgctcagctgatttctttctttcggttggtcttggattaggaggtacagaaactccagagcaaaggcaaaggaaaagtatcagttgtgagcgaactttcacagcaacaaatgattcttctttgcttttcgagaaattagctaacctcgctgaaaacttaatggatgatttgcaaaaggagggtttgaaaggaaagacactaacactcaaactaaagactgcagattttgaggttcggactcgagcagtaactacacgaggctatatcaactccaagggagacatcttgatctatgctactaagttgc

SEQ ID NO: 40706 - protein, 237 aa, Panicum virgatum
  misc_feature: Ceres CLONE 2004314
  misc_feature (1)..(236): Pfam Name: IMS Pfam Description: impB/mucB/samB family
  misc_feature: SWISSPROT Homolog: EC 2.7.7.7 DNA-directed DNA polymerase
TRKVFQRYDPNFIATSLDEAYLNITNVCAERGMTGEEVATELRAAIHQETGLTCSAGVAPNRMIAKVCSDINKPNGQFILPNDREAVWTFVSTLPIRKIGGIGKVTEQMLRQVLGISTCQEMLQKAAFLCALFSECSADFFLSVGLGLGGTETPEQRQRKSISCERTFTATNDSSLLFEKLANLAENLMDDLQKEGLKGKTLTLKLKTADFEVRTRAVTTRGYINSKGDILIYATKL

SEQ ID NO: 40707 - DNA, 718 bp, Panicum virgatum
  misc_feature: Ceres CLONE 2004316
  misc_feature: Encodes the peptide sequence at SEQ ID NO. 40708
cccctgatcccgtcgtcctattcgctcccccaccatcccctgcgcctcgtcgcggccgctcgcggtgtcgctccggcaaacccaatggccgccgccgccgtccccaacggccacgccgccgccgacgcgccccctccctcctcgtcgtcgctggtgttcctgggcacggggtgctcgagcgccgtcccgaacgcgcggtgcctgatccagccccccgacccgccctgccacgtctgctcccagtccctctccatcccgcccgagctaaaccccaactacaggtgcaatacttctcttttgattgactattgccaggatgaaggtgcacataagtatattataattgatgttgggaagacattcagagaacaagttcttcgatggtttgttcgccacaaaatcccttgtgttgattctattcttctgactcatgagcatgcagatgcaatcttaggccttgatgatattagggttgtgcaggcatttagtcccacaaatgatattgatccaacccctatttatctctctcagtttgctatggacagcatctccctaaagttcccttatttggtcaaaaagaaactaaaggaaggggaggaggtcaggcgagttgctcaactggactggagaataatcgagagtgatcttcagataccatttacaacttcaggggctagagtttgttccccttccggtgatccatggtgaagactacatt

SEQ ID NO: 40708 - protein, 207 aa, Panicum virgatum
  misc_feature: Ceres CLONE 2004316
  misc_feature: SWISSPROT Homolog: EC 2.3.1.181 Lipoyl(octanoyl) transferase
MAAAAVPNGHAAADAPPPSSSSLVFLGTGCSSAVPNARCLIQPPDPPCHVCSQSLSIPPELNPNYRCNTSLLIDYCQDEGAHKYIIIDVGKTFREQVLRWFVRHKIPCVDSILLTHEHADAILGLDDIRVVQAFSPTNDIDPTPIYLSQFAMDSISLKFPYLVKKKLKEGEEVRRVAQLDWRIIESDLQIPFTTSGARVCSPSGDPW

SEQ ID NO: 40709 - DNA, 713 bp, Panicum virgatum
  misc_feature: Ceres CLONE 2004323
  misc_feature: Encodes the peptide sequence at SEQ ID NO. 40710
aggtttccgtcccgccgccgccgccgccgccacttgtcactcgctcgccaccgccgccacttgccaccgccgccgccatgggccgcatgtacggccccgggaagggcatgtcctcgtcggtgctgccctacgctcgctccgcgcccgggtgggtcaggtcgtccgcggcggaggtggaggacgcgatcgtgcgcgccgccaagaagggccagctgccatcgcagatcggcacgctgctccgcgacgcgcacggcgtgccgctggtccacggcgtcacggggcgcaagatcctgcgcgtgctcagggcccgcggcctcgcgccggaggtgcccgaggacctctacttcctcatcaagaaggccgtcgcgatcaggaagcacctggacaggaaccggacggacgtggacgccaagttccgcctcatcctcgtcgagagcagggtccaccgcctctcccgctactaccgccgcgccaagaagatccccgcctcctggaagtacgaatccaacaccgcgagcactctggtggcttgagtgacgattttgttttgagcttcgtggttcctgtggattgattatctacacttctggagtttaccttgaacttaaattaagtgacagtagtgcctttttggttgcacctaggaagaagtatgtatcttgagagtttatgaaactggatcaagttttagtcctttggagctagattgttca

SEQ ID NO: 40710 - protein, 151 aa, Panicum virgatum; identical to SEQ ID NO: 11966
  misc_feature: Ceres CLONE 2004323
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
  misc_feature: Useful for making plants with modulated nitrogen use efficiency

SEQ ID NO: 40711 - DNA, 733 bp, Panicum virgatum
  misc_feature: Ceres CLONE 2004348
  misc_feature: Encodes the peptide sequence at SEQ ID NO. 40712
aaaaaaagagctaatcgcttatcatctgcgcctccccatctctcccctgctcctccacctccttgtgatccatccaaaccaggggtagccatgtcggactccgaggagcaccacttcgagtcgaaggccgacgctggggcgtccaagacctacccgcagcaggccggtaccatccgcaagaacggattcatcgtcatcaagggccgcccctgcaaggtggtggaggtttctacctcaaagactggtaagcacggtcatgctaaatgccactttgttgccatcgacatattcaatgggaaaaagcttgaagatattgtcccatcttcccataattgtgatgtgccacatgtgaaccgcactgagtatcagctgattgacatatctgaggatggatttgtgagccttcttacttctgatggcaacaccaaggatgatcttagacttccaactgatgagactctcctgggccagatcaaggaaggatttgacagcgggaaggaccttgtggtgactgtccagtctgcaatgggggaggagcagatctgcgcgctgaaggatgtcggccccaagtagcttcccaaagaaggccgatcttggaacagagggagcaactgtatctcaaaacttaaatcgaaaaaggcgtgtatcgcaacaaaggattggtaccgagacattcaccttagcttgagctggcttttgctgtagtaaactcaagtgcagtgattgctgggtg

SEQ ID NO: 40712 - protein, 160 aa, Panicum virgatum
  misc_feature: Ceres CLONE 2004348
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTIRKNGFIVIKGRPCKVVEVSTSKTGKHGHAKCHFVAIDIFNGKKLEDIVPSSHNCDVPHVNRTEYQLIDISEDGFVSLLTSDGNTKDDLRLPTDETLLGQIKEGFDSGKDLVVTVQSAMGEEQICALKDVGPK

SEQ ID NO: 40713 - DNA, 418 bp, Panicum virgatum
  misc_feature: Ceres CLONE 2004350
  misc_feature: Encodes the peptide sequence at SEQ ID NO. 40714
attccgtcgatcccgtcaagctccggatcccgcgccccctccgcgcctcgctctccggagagatcagtacacttcttccctcgcgcgatggcccagactgttgtactcagggttggcatgtcctgtgaaggctgtgttggagctgttaagcgagttttgggtaaaatggaaggtgttgaatcttacgatgtagacatcaaggagcagaaggtcacggtgaagggtaacgtaacacctgatgcagttctgcagactgtttccaagacgggcaaaaagacttcattctgggatgctgagcctgcaaccaaccaatccacagcacctgctgatgctactgcttgacaagttggatgtaacaaataccagtgtaattttctggtaaaactacaaatgtgtggggtctgatggtatttatctt

SEQ ID NO: 40714 - protein, 84 aa, Panicum virgatum; identical to SEQ ID NO: 39948
  misc_feature: Ceres CLONE 2004350
  misc_feature (6)..(66): Pfam Name: HMA Pfam Description: Heavy-metal-associated domain
  misc_feature: SWISSPROT Homolog: EC 3.6.3.4 Copper-exporting ATPase

SEQ ID NO: 40715 - DNA, 581 bp, Panicum virgatum
  misc_feature: Ceres CLONE 2004353
  misc_feature: Encodes the peptide sequence at SEQ ID NO. 40716
cactgctcgggcactggaatacctgcatgaggtgtgcttgccatctgttgttcatagaaactttaagtcttcaaacatcctattagacgaggagcataatccacatctatctgactgtggacttgctgccttgacacctaatactgaaagacaagtttcgactgaagtatttggatcatttggatacagtgcccctgagtttgctatgtccggaatttatactgtaaagagtgacgtgtacagttttggagtagtgatgttagagctattgacagggaggaagccactagacagttctagagagaggtcagaacagtcccttgttagatgggccactccgcagcttcacgatattgatgcacttgctaagatggttgatccagcattaaatggaatgtacccagctaaatcactctcccgttttgcagacataattgcgctctgcgttcagcctgagccagagttccgtccgcctatgtcagaggtggttcagcaacttgtgcgcctgatgcagagggctagcatagtgaggcggcaatcaggagaggagctaggattctcatacagagccccggaacgcg

SEQ ID NO: 40716 - protein, 193 aa, Panicum virgatum
  misc_feature: Ceres CLONE 2004353
  misc_feature (1)..(166): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Useful for making plants with altered cell wall content and/or composition
TARALEYLHEVCLPSVVHRNFKSSNILLDEEHNPHLSDCGLAALTPNTERQVSTEVFGSFGYSAPEFAMSGIYTVKSDVYSFGVVMLELLTGRKPLDSSRERSEQSLVRWATPQLHDIDALAKMVDPALNGMYPAKSLSRFADIIALCVQPEPEFRPPMSEVVQQLVRLMQRASIVRRQSGEELGFSYRAPER

SEQ ID NO: 40717 - DNA, 645 bp, Panicum virgatum
  misc_feature: Ceres CLONE 2004365
  misc_feature: Encodes the peptide sequence at SEQ ID NO. 40718
atccatcatcgaacacaaaagaaaaaacatcaatcaaagtgcttacatctttgaggtaagccacaatacatgcgcccccttcaatttcctattgttctttgttcgtttagctatgaacattgcaaaagaagaacaagaaactgattgaagcccgtagttctggtttgcttcgtttctactactttgtgtagcctgaactcccatttttaacaaatggggcgcagaaattctgcaggtatctctgaagaagatgagctcaacagctgacagcaaggggtgcaatgctactcccaagacggagtggcctgagctagtgggatgcacgatcaaagaggcgatggagaggatcaaggcggagcggccgcacctcaatgtcgtgcctgtccctgtaggctcctttgtcacccaagaggttgaccctaatcgcgtccgtctctgggttgacatcgtcgccgaggttcctaaaattggctgaagcatcgaaacgccaagccaccaaataatggcatttgtgtgtgttcctatggaccattcatgtgggttaagtaaataaaagcatgtctgtgatggactcttgtatatggttcgcctgtcataagttgtgaattgtgatgattgagttattaataatacgttggcaacacc

SEQ ID NO: 40718 - protein, 74 aa, Panicum virgatum
  misc_feature: Ceres CLONE 2004365
  misc_feature (15)..(74): Pfam Name: potato_inhibit Pfam Description: Potato inhibitor I family
MSSTADSKGCNATPKTEWPELVGCTIKEAMERIKAERPHLNVVPVPVGSFVTQEVDPNRVRLWVDIVAEVPKIG

SEQ ID NO: 40719 - DNA, 731 bp, Panicum virgatum
  misc_feature: Ceres CLONE 2004377
  misc_feature: Encodes the peptide sequence at SEQ ID NO. 40720
atcccaaacacagcaagctcagagtactcaagctagctaaagcaagcagctcataccacacacttgaagctctagctagctaatagaaatggcgccatcaaagcttgccatgttcctcgccctgactgtcctcgccttcgcggcgactgtgcacggctgcacgccgtcctgtcctaccccaccagtggttcccagcccaccgccgccggttgtgccgacgccgtctggcggtggtggctcctgcccaatcaacgcactgaagctggaggtgtgcgccaatgtgttgaacctcctgaagctcaacatccctgtcacggggagcgaccaatgctgcccgctgctgcaggggctcgtcgaccttgacgccgcagtctgtctctgcactgctatcaaggccaacgtcctcggcatcaacatcaatgtgcccatcgacctgagcctcctcctcaaccactgtggcaagatctgccctgcagatttcacctgccccaattagcatccatcacctgaatcttcatccactgccttgcctgcgatcttgtgcacctatgccgtcggtctatgtgttggtttgcatcagcatgcacccatatatgtgttgatctcttctgttcgggttcgagtgagggctcagggcaggtgatggcatgcaaattgttgttctcgttcattcgaacaatatgttttgtttttttgtctgtaacttcatcatacccgtgaaataaaaattt

SEQ ID NO: 40720 - protein, 135 aa, Panicum virgatum
  misc_feature: Ceres CLONE 2004377
  misc_feature (52)..(133): Pfam Name: Tryp_alpha_amyl Pfam Description: Protease inhibitor/seed storage/LTP family
  misc_feature: Useful for making plants with modulated biomass
  misc_feature: Useful for making plants with modulated flowering time
  misc_feature: Useful for making plants with modulated salt sensitivity
MAPSKLAMFLALTVLAFAATVHGCTPSCPTPPVVPSPPPPVVPTPSGGGGSCPINALKLEVCANVLNLLKLNIPVTGSDQCCPLLQGLVDLDAAVCLCTAIKANVLGININVPIDLSLLLNHCGKICPADFTCPN

SEQ ID NO: 40721 - DNA, 634 bp, Panicum virgatum
  misc_feature: Ceres CLONE 2004381
  misc_feature: Encodes the peptide sequence at SEQ ID NO. 40722
agagcaaagctgctcgtgcaacaagcgaagaggcgaaagagagaaagagttggtggcaactggcaaggcagatggcgtcgccgtcgtcgtcgctgtgctccggcttcgcctccctgcggatggcctcccttggccaccgccgcggcctcgtcttctccacccccaggtcggtcaaacgcgccgccgccccttctatcctcccccgtctggccgtcccgacgaccacgcgcgtggtagtagcacgtcgccggcggtttgaatccgcccccccccccccccccccgtccgatctcgccggaggttactagcgatcccttgctccgttgccgcccccgatggccccgagcggcgctgctgcaaactgtgagctgtgccgtcaccgaagcagaattgcgcgctctggatcaaatggcttgagccctctggcaccgaacagctcttatcatgatgggtagtgagggtaataattgcgtgtgctacttgatcactttgatgttgcttgtggaggactttgtcaatcaggaaatgccatatgcttaagttcacagctctcatgtctatgatgatgctcgttaagtgatcttcggtcgtgttacctgttaacgagagaacaaggggaagccccccccccccc

SEQ ID NO: 40722 - protein, 78 aa, Panicum virgatum
  misc_feature: Ceres CLONE 2004381
  misc_feature: SWISSPROT Homolog: EC 5.1.3.1 Ribulose-phosphate 3-epimerase
MASPSSSLCSGFASLRMASLGHRRGLVFSTPRSVKRAAAPSILPRLAVPTTTRVVVARRRRFESAPPPPPPSDLAGGY

SEQ ID NO: 40723 - DNA, 623 bp, Panicum virgatum
  misc_feature: Ceres CLONE 2004398
  misc_feature: Encodes the peptide sequence at SEQ ID NO. 40724
aacgctcgtctcacctgtcaatcgaaagccaagccaatgggggcagccgtcgggctccggctgcatgccggagctggtcggcctgtcgccgtgcatggactacctgtcgggcaacgccacgacgcccgacgcgccgtcgtgctgctcagcgctgtcgggcatgctgaggtcgagcccgggctgcctctgcacggtgctcggcggcacggccgcgtcgctcggcgtcgccgtcgacggcgcccgcgtggcgcagctgcccggggcgtgcaaggtccaggcgcctcctgccacccagtgcaacgccgtgggagctccagtggcgtctccggcggcgccgtcagacgccaacgcgacccctgcagtctacaccagcatccacccttccatactctgacggaaataccgggaagcctggaaggatcttcgtcttcgcagccgcagcactggcgctgctccatcgtttgtgagatgaatcagatgatgcgaaagcttcttgtgttcgtctccgacaaccgaatcgtttcacacgagcagcttgtaaagtttggggtgtttgttgctccaggattcagaggagcagcgcgttttttacattgttcgctcgagcatttttttttttgttt

SEQ ID NO: 40724 - protein, 130 aa, Panicum virgatum
  misc_feature: Ceres CLONE 2004398
  misc_feature (21)..(99): Pfam Name: Tryp_alpha_amyl Pfam Description: Protease inhibitor/seed storage/LTP family
TLVSPVNRKPSQWGQPSGSGCMPELVGLSPCMDYLSGNATTPDAPSCCSALSGMLRSSPGCLCTVLGGTAASLGVAVDGARVAQLPGACKVQAPPATQCNAVGAPVASPAAPSDANATPAVYTSIHPSIL

SEQ ID NO: 40725 - DNA, 740 bp, Panicum virgatum
  misc_feature: Ceres CLONE 2004399
  misc_feature: Encodes the peptide sequence at SEQ ID NO. 40726
caatgaaggagatgtttggaattgacaggactgaggagcattatgcatgcatgattgatcttcttggccgtgcaggaaaattagaggatgcaatggagcttgtcaacaacatgccattccaagctaatgctaaagtttggggtgcactcttaggagcctcgagagtacaccgagatccagagctaggaaggttagcagctgaaaagctcttaaccctagagccggagaagtctggcacgcatgtcctccttgcaaacacttatgcttcagcaggcatgtgggatgaggtggctaaggtgcggaagctaatgaaagtcagtaatgtcagaaaggagcctgctatgagctgggttgagatgaaggacaaggtgcatactttcattgtcggggacaagagccatccaaggacaagagagatatatggcaagctagatgaattgggagatctgatgaaaaaagctggttatgttccgaatgtcgaggttgatctgcatgatgtggacaaaagtgaaaaggaactgcttctttctcaccacagcgaaaggctggctgccgcgtttgcgttgatcagcactccagctggggccccaatcagagtcaagaaaaatctgcggatatgcagagattgccatgttgccttcaagttcatttcaaagatcgtatcaagggagattatcatcagagatatcaatcggttccatcatttcagagatgggacatgttcttgcggtgattattgg

SEQ ID NO: 40726 - protein, 245 aa, Panicum virgatum
  misc_feature: Ceres CLONE 2004399
  misc_feature: Useful for making plants with altered cell wall content and/or composition
MKEMFGIDRTEEHYACMIDLLGRAGKLEDAMELVNNMPFQANAKVWGALLGASRVHRDPELGRLAAEKLLTLEPEKSGTHVLLANTYASAGMWDEVAKVRKLMKVSNVRKEPAMSWVEMKDKVHTFIVGDKSHPRTREIYGKLDELGDLMKKAGYVPNVEVDLHDVDKSEKELLLSHHSERLAAAFALISTPAGAPIRVKKNLRICRDCHVAFKFISKIVSREIIIRDINRFHHFRDGTCSCGDY

SEQ ID NO: 40727 - DNA, 723 bp, Panicum virgatum
  misc_feature: Ceres CLONE 2004402
  misc_feature: Encodes the peptide sequence at SEQ ID NO. 40728
gcatcagcgtagcaggcaacagcaatctcgaggagcaggtagtagagcgctaagcttccggtgcgtggagcgaatagcggaagcggaagcgaagatggtgaagctcgcgttcgggagcgtcggcgactccttcagcgccacctccatcaaggcctacgtggccgagttcatcgccaccttgctcttcgtcttcgccggcgtcggttccgccatcgcctacgggcaactgacccatggcggcgcgctcgaccctgccggcctggtggcgatcgcgatcgcccacacgctggccctcttcgtcggcgtctccatcgccgccaacatctccggcggccacctgaaccccgccgtgaccttcggcctcgccgtcggcggccacatcaccatcctcaccggcctcttctactgggtcgcccagctgctcggcgcctccgtggcgtgcctgctcctcaagttcgtcacccacggcaaggccatcccgacccacggcgtcgccggcatcagcgcgctggagggcgtggtgttcgagatcatcatcaccttcgcgctcgtctacaccgtgtacgccaccgccgccgaccccaagaagggctccctcggcaccatcgcccccatcgccatcggcttcatcgtcggcgccaacatccctcgcgccggggccctcagcggcggctccatgacccccgctcgctccttcggccccgccgtcgccgcgggcaactt

SEQ ID NO: 40728 - protein, 209 aa, Panicum virgatum
  misc_feature: Ceres CLONE 2004402
  misc_feature (11)..(209): Pfam Name: MIP Pfam Description: Major intrinsic protein
MVKLAFGSVGDSFSATSIKAYVAEFIATLLFVFAGVGSAIAYGQLTHGGALDPAGLVAIAIAHTLALFVGVSIAANISGGHLNPAVTFGLAVGGHITILTGLFYWVAQLLGASVACLLLKFVTHGKAIPTHGVAGISALEGVVFEIIITFALVYTVYATAADPKKGSLGTIAPIAIGFIVGANIPRAGALSGGSMTPARSFGPAVAAGN

SEQ ID NO: 40729 - DNA, 690 bp, Panicum virgatum
  misc_feature: Ceres CLONE 2004408
  misc_feature: Encodes the peptide sequence at SEQ ID NO. 40730
gtttccctttctccgctaccacattcgatcggcttcgaggcaagcagcatcacaacacaacgtcctctcctgccggcggaccggatccacccccgcgccatgtactcccggcggccgccgcatccgtcccaccggagtccacggcgatcacccgccgcctactgtctcctcctcaccctcgctctcctcttcgcgtccgccgccgccaaatcctctcgccgccccatctccgacaacgagatccggcagaagaaggaggcctgctacaccgacgtcgagaacgggctgtggggatgggtgtgcaggtcctcgccaacggagaaggagaactgcgtgctgcgctgcctctccccggagtgctacgacctcatctacggcggcgacccgcttgaagaaggggagctggattatgtccgcggccaggaatacaagtactgcatgcacaaatcatcccttggagaaagcttggatggcgttaaggggtccttcagctattcgtgaagttagcaagaataaaaggctcccatatgtccaagctgcacttctcagttctcctctatacggtggtgttcagccatgtccagctatcgtctccaagcatgggcaatcgataagttcatcgattaaatccaaatcgattaaatgtgaaaattttcctaaaccctccaagcactgctgttgtgcatcctg

SEQ ID NO: 40730 - protein, 133 aa, Panicum virgatum
  misc_feature: Ceres CLONE 2004408
  misc_feature: Useful for biocontainment applications
MYSRRPPHPSHRSPRRSPAAYCLLLTLALLFASAAAKSSRRPISDNEIRQKKEACYTDVENGLWGWVCRSSPTEKENCVLRCLSPECYDLIYGGDPLEEGELDYVRGQEYKYCMHKSSLGESLDGVKGSFSYS

SEQ ID NO: 40731 - DNA, 631 bp, Panicum virgatum
  misc_feature: Ceres CLONE 2004415
  misc_feature: Encodes the peptide sequence at SEQ ID NO. 40732
accaaccacagcgaaacagaaccctgttcactctgtgtcggtgtccgtgtctccccccttctctggaagcacgaggcctccgtacgtgctccacacgcttctcaggtctctctctctccctctctcaactcccgtcgctcgagctgtccgtggcgggcggagagcgcgagccgccaccgtacggtcgggagaggggcggagggagaggtggaggaggaggagggaggagagcgcgggcgacatggccgcggccgggctgggcgtgaaggcggcgccgttcacgtacgcggcgcacgcgctggccgcggcggcggcggtgctggtgctggtgtggtgcgtccacttccgcggcggcctcgcgctcgaggcccagaacaagaacctcatcttcaacgttcaccctgtgctgatgctgattggatacattatcctcggcagtgaagccattatgatctacaaggtgttcccaaaactgaaccacgacaccgccaagctgacgcacctgatcctccacgccatcgcgactgtgctcggcgccttcgggatctactgtgccttcaagttccacaacgacagtgggatcgccaacctctacagcctgcactcctggctcggcatcgggacgatctcc

SEQ ID NO: 40732 - protein, 129 aa, Panicum virgatum
  misc_feature: Ceres CLONE 2004415
  misc_feature (14)..(129): Pfam Name: Cytochrom_B561 Pfam Description: Cytochrome b561
MAAAGLGVKAAPFTYAAHALAAAAAVLVLVWCVHFRGGLALEAQNKNLIFNVHPVLMLIGYIILGSEAIMIYKVFPKLNHDTAKLTHLILHAIATVLGAFGIYCAFKFHNDSGIANLYSLHSWLGIGTI

SEQ ID NO: 40733 - DNA, 1062 bp, Panicum virgatum
  misc_feature: Ceres CLONE 2004419
  misc_feature: Encodes the peptide sequence at SEQ ID NO. 40734
actcatcgcgatcgatcgctgctagctagctcccagctgcgattctgatccttcgtgctccctcagttgtcgtcgtcgctggctcgctcgcttgcttgccagctctctctctcatagtagctagctgcttgcatggatccgtccgggcccggcccgtcgccggtcgttggcggaggaggcggcggtgacgcgccggccgtggtgccgcagcagcggccggcgcagctgagcaggtacgagtcgcagaagcggcgggactggaacacgttcctgcagtacctgcggaaccaccgcccgccgctgacgctggcgcggtgcagcggcgcgcacgtgatcgagttcctcaggtacctggaccagttcggcaagaccaaggtgcacgccgccgggtgcgcctactacggccagcccgcgccgccggggccctgcccgtgcccactgcggcaggcctggggctccctcgacgcgctcatcggccgcctgcgcgccgcgtacgaggagagcggcggcacgcccgagtccaaccccttcgccgcgcgcgccgtgcggatctacctccgcgaggtgcgcgactcgcaggccaaggcgcgcggcatcccctacgagaagaagaagcgcaagcgcgcgcagcaggccgccgagccgtcgtcgagctcgtccgccgccccggccggtgggagcgggagcatcagcagagctgctgcgacggccgccgctcatcaggctggagggagcagcgctgcaccgagcaacacctgagtacagtagatctgcagatcttgtttaattatcgtctccgcatcgcaagatttgagcttagctttctactgcttttgctatatatatgtgctttgcgttgcttcttttctctgcccatttcatccttttcttaccagggttttggatccccctttttttttttccggtttattaggtcaagtatatggctagatattggagtagtagtagctgaaaggggaagaagttggcgattaatcggtgcaagggcaactgtgtgttcatgatctgatacatatatattaatatatatatgttcttggt

SEQ ID NO: 40734 - protein, 208 aa, Panicum virgatum
  misc_feature: Ceres CLONE 2004419
  misc_feature: Useful for making plants with modulated low light sensitivity
  misc_feature: Useful for making plants with modulated nitrogen use efficiency
  misc_feature: Useful for making plants with modulated flowering time
  misc_feature: Useful for making plants with modulated biomass
  misc_feature: Useful for biocontainment applications
MDPSGPGPSPVVGGGGGGDAPAVVPQQRPAQLSRYESQKRRDWNTFLQYLRNHRPPLTLARCSGAHVIEFLRYLDQFGKTKVHAAGCAYYGQPAPPGPCPCPLRQAWGSLDALIGRLRAAYEESGGTPESNPFAARAVRIYLREVRDSQAKARGIPYEKKKRKRAQQAAEPSSSSSAAPAGGSGSISRAAATAAAHQAGGSSAAPSNT

SEQ ID NO: 40735 - DNA, 601 bp, Panicum virgatum
  misc_feature: Ceres CLONE 2004434
  misc_feature: Encodes the peptide sequence at SEQ ID NO. 40736
accagggtgtggcccaacaccaagtacctggacgtgatcgtgacgggcgccatggcgcagtacatcccgacgctgaggtactacagcggcgggctgcccatggcgtgcaccatgtacgcctcctccgagtgctacttcgggctcaacctccggcccatgtgcgacccgtcggaggtgtcctacaccatcatgcccaacatgggctacttcgagctgctgccgcacgacccggaggccggcgagccgggcagggacgtggacggcccgccgccgcggctggtggagctggcggacgccgaggtgggcaaggagtacgagctggtgatcaccacctacgcggggctctgccgctaccgcgtcggcgacatcctgcaggtgaccgggttccacaacgcggcgccgcagttccggttcgtgcgccgcaagaacgtgctcctcagcatcgactcggacaagacggacgaggcggagctgcaggcggccgtggagcgcgcggcggcgctgctggcgccctacggcgcgagcatcgtggagtacacgagccaggcggacgccgccgccatcccgggccactacgtggtgtactgggagctgatggtgc

SEQ ID NO: 40736 - protein, 200 aa, Panicum virgatum
  misc_feature: Ceres CLONE 2004434
  misc_feature (1)..(200): Pfam Name: GH3 Pfam Description: GH3 auxin-responsive promoter
TRVWPNTKYLDVIVTGAMAQYIPTLRYYSGGLPMACTMYASSECYFGLNLRPMCDPSEVSYTIMPNMGYFELLPHDPEAGEPGRDVDGPPPRLVELADAEVGKEYELVITTYAGLCRYRVGDILQVTGFHNAAPQFRFVRRKNVLLSIDSDKTDEAELQAAVERAAALLAPYGASIVEYTSQADAAAIPGHYVVYWELMV

SEQ ID NO: 40737 - DNA, 716 bp, Panicum virgatum
  misc_feature: Ceres CLONE 2004447
  misc_feature: Encodes the peptide sequence at SEQ ID NO. 40738
aaccctagtctccatccccccacccgccgcccctcaaccctacccagccgccgcccctcaaccctacccagccgccgccgccgccgcgcggaggcgaccccccaccgccgccaagatgcagatcttcgtgaagaccctgacggggaagaccatcacgttggaggtggagtcctcggacaccatcgacaacgtgaaggccaagatccaggacaaggagggcatccccccggaccagcagcggctcatcttcgccggcaagcagctcgaggacggccgcaccctcgccgactacaacatccagaaggagtccaccctccacctggtgctccgcctccgcggtggcgccaagaagcgcaagaagaagacctacaccaagcccaagaagatcaagcacaagcataagaaggtgaagctcgccgtcctgcagttctacaaggtcgacgacgccaccggcaaggtcacccgcctccgcaaggagtgccccaacgccgactgcggcgcgggtaccttcatggccaaccacttcgaccgccactactgcggcaagtgcggcctcacctacgtctacaaccagaaggcgtaatcgcttgcatcgctttgcttagcattacccgcctacctatcatgaaattgagctgttggtttctcgaattggatatcatttagatctgtctgaggttgagacttaaatggagtagcagtatctattttctctg

SEQ ID NO: 40738 - protein, 155 aa, Panicum virgatum; identical to SEQ ID NO: 14149
  misc_feature: Ceres CLONE 2004447
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a
  misc_feature: Useful for making plants with modulated cold sensitivity
  misc_feature: Useful for making plants with modulated flowering time
  misc_feature: Useful for making plants with modulated nitrogen use efficiency

SEQ ID NO: 40739 - DNA, 699 bp, Panicum virgatum
  misc_feature: Ceres CLONE 2004453
  misc_feature: Encodes the peptide sequence at SEQ ID NO. 40740
actgtcctcctctacgccctcgctcgcgccgccgccgcacttcccgtctggtctcgtctgcgcagcaaaccctagcagcaggtagagagccgccatccgcccctcccctcctcttcttctgctcccggtccgcatccagatctctggcctcaccgcctcgtctcatctatttcgcgttggttttcctgtctacaggtgggtcggttatcgacggacagtagccatgagtaagttgcaaactgaggccctcaaggaggccatctccctggtcgtgtcggaggcaagggagaagaacaggaagttcacagagaccatcgagctccagattggactgaagaactacgatccgcaaaaggacaagcgtttcagtggctccgtcaagctgccccacatccctcgccccaagatgaaggtctgcatgcttggtgatgcccagcacgtggaggaggctgagaagatcggtcttgattacatggatgttgaagctcttaagaagatgaacaagaacaagaagcttgtcaagaaacttgctaagaagtaccatgctttcttagcttctgaggctattatcaagcagattccccgtctccttggtcctggtctcaacaaggcaggcaagttcccaactttggttactcaccaggagtctctggaatcaaaggtgaatgagacgaaagctacagtcaagttccagctcaa

SEQ ID NO: 40740 - protein, 158 aa, Panicum virgatum
  misc_feature: Ceres CLONE 2004453
  misc_feature (10)..(157): Pfam Name: Ribosomal_L1 Pfam Description: Ribosomal protein L1p/L10e family
MSKLQTEALKEAISLVVSEAREKNRKFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQL

SEQ ID NO: 40741 - DNA, 781 bp, Panicum virgatum
  misc_feature: Ceres CLONE 2004469
  misc_feature: Encodes the peptide sequence at SEQ ID NO. 40742
aaggcccaatatccctcagcactggcttcgccgcggcctcctctctcttctgcggcggcgcggcgcggcgcgccacgcgtactccggcagccaccgccgcgcgtgatcgtcgtccgccggcgacgcggggcggtcgaagagacctcggcaccgacacctctcccctaaattttgtagtatggaccctcctcttcatctcgtgcacatcaagattctggctgcggaccttctgtcccttaccgtgcagcagacttcgccgccttcctttcttcgccgtggccgtacggttgctcgtgcagagcttgtcggaattgtggtgtctcgtgaccgtagggaaaagttcctccgcttcttgatcgatgatggcactggctgtataccgtgcatcctatggttgaaccaccaatatctaaatgcaaacacttcctccgggccatcagattctgatcctaccgcagagatggcattgaatatgtcggaggaagtgcatctaggcactcttgtgagggtccgaggaaagattgtcatgtatcgtggtgtgatccagatttctgttagagatgtggttctggagaaggaccccaatgcggaggtgttacattggttacaatgtgtttacttggccaaggaatgctatgatctgccacctgctcaaggtgccacttgaatggaatctatgaagtgtaaatctctgtacttgctggagagcaaatctcttcttacatgaccaagttgtgcataataatccttattaatgaaatacattggtgatgggagattt

SEQ ID NO: 40742 - protein, 162 aa, Panicum virgatum
  misc_feature: Ceres CLONE 2004469
  misc_feature (40)..(132): Pfam Name: tRNA_anti Pfam Description: OB-fold nucleic acid binding domain
MDPPLHLVHIKILAADLLSLTVQQTSPPSFLRRGRTVARAELVGIVVSRDRREKFLRFLIDDGTGCIPCILWLNHQYLNANTSSGPSDSDPTAEMALNMSEEVHLGTLVRVRGKIVMYRGVIQISVRDVVLEKDPNAEVLHWLQCVYLAKECYDLPPAQGAT

SEQ ID NO: 40743 - DNA, 708 bp, Panicum virgatum
  misc_feature: Ceres CLONE 2004477
  misc_feature: Encodes the peptide sequence at SEQ ID NO. 40744
aaggtagctcattaatttcgattcccttcgttccctgggtacatagatagatagatctgaacacatcaaacaattttccgccgctcgctttcagccgaaaacaaccatggctgctgctgtcaagcagaagcaggccgcctccgtggcgctagtcttcctcctcgccgtgttggtcgcgccgcctccggccgccgtggtagcggcggacggcgacggcacgacgcacctgagcttcttcatgcacgacatcgtgtcgggcagcgacccgactagggtgcaggtgatcaagggccccgggtcggcagtgacggccccggcgctgggcatgtccttcggcgacacggccgtgatggacgacgcgctgacggagacctcgtcgccgggctcggcggcgctggggcggatgcagggcatctacatgctgtcgtcgcagtcgggcgcggcgttgatggtgtgcgccaacctggtgctgacctcgggcgaccacaacggcagcaccatcgccgtgctggggcgcgacgacacggccgccgacgtgcgggagctcgccgtcgtgggcggcaccggcaagtacaggatggccaacgggtacgtgctgtggaagacgaccagcatgaagggcgccgacgccaccacccagctcgacgtctacctcaccaccggcaacgccaccagcatcgacgctggcggcggcggcggggtctctgg

SEQ ID NO: 40744 - protein, 200 aa, Panicum virgatum
  misc_feature: Ceres CLONE 2004477
  misc_feature (13)..(185): Pfam Name: Dirigent Pfam Description: Dirigent-like protein
MAAAVKQKQAASVALVFLLAVLVAPPPAAVVAADGDGTTHLSFFMHDIVSGSDPTRVQVIKGPGSAVTAPALGMSFGDTAVMDDALTETSSPGSAALGRMQGIYMLSSQSGAALMVCANLVLTSGDHNGSTIAVLGRDDTAADVRELAVVGGTGKYRMANGYVLWKTTSMKGADATTQLDVYLTTGNATSIDAGGGGGVS

SEQ ID NO: 40745 - DNA, 740 bp, Panicum virgatum
  misc_feature: Ceres CLONE 2004485
  misc_feature: Encodes the peptide sequence at SEQ ID NO. 40746
acgcgattcgcagggtcctttattgcaatccccgtcccgtgaacccgtcgcgtctcggcttcctcctcaccgccccgccgtgcacgagcgcagctcgccgtcgcctccctcgccgagaggcccggggcctgatccccacgccgagagcagtggtggtgcgaggaggttagcgatggcgaggtggcgcccggcggagctgctgctggtggtgctggcggcggtcctggcggcggcgcggcgggcggacgcgctgtcggtgacggtgacggacaccgagtgcatccacgagttcgtgccctacgagggcgacaccgtgtccgggaacttcgtcgtcgtcgaccacgacatcttctggagctccgaccaccccggcatcgacctcacggtaacttcaccaggtggcaacactgtacatacgttgaaggggaaatctggtgataaatttgagtttaaagctccaaggggtggcatgtacaagttttgcttccataacccatatggagcacctgaaactgtttctttctacattcatgttgggcacatacccaatgaacacaatctggcaaaagatgagcacttggaccctattaacgttaaaattgcggagctgaaggaagcattggaatccgtaactgctgagcagaagtacctaaaggcacgtgaagctcgtcaccgacacacaaacgagagcacgcgaaagcgtgtgatgttctacacaatggcggagtacctagcttttc

SEQ ID NO: 40746 - protein, 189 aa, Panicum virgatum
  misc_feature: Ceres CLONE 2004485
  misc_feature (55)..(121): Pfam Name: EMP24_GP25L Pfam Description: emp24/gp25L/p24 family/GOLD
MARWRPAELLLVVLAAVLAAARRADALSVTVTDTECIHEFVPYEGDTVSGNFVVVDHDIFWSSDHPGIDLTVTSPGGNTVHTLKGKSGDKFEFKAPRGGMYKFCFHNPYGAPETVSFYIHVGHIPNEHNLAKDEHLDPINVKIAELKEALESVTAEQKYLKAREARHRHTNESTRKRVMFYTMAEYLAF

SEQ ID NO: 40747 - DNA, 680 bp, Panicum virgatum
  misc_feature: Ceres CLONE 2004490
  misc_feature: Encodes the peptide sequence at SEQ ID NO. 40748
acaagagcgagggggttgcaaccttccaggaaaccattcctctccctttccctgcaccggttaggcgccgatcgagccatgtcacctgcaatttcagcatcgccacacggcgagaacttcacggagatggtggcggtgcgccacggagagacggagtggaacgtctcccacaccattcagggacgattggatcacgagctcaacgaaactggaagacagcaagctgccatggttgcccgtcggctgtccgagtccgaggaagccaagccagctgcagtctactcctctgatttgaagcgtgctgccgagactgcacaaatgatagcagcaacttcctctgtatctaacgtggtgattgatcaggcactgacagaaaggcacatgggatcgttccaaggaatgaagcgtgaagatgtcctcaaatcagaagcttacaaggcttactcatccaaagatgaaagaaaagaagaactacctggtggtggggagagtcttaatcagctttccgagcgctgtgtttcccgcttgaacgcgatagctgagaagcacaagggtgagcgggtggtcgtggtcacccatgaagaagtcatacaggaactctgcaggcacgccaatccgacgacctcggttcgcaggaacatccccaacacctcgatcagcattttccatgtctcggggtc

SEQ ID NO: 40748 - protein, 200 aa, Panicum virgatum
  misc_feature: Ceres CLONE 2004490
  misc_feature (16)..(174): Pfam Name: PGAM Pfam Description: Phosphoglycerate mutase family
  misc_feature: SWISSPROT Homolog: EC 5.4.2.1 Phosphoglycerate mutase
MSPAISASPHGENFTEMVAVRHGETEWNVSHTIQGRLDHELNETGRQQAAMVARRLSESEEAKPAAVYSSDLKRAAETAQMIAATSSVSNVVIDQALTERHMGSFQGMKREDVLKSEAYKAYSSKDERKEELPGGGESLNQLSERCVSRLNAIAEKHKGERVVVVTHEEVIQELCRHANPTTSVRRNIPNTSISIFHVSG

SEQ ID NO: 40749 - DNA, 877 bp, Panicum virgatum
  misc_feature: Ceres CLONE 2004511
  misc_feature: Encodes the peptide sequence at SEQ ID NO. 40750
aacaaacgctaaaaaagtaacagtttctgtactttattgatcccacatggctgacgcgcctgctgctgctgcccccgcccccaccgaggcgcgcggccgcggattcggccgtggcggccgtggcggccgcggtggccgtggtggccgcggcggtgccgagtccaaggaatgggtgccgtgcaccaagctaggccgcctcgtgaaggacaagaagatcagctcgctggaggagatctacctgtactccatcccgatcaaggagcaccaggtcgtcgacgctttcctcggcgagggcacgctcaaggatgaggtgatgaagatcttccccgtccagaaggtgacgtccgccggccagcgcacccgcttcaaggcgtacaccgttgtcggtgactcgaacggtcacgtcggcgttggcagccgcgtcggtaaggaggtcgcgatctgcatccgctcgtcgctgatcgccgccaagctgaacctcatcccggtccgccgtggctactggggtaacaagctcggccagccgcacaccgtgccgatgaaggtgaccggcaagtccggctccgtctgggtgcgcctcgtcccggcgccgcgtggcacgggcatcgtcgccgccccggtcccgacgaagatcctccagttcgccggcatcgaggacgtgtacaccgcgtcgatgggctcgacccgcacgacgtccaacttcatcatggcgacgttctacgcgctgcgcaagacgtacgcgttcttgacgccggacctgtggcccgccaccgccgcgcagaaggaccccacggacgagcactcggagttcctctcgtcccacaaggccgtgaccgcgtaaaatcatgagggatttctctccacctctcgcagattg

SEQ ID NO: 40750 - protein, 264 aa, Panicum virgatum
  misc_feature: Ceres CLONE 2004511
  misc_feature (167)..(240): Pfam Name: Ribosomal_S5_C Pfam Description: Ribosomal protein S5, C-terminal domain
  misc_feature (84)..(150): Pfam Name: Ribosomal_S5 Pfam Description: Ribosomal protein S5, N-terminal domain
MADAPAAAAPAPTEARGRGFGRGGRGGRGGRGGRGGAESKEWVPCTKLGRLVKDKKISSLEEIYLYSIPIKEHQVVDAFLGEGTLKDEVMKIFPVQKVTSAGQRTRFKAYTVVGDSNGHVGVGSRVGKEVAICIRSSLIAAKLNLIPVRRGYWGNKLGQPHTVPMKVTGKSGSVWVRLVPAPRGTGIVAAPVPTKILQFAGIEDVYTASMGSTRTTSNFIMATFYALRKTYAFLTPDLWPATAAQKDPTDEHSEFLSSHKAVTA

SEQ ID NO: 40751 - DNA, 673 bp, Panicum virgatum
  misc_feature: Ceres CLONE 2004512
  misc_feature: Encodes the peptide sequence at SEQ ID NO. 40752
ccatcgccgatcgctcgacccccaccatcatcctatcagcaacccacacctcgcacaccggcgcaccaaccatccatcccccgccgtcctcaccgtcgccgcactccggcatccaccatccatccgtcaggtcacataagcgagaatggccgcccgcttcgccgccctcgtcgcagtcatcgccctcttcgctgcagccgcaacggcgcagggcccggccgcgtcgcccaagagagcgccgacccctgcaccgcccaagatggccccgctgccgccgccgccgaccaagtccccggcggcctccccgcctgcgccgcccatggcgaccccggtctccgcgccctcggccgccgtcccggccatgagcccgttgggcgctggcgccggcgacacgctgcccccggctggtgcctccgtcctgaccccggccgctgcgcccgccgccaccgagaagagccccgccgcatctgccaccgccgccaccagcttcgtcgccgttgccggtgctgtggtcgtagccctcgtgttctaggcgccgcggcctgatctggcagtgggcgctgacgcgatcctttcgctgtttatgcgcgttcgctgctctcctctgctcggctcggctgttgatacatgtactctgtttcttcgtttttggcgattctttatttattattga

SEQ ID NO: 40752 - protein, 128 aa, Panicum virgatum
  misc_feature: Ceres CLONE 2004512
  misc_feature: Useful for making plants with altered carbohydrate content
MAARFAALVAVIALFAAAATAQGPAASPKRAPTPAPPKMAPLPPPPTKSPAASPPAPPMATPVSAPSAAVPAMSPLGAGAGDTLPPAGASVLTPAAAPAATEKSPAASATAATSFVAVAGAVVVALVF

SEQ ID NO: 40753 - DNA, 421 bp, Panicum virgatum
  misc_feature: Ceres CLONE 2004520
  misc_feature: Encodes the peptide sequence at SEQ ID NO. 40754
cggcgaagcccgaggtgacggaggaggccaagatggacctgctcgaggacgacgacgagttcgaggagttcgagatcgaccaagagtgggaagacaaggaagaaggcaatgaagcacttcagcaatgggaggatgactgggatgacgatgacgtcaacgatgacttctcgctgcagttgaggaaggagctggagagcaatgcgcccaagaactagccggcgtatgcagccttgtattgagttggagtggtgtccaagaactagttggcgtatgcagccttgtatccattattatcaggtaggaactagtgacgatggttgggaaactgctactgttccgttctggcccttgttggcatggccactgatgtagtcgttccgtttgcttggatcatttaaccaccgagttacatgttacctat

SEQ ID NO: 40754 - protein, 70 aa, Panicum virgatum
  misc_feature: Ceres CLONE 2004520
  misc_feature (4)..(66): Pfam Name: DSS1_SEM1 Pfam Description: DSS1/SEM1 family
AKPEVTEEAKMDLLEDDDEFEEFEIDQEWEDKEEGNEALQQWEDDWDDDDVNDDFSLQLRKELESNAPKN

SEQ ID NO: 40755 - DNA, 786 bp, Panicum virgatum
  misc_feature: Ceres CLONE 2004521
  misc_feature: Encodes the peptide sequence at SEQ ID NO. 40756
ggaaccgttcggccttcacagccccgcacccccggcaagagtccccaacgcagcaggggcgaaccgaatcgaatcctccggaactcgccgccgcttctcctcgcatcgcagcccgggtgccccgctagcgtctccgccgccgggaccgaccgatccgatcgagcgaggatgtcgtacgcctacctcttcaagtacatcatcatcggcgacacaggcgtggggaagtcgtgcctgctgctgcagttcacggacaagcgcttccagcccgtgcacgacctcaccatcggcgtcgagttcggcgcccgcatgatcaccatcgacaacaagcccatcaagctccagatttgggacacggctggccaagaatcattcagatccattactagatcgtattacagaggggctgctggtgcccttttggtttatgatatcaccaggagggagaccttcaatcacctcgcaagctggctagaagatgcaagacagcatgcaaatgccaacatgacagttatgctgattggaaacaaatgtgatctgtctcataggcgtgctgtcagctacgaagaaggtgaacagtttgccaaggaacatggtctggtttttatggaggcgtctgcgaaaactgcacagaatgtcgaggaggcattcattaagacagctggaactatatacaagaaaatccaagatggcatatttgatgtatcaaacgagtccaatggaatcaaagttggctacgctgtccccaactcgtctggaggtgctgctggctcgtcctccgcaggcggg

SEQ ID NO: 40756 - protein, 205 aa, Panicum virgatum
  misc_feature: Ceres CLONE 2004521
  misc_feature (8)..(169): Pfam Name: Ras Pfam Description: Ras family
  misc_feature (8)..(122): Pfam Name: Miro Pfam Description: Miro-like protein
  misc_feature: SWISSPROT Homolog: EC 2.7.11.1 Non-specific serine/threonine protein kinase
  misc_feature: Useful for making plants with altered lignin content
  misc_feature: Useful for making plants with altered terpenoid content
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEGEQFAKEHGLVFMEASAKTAQNVEEAFIKTAGTIYKKIQDGIFDVSNESNGIKVGYAVPNSSGGAAGSSSAG

SEQ ID NO: 40757 - DNA, 647 bp, Panicum virgatum
  misc_feature: Ceres CLONE 2004530
  misc_feature: Encodes the peptide sequence at SEQ ID NO. 40758
atcatcgcatcggcactcctctcagcaaagccagccatcggaggaggagagcttttgggcttttagggggggtgggtggtgcgccatgggggaggtgaagcacctgtgcctggtgaggttcaaggagggcgtcgtggtggaggacgtcctcaaaggcatgaccgaccttgtcgcccagatggacatggtcaaatccttcgagtggggccaggacgtgctgaatcaggagatgctgacgcagggcttcacgcacgtcttctcgctcaccttcgcctccgccgacgacctcaccacctacatgggccacgacaagcacgccgcgttcgccgccacgttcatggccgcgctcgagaaggtggtcgtcatcgacttccccgtcgtcatcgccaagccaccgccatcggcatgatcgacctgccacagcatctgtcggccattgtacggtgccttttcaggtagcagatcatcgtctatttgcaacggtgatgtactgcgtgtctaagtacgtatgtactaagctccttattaccacttgttctgctatatgtcctgcactctaggacgtctattgtagctcagctgtaaggcaaagatatctacaccgtaccgtacgtgcagcactccgtgttcaaggccctattggttgg

SEQ ID NO: 40758 - protein, 107 aa, Panicum virgatum; identical to SEQ ID NO: 10007
  misc_feature: Ceres CLONE 2004530
  misc_feature (4)..(98): Pfam Name: Dabb Pfam Description: Stress responsive A/B Barrel Domain

SEQ ID NO: 40759 - DNA, 770 bp, Panicum virgatum
  misc_feature: Ceres CLONE 2004537
  misc_feature: Encodes the peptide sequence at SEQ ID NO. 40760
aaggcgagccaccaaccagataatccatggcgctctcgagcacggaggagaggaagacggcggcggagatcgtcgccgcgctggatctgcagcgccaccccgacggaggcttctacctggagacctttcgcgacccctccatctttctccccaccgccgcgcttccgccgcgctataaggtggaccgagctgtgagcagcgccatctatttcctactgcctgctggggagattgctcggttgcaccgcatcccttgtgctgaaacctggcactactacctaggagagcctctcacggtatttgaggtgcatgatgatggacaaatcaagataacagtggttggtcctgatctacgacaaggccagagaccacagtacacggttcctccaaacgtatggttcggggccttcttgacctgtgacattgagtcctttactgaagatggaagtgtctttgtcaaggctcctggaagagaccctgtggtgcattattcctttgttggcgtaacctgtgctccagcgttccagtttgaggacaatgaactggcaacgcgtgaggacatgaaagctttggctccaaaggctgaagctttcatcaattaccttgtaccatcttaaactgccttgtccgtgcaagcagcttgttcttcatgatgaacttcatgtaccaacttgctctagtagctactgaaattcactgtatgatatcaaaacgacttatgactcagcggaatcagttccgtctggattatggaagttgatgttgctgcc

SEQ ID NO: 40760 - protein, 196 aa, Panicum virgatum
  misc_feature: Ceres CLONE 2004537
  misc_feature (12)..(175): Pfam Name: Cupin_5 Pfam Description: Cupin superfamily (DUF985)
MALSSTEERKTAAEIVAALDLQRHPDGGFYLETFRDPSIFLPTAALPPRYKVDRAVSSAIYFLLPAGEIARLHRIPCAETWHYYLGEPLTVFEVHDDGQIKITVVGPDLRQGQRPQYTVPPNVWFGAFLTCDIESFTEDGSVFVKAPGRDPVVHYSFVGVTCAPAFQFEDNELATREDMKALAPKAEAFINYLVPS

SEQ ID NO: 40761 - DNA, 727 bp, Panicum virgatum
  misc_feature: Ceres CLONE 2004543
  misc_feature: Encodes the peptide sequence at SEQ ID NO. 40762
agcacaagaagatacggagaagaactccgactccggcggcgtgccggccggagctgcctttaagcaaagcgagccctctccccttccccagccgcgcttcgcaaattcgcatcagttcatctgggatcagacccgagagcgaagcaagagacgagcgaatctcgtagcggaggcgatggccaggttcgacccgtacgagaacaacggcggcacctgcgtggccgtcgccggcgccgactactgcgtggtcgccgccgacacccgcctctccgtcggatacagcatcttgtcccgcgaccactccaaggtcgcccaactggcagacaaatgtgttttggcctcatttggcttccaaggtgatatcaaagctttgcagaagaatctggcagccaaggaattggtttatgagcacaatcataacaagaagatgagctgccctgcaatggcgcaactgctgtcgaacacactctactacaagagattcttcccatactacgcattcaatgtattgggtggactggacagccaaggtaaaggatgtgtctttacatacgatgctgttgggtcttatgagaggacaggttatagtgctcagggaacgggtgcagcattgatgatgcctgttcttgacaatcagttgaaatcccctagtcctctactactgccagctagggatgcagtgacgcccttatctcaatctgaggtttgatctggtgaaggacgtttt

SEQ ID NO: 40762 - protein, 177 aa, Panicum virgatum
  misc_feature: Ceres CLONE 2004543
  misc_feature (8)..(177): Pfam Name: Proteasome Pfam Description: Proteasome A-type and B-type
  misc_feature: SWISSPROT Homolog: EC 3.4.25.1 Proteasome endopeptidase complex
MARFDPYENNGGTCVAVAGADYCVVAADTRLSVGYSILSRDHSKVAQLADKCVLASFGFQGDIKALQKNLAAKELVYEHNHNKKMSCPAMAQLLSNTLYYKRFFPYYAFNVLGGLDSQGKGCVFTYDAVGSYERTGYSAQGTGAALMMPVLDNQLKSPSPLLLPARDAVTPLSQSEV

SEQ ID NO: 40763 - DNA, 666 bp, Panicum virgatum
  misc_feature: Ceres CLONE 2004545
  misc_feature: Encodes the peptide sequence at SEQ ID NO. 40764
cgacgtcgcgagaagtcctttgaaccttatcatttagaggaaggagaagtcgtaacaaggtttccgtaggtgaacctgcggaaggatcattgaagtgcttctttcaaaaacccctcgcttccccgcgtgctcgccccgagatctcgcccggccgccatggacgcgatcgactcggtggtggatcccctccgcgacttcgccaaggacagcgtccgcctcgtcaagcgctgccacaagcccgaccgcaaggagttcaccaaggtcgcggcgcggacggcgatcgggttcgtcgtcatgggcttcgtcggcttcttcgtcaagctcatcttcatccccatcaacaacatcatcgtcggttccggctagacctcgagtcctggagaagtgcagaacgagtgactagcatgggtggattgcaatacttttgaggagagcaaaggctaacgatgatcttggtctttcacaaagtattgtaaaagacagtttctcatttgtgtttttggagtaatcctcatactgtttaagacttcaggatgcctgcataccagattctgagttgatcgatcggttatagaagggtacggtggactgctttctttttagataggctgaaagtaagaattcaggttggttcaatgtatcagttcgtggtaaatataaaaaact

SEQ ID NO: 40764 - protein, 69 aa, Panicum virgatum; identical to SEQ ID NO: 12598
  misc_feature: Ceres CLONE 2004545
  misc_feature (10)..(66): Pfam Name: SecE Pfam Description: SecE/Sec61-gamma subunits of protein translocation complex

SEQ ID NO: 40765 - DNA, 1547 bp, Panicum virgatum
  misc_feature: Ceres CLONE 2004552
  misc_feature: Encodes the peptide sequence at SEQ ID NO. 40766
ctctccctccctctcttggatgatctagtataaatcaggcggcgcaagcaagcaggccagcagcaagcaagccactctacttgtagctagctagctagctaagaagagaaggaagaagaagattgctcctctatctaatgagcatgagcatgagcatgagcatgatgagatgccggtgccagcagcagcaggcgacgactgtcgtcctgctcctcctggccgtgagcgtcagcgcgagcgcgaggcctctaactctgacgactctgggtagtgctagtgccaacgcccacgccaacgccaccaacggcctgtccgtctacttccacctcgactcctgcccgcagctggagaccatcgtccgctcccacgtcgacgccgctctccgccagaacgtccgcctcaccgccggcctcctccgcgtcttcttccacgactgcttcccgcagggctgcgacgcctccatcctcctcgacaacggcgagcgcaacctcccgcccaacgtcggcctccagcaggaggtgctgcagctcatcgaggacgcccgggccaaggtgcacgcccagtgcggcgccaccgtctcctgcgccgacatcaccgtcctcgccacgcgcgacgccgtcaacctcgccggcggccccgccttcacggtgcccctcggccgcctcgacagcctggcgcccgcctccgacaacgacgtcttcaagctcccgccgcccaccgccaccgtcgacgacctcctcaccgccttcaccaacgccggcctctccgacccggccgacctcgtctcgctctccggcgcccacaccgtcggcaaggcgcgctgcagctccttcggcgccgtgtccgggcccgccgccgacgacgtcaccaggtgcatcacggagacctgctcggcggccggcagcgccgaccggctgcgcgacctcgactttctgacgcccaccgtgttcgacaacctctacttcgtcgagctgacgctcaagaagaaccagggggtgatgctgccgtcggaccaggcgctggtcaccgactcgcgcaccagctggctcgtccagggcttcgccgacaaccactggtggttcttcgaccagttcaagacctccatggtgaagatgagccagctcaaggggccccaggggaacgtcggcgaggtccgccgcaactgcttcaggcgcaacgccgccgccggcgacgagggcctcatgctgaccgcatctgcctgatccgatgcctgctacttgtactgtttcttgtgtgttttatttatgcatccacgtataacgacgaccacgacgacgacgaccacgacgacagtagtacttactccataagacagatgatcgaataaggagtactcctaattcataattaagatttgggtggccgtgcaccacgtggtggtagatctcgactacctcgtagcttgctagctagtcgatcgatcaccatgatatgatatgcatgcatgtcggcatcgatcaacatcatctctcattttaattatatcttgaaataataattaatatcgatcggtcaccataccttgc

SEQ ID NO: 40766 - protein, 361 aa, Panicum virgatum
  misc_feature: Ceres CLONE 2004552
  misc_feature (74)..(311): Pfam Name: peroxidase Pfam Description: Peroxidase
  misc_feature: SWISSPROT Homolog: EC 1.11.1.7 Peroxidase
MSMSMSMSMMRCRCQQQQATTVVLLLLAVSVSASARPLTLTTLGSASANAHANATNGLSVYFHLDSCPQLETIVRSHVDAALRQNVRLTAGLLRVFFHDCFPQGCDASILLDNGERNLPPNVGLQQEVLQLIEDARAKVHAQCGATVSCADITVLATRDAVNLAGGPAFTVPLGRLDSLAPASDNDVFKLPPPTATVDDLLTAFTNAGLSDPADLVSLSGAHTVGKARCSSFGAVSGPAADDVTRCITETCSAAGSADRLRDLDFLTPTVFDNLYFVELTLKKNQGVMLPSDQALVTDSRTSWLVQGFADNHWWFFDQFKTSMVKMSQLKGPQGNVGEVRRNCFRRNAAAGDEGLMLTASA

SEQ ID NO: 40767 - DNA, 575 bp, Panicum virgatum
  misc_feature: Ceres CLONE 2004557
  misc_feature: Encodes the peptide sequence at SEQ ID NO. 40768
ctcccagccgtcatcatcttcccgtccgccgcagcctgccgccaggaggggtaagtccagcgagggagttttgagaagcgcaaaatggctcctaaagctgctccagccaaaaaagatgcctagacccacgccttgaaagttgccaacgctgtgaactctggcgcagtgaagaagaacaccaagaagatcaggacgtctgtgacatttcgccgccccaagaccctgaagaaagctcgggaccccaaatacccgagagtccgcgctcctggaatgaaccagcttgatcagtaccatatcctgaagtatccccttaccacggaatcaacaatgaataagatcgaatataacgacactctggtcttcatcgtggacctcaatgcagacaataagaagatcatggctgctgtcaagaatatgtatgacatccaggcaaagaaggtcattaccctgatcatgcctgatggtaacaagaatgcatatgtgaagctgacaccggactacgatgctcttgatgtggccaacgagatctgcatcatctaaggctactttgttaggcatctgtgtcctatctctat

SEQ ID NO: 40768 - protein, 89 aa, Panicum virgatum
  misc_feature: Ceres CLONE 2004557
  misc_feature (7)..(86): Pfam Name: Ribosomal_L23 Pfam Description: Ribosomal protein L23
MNQLDQYHILKYPLTTESTMNKIEYNDTLVFIVDLNADNKKIMAAVKNMYDIQAKKVITLIMPDGNKNAYVKLTPDYDALDVANEICII

SEQ ID NO: 40769 - DNA, 659 bp, Panicum virgatum
  misc_feature: Ceres CLONE 2004565
  misc_feature: Encodes the peptide sequence at SEQ ID NO. 40770
agaagccgccgactctattaccatcacggcaccagacagcgcggcccagaggctcccctcgcgaaaaatggcggcggcggcggaagggctagctgcctaccgggcggtgctgcgggcggcgcggcggactttcgcgggcgacaagctgatgctgcaggagtcggcggtggagatccggcgccgcttcgaggaccaccgcgtcctcggcccgggctccgacgaggcggcgcgcgccctcgccgacgcccgcgaggccgcgcacttcatcacccacatgatagttcacgccacgcgcgcgccctccgggtccttcgttgtgaagcctgagagcgtacatgctggagctacactggaggttccttccgaggaaatcctgtcaaagttgaaataggggaacgcactagactgtacaagcattattgcagaaactcgcccatcttcaggcttctagggataataaaaacagttttgcatcggctgcttatagattgtttgttgtattactgttggactgaatagcttcacaccttttcctttagcatttctgtcgagagcatcacaccgcgctaaggtatggtgctgatgatgtacgctagtcatctgaacttgaaagcgagtaaacaaccgctgagattttgaaattttactgtctggtggcg

SEQ ID NO: 40770 - protein, 107 aa, Panicum virgatum
  misc_feature: Ceres CLONE 2004565
  misc_feature (2)..(69): Pfam Name: Complex1_LYR Pfam Description: Complex 1 protein (LYR family)
MAAAAEGLAAYRAVLRAARRTFAGDKLMLQESAVEIRRRFEDHRVLGPGSDEAARALADAREAAHFITHMIVHATRAPSGSFVVKPESVHAGATLEVPSEEILSKLK

SEQ ID NO: 40771 - DNA, 657 bp, Panicum virgatum
  misc_feature: Ceres CLONE 2004573
  misc_feature: Encodes the peptide sequence at SEQ ID NO. 40772
ccgcggaacctggccacccctgctactgccccgaggccccgccgcccgcggaaccggcttatttcttcgacaaaagccgcgccgcccgccgccgccggagatccccagcataaaagaagatgccttcacttcaaaaagcgttgcctccagaacttgctgataatgtactcagattatatcgcgaatgcttaaggggggctaagtatattgggcatcagaaacacaatacagagcttttagttaccatggtgaggcaacagttcaagaaaaacatgcatgaaactgatccagagaagatacagaaaatgaaggacgatgctgcaaggggccttatcaatcatattctgtatgagtctgagaagataactgggcgcaaattttcaggataagaaagaaagttgagacaagacttacaacatgctctatggataataataaataaactagttgtgtgtctgttgaattatttcacctcgccagtacaatgaatttttgggtgcatgagttattccagcaatgaatttttactagccattagtttgacgatttctgtttgattctttttgcatcataaatgatgtgttcaagttgtttcagataaatctactggccaggagatgaaaatattcggtaattgagaatgctccaatcttttct

SEQ ID NO: 40772 - protein, 89 aa, Panicum virgatum
  misc_feature: Ceres CLONE 2004573
  misc_feature (11)..(77): Pfam Name: Complex1_LYR Pfam Description: Complex 1 protein (LYR family)
MPSLQKALPPELADNVLRLYRECLRGAKYIGHQKHNTELLVTMVRQQFKKNMHETDPEKIQKMKDDAARGLINHILYESEKITGRKFSG

SEQ ID NO: 40773 - DNA, 668 bp, Panicum virgatum
  misc_feature: Ceres CLONE 2004595
  misc_feature: Encodes the peptide sequence at SEQ ID NO. 40774
aaactacggcttgggatctcggctcggcttcgcatcttccttccgcaaaaccgaagctcgcggcgtgcgtcccttctcctcgacatccatatcctcgcctccactggcccggcgtggagtggagagtggggatccatttggacttggattgatttccccttccgctgccagcatgccgaagataaagacaagccgtgtttcgtatccggaaggatgggagcttattgaaccaacaatccgtgagttggatgccaaaatgagagaagctgaaaatgatccacatgatgggaagaggaagtgtgaagctctctggccaatcttccgtatttctcatcaaaggagccgctacatatatgatctttactacagaaggaaggagatatcacagaagctttatgagttttgcctggaccagggttatgcagaccgtaatctgatagcgaagtggaaaaagccgggttatgagcgcctttgctgccttcggtgcatacagacacgtgaccacaattttgcaacaacttgtgtctgccgagtccccaagcacctcagggaggagcaagtgatcgaatgtgttcattgcgggtgcaggggctgtgccagcggtgactaatcttttcattatgcttttgggctcatgactcatcatctgggactaacacttgaaatct

SEQ ID NO: 40774 - protein, 145 aa, Panicum virgatum; identical to SEQ ID NO: 15514
  misc_feature: Ceres CLONE 2004595
  misc_feature (1)..(143): Pfam Name: G10 Pfam Description: G10 protein

SEQ ID NO: 40775 - DNA, 452 bp, Panicum virgatum
  misc_feature: Ceres CLONE 2004600
  misc_feature: Encodes the peptide sequence at SEQ ID NO. 40776
atctcatcgatcgagccagccatccatccatccatccgtccagccgcctctcctcgcctgctgcgcgcgtctctctgctctcctagggagatctcgcgcagcccggaaacccgtcgacccagctcgtcctcgtcgcagatggccggcctcaggatgaagttcgtcgccgccgccgccgtggccgccgcgctcgtggcgtcggccgccgccgccaccgaggcccccgccccagcgcccgcctccggcgccgccgccgcggtgcccctcgcggcggcgtccctcgccgccgccgccttcggctacctcttctgctatatccgtcggccgttctccgcgggtggccctgctgatgatctgatgattcgttttggcgtgagtcgagtccgtgtccgtggcgtgtggggatgatgtcagtgggcgtgtgtatgtacgattgctgcggaggtgggggt

SEQ ID NO: 40776 - protein, 89 aa, Panicum virgatum
  misc_feature: Ceres CLONE 2004600
  misc_feature: Useful for making plants with altered carbohydrate content
MAGLRMKFVAAAAVAAALVASAAAATEAPAPAPASGAAAAVPLAAASLAAAAFGYLFCYIRRPFSAGGPADDLMIRFGVSRVRVRGVWG

SEQ ID NO: 40777 - DNA, 469 bp, Panicum virgatum
  misc_feature: Ceres CLONE 2004601
  misc_feature: Encodes the peptide sequence at SEQ ID NO. 40778
attcccatcgcagatctccaccgacgcaacacagagatgaagagcggatctcgcggcaacccgaaccgacgcatggcgacgctcacggtccccgcctccgtcccgcccgtcgccgaggactgcgagcacctccacaaggcattggaaggtgggggcgacaacgagaagctcatcgtctccctcctggaccaccgcgacgccgcgcgccgccgcgcgatccgccgcgcatacgccgagaagtgcggtgaggagctgctccgcgccctcgacgacgagatcctcggagagtgcgagagggcggtgatcctgtggacgctggaccccggggatagggatgcggtactggcaagacacgaggctaataagtggcgccccggtggacgcgcgctggtggagatcgcgtgcgcacgcacgcgagcgcagctcttcgcggctaggcgagcgtaccaacaccgcttcaagcgctcat

SEQ ID NO: 40778 - protein, 132 aa, Panicum virgatum
  misc_feature: Ceres CLONE 2004601
  misc_feature (15)..(80): Pfam Name: Annexin Pfam Description: Annexin
MATLTVPASVPPVAEDCEHLHKALEGGGDNEKLIVSLLDHRDAARRRAIRRAYAEKCGEELLRALDDEILGECERAVILWTLDPGDRDAVLARHEANKWRPGGRALVEIACARTRAQLFAARRAYQHRFKRS

SEQ ID NO: 40779 - DNA, 724 bp, Panicum virgatum
  misc_feature: Ceres CLONE 2004608
  misc_feature: Encodes the peptide sequence at SEQ ID NO. 40780
atcgcgcgagtctgcactagggtttttgccgccgccgccgccgccgccgctctgccccccgcatcccctcccacccaccgagacgccaagatgacggcgcagaccgccgaggagctcgccgaccagatcaccgccgaggagctcgccgcccagatcgagcagcagaagctcgaggagcagaagactgaggcagaggaggttgtggttgaggatgaggaggatgacgatgaggatgatgacgatgatgacaaggatgatgatgagggacaagaaggcgatgccagtggcaaatcaaagcaaagcaggagtgagaagaagagccgcaaggccatgctgaaacttggcatgaagccgatcactggtgtcagccgtgtcactgtgaagaaaagcaagaatatactgtttgtcatctccaagccagatgtgttcaagagcccaaactcagacacctatgtcatctttggtgaggccaagatcgaggacctcagctcccagctgcagacccaggctgcggaacagttcaaggctcctgacttgagccagatgatctccaagcctgagacatctggcctaggccaggaggacaatgaggaggaggttgatgagactggtgtcgagccaaaggacattgagctggtgatgacgcaggcatccgtatcgaggcccaaggctgtcagggccctcaaggctgccgatggggacattgtctctgccattatggagc

SEQ ID NO: 40780 - protein, 211 aa, Panicum virgatum
  misc_feature: Ceres CLONE 2004608
  misc_feature (72)..(131): Pfam Name: NAC Pfam Description: NAC domain
MTAQTAEELADQITAEELAAQIEQQKLEEQKTEAEEVVVEDEEDDDEDDDDDDKDDDEGQEGDASGKSKQSRSEKKSRKAMLKLGMKPITGVSRVTVKKSKNILFVISKPDVFKSPNSDTYVIFGEAKIEDLSSQLQTQAAEQFKAPDLSQMISKPETSGLGQEDNEEEVDETGVEPKDIELVMTQASVSRPKAVRALKAADGDIVSAIME

SEQ ID NO: 40781 - DNA, 697 bp, Panicum virgatum
  misc_feature: Ceres CLONE 2004609
  misc_feature: Encodes the peptide sequence at SEQ ID NO. 40782
atccaaccatcctcgtcctcgatcgcaagaagagagaactctctttgatcttcttcttcttgcaacgtactagctagctaggttactgcacacttgcatcgatcggcactgctttttccatggcggcttccatgagtggtcgcctcgtcctgctcgcctgcctcgccgtcgcccgggagaccaggatggccgcgtcgctggtcaggctgcatttccatgactgcttcgtcaagggttgcgacgcttcagtgcttctggacaacagcaccggcatcgtgagcgagaaagggtccaaccccaacaagaactccctccgggggttcgaggtggtcgacgagatcaaggccgccctggaggccgcctgccccggcaccgtctcctgcgccgacatcctcgccctcgccgcccgcgactccaccgtcctcgccggcgggccgtcctgggacgtgccgctgggacggcgggactcgctgggcgccagcatccagggctccaacaacgacatcccggcgcccaacaacacgctccccaccatcgtcaccaagttcaggcgccagggcctcgacgtcgccgacgtcgtcgcgctctccggcgcccacaccatcggtctctcccgctgcaccagcttccgccagaggctgtacaaccagacgggcaacggcgcggcggacgccacgctggacgtgtccttcgcggc

SEQ ID NO: 40782 - protein, 192 aa, Panicum virgatum
  misc_feature: Ceres CLONE 2004609
  misc_feature (11)..(190): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated nitrogen use efficiency
  misc_feature: Useful for making plants with modulated phosphate use efficiency
MAASMSGRLVLLACLAVARETRMAASLVRLHFHDCFVKGCDASVLLDNSTGIVSEKGSNPNKNSLRGFEVVDEIKAALEAACPGTVSCADILALAARDSTVLAGGPSWDVPLGRRDSLGASIQGSNNDIPAPNNTLPTIVTKFRRQGLDVADVVALSGAHTIGLSRCTSFRQRLYNQTGNGAADATLDVSFA

SEQ ID NO: 40783 - DNA, 616 bp, Panicum virgatum
  misc_feature: Ceres CLONE 2004630
  misc_feature: Encodes the peptide sequence at SEQ ID NO. 40784
cactgcccagccatggcgtcgccgggcgaccacgccgcggccgccaagcacctcagggtgctgctgccgttcacctgcgacagtctgcggatccccgacgaggtcgctgaggagatcggcgccggggaggccctcgtcgccggcccgctaggcggcaagggcaaggccttgtggcgcgtcgaggtcgggcgcgacggcgacggcgccttcctgggccgcggctggcccgagctcgccgacgcgtgcggcgtcggcgcagggtggctcctcgtcctctgccaccgcggccgcggcgtgctcacgtgcaaggccttcgacgacacccactgcctcagggacctcggcgctcccgctccgcctccagctgaagcagctgtgagtggcaaagccaccgctcgtaagccacagttcatcattgtgcttccaactgatttcatggaaaagatgctaatacctgctaagtttgtgcaacagcacatccccaaagagcactggaacaatcgtatggccattgttttgggcccccatggcaaagttcatgacattaagcttgagacggatcgatcggacatgttcttctcaggtggatggtcacagtttatggtgtttcatgaac

SEQ ID NO: 40784 - protein, 201 aa, Panicum virgatum
  misc_feature: Ceres CLONE 2004630
  misc_feature (15)..(106): Pfam Name: B3 Pfam Description: B3 DNA binding domain
MASPGDHAAAAKHLRVLLPFTCDSLRIPDEVAEEIGAGEALVAGPLGGKGKALWRVEVGRDGDGAFLGRGWPELADACGVGAGWLLVLCHRGRGVLTCKAFDDTHCLRDLGAPAPPPAEAAVSGKATARKPQFIIVLPTDFMEKMLIPAKFVQQHIPKEHWNNRMAIVLGPHGKVHDIKLETDRSDMFFSGGWSQFMVFHE

SEQ ID NO: 40785 - DNA, 704 bp, Panicum virgatum
  misc_feature: Ceres CLONE 2004648
  misc_feature: Encodes the peptide sequence at SEQ ID NO. 40786
acccagcccccgagaaccctagagccctcctcaacctcccctgcggcggccgccttctcctcctcccggaacctccctcacctcgcgaaaatgagccaggaggcggtgaacccgaaggcgtacccgctggcggacgcgcagctgactgttacgatcctcgaactcatccagcaggcagccaactacaagcaactcaagaagggcgctaacgaagcgacgaagaccctgaacaggggaatatctgagttcgtggtgatggcggcggacacggagccgctcgagatcctcctccacctccccctgctcgctgaggataagaatgtgccatatgtatttgttccttccaagcaagctcttggtcgtgcttgtggtgtgacaaggccagtcattgcttgctcagtgaccagcaatgagggtagccagctgaaaaactcgatccagagtctcaaggatgctatcgagaagcttctcatatgatttatcaaagacctttcagtgtgatgggcctcagagtgacacatttttcagaggcttggactggtcatggtgtcttgtttcctagatttgcattttctgaactatgtttgagtacccataagtcattatacttgcattgtgctgtattatctgttcttaactgtcatgtaattctcaagacatctatattatggtggttaatttctcaggaagttgaccgcagttgt

SEQ ID NO: 40786 - protein, 128 aa, Panicum virgatum; identical to SEQ ID NO: 40178
  misc_feature: Ceres CLONE 2004648
  misc_feature (20)..(114): Pfam Name: Ribosomal_L7Ae Pfam Description: Ribosomal protein L7Ae/L30e/S12e/Gadd45 family

SEQ ID NO: 40787 - DNA, 615 bp, Panicum virgatum
  misc_feature: Ceres CLONE 2004649
  misc_feature: Encodes the peptide sequence at SEQ ID NO. 40788
atctccccattctcgccgccccgctccgtgctcgccgttctcccctcgctccgttggattcctctgctcgccgaagctccgagttcgccacccccccccccaccccccccatggcggatgaggaggtatctgatccaaaggcgctcctagaggaacgctcaaaggctaagtgtgtgtcacagtggtacgaatatcagaaatgtgtcaagagaattgaaaatgacgagactgggcataagcactgtactggccagtactttgattactggaaatgtgttgacaagaatgttgctgagaaactctttgatctgctaaaatgacaaggaaaatgtcctctttcagttttctactcaaaattggtaataattgtatcgcctgtgcgccatatagactattcaggtgcttaatatttgtcggagaagttttgcctcttgggtaacacaacaaattttccactgccagtttacgtttcatttctgtcagtagtattgaactttacagcaggtttcctcctgcataaagcattgttggataaagagattcaatgggttattccaagaatgtggctgagcatgaaatgctcttatttacgtttaaaaaaaaaaaaaaaaaaag

SEQ ID NO: 40788 - protein, 69 aa, Panicum virgatum; identical to SEQ ID NO: 14672
  misc_feature: Ceres CLONE 2004649
  misc_feature (7)..(69): Pfam Name: UCR_hinge Pfam Description: Ubiquinol-cytochrome C reductase hinge protein

SEQ ID NO: 40789 - DNA, 672 bp, Panicum virgatum
  misc_feature: Ceres CLONE 2004667
  misc_feature: Encodes the peptide sequence at SEQ ID NO. 40790
ctaccgatagcacactacgctactctacgctctcgccagctagtcgatcttacactgcgttccgcttccgcaacagctccttcggcaacaacggcggcggctacacggtgttcgcgcccaccgacaacgccttcaacaacctcaagcccggcacgctcaactccctcacccagcagcagcaggtgtcgctggtgcagggccacatcctgcccagtttctacagcatggactccttccagaccgccagcaaccccgtccgcacccaggcctccggccgggacgggccctacacgctcaacatcacctccgacaccaacaaccaggtcaacgtctcctccggcgtcgtcgaggtccgcatcaacaacgcgctctactccgccaagccgctcgccgtctactccgtcgacaaggtgctcctgcccatggagctcttcggggccaaggcccccgccgccgcgcccactgcgtccgagggcaagcccaagaagggcggctcctccgacgcctcgtcaccggccggctccgaggattccgacacgggcgccgccagcgccagggccgtcggctggagcgtcgctggcctcgccgccgttcttggctacctgttgtgagactgggatgagaatgccaatgtccaccaattccatctttgactgagattgtcagcggggg

SEQ ID NO: 40790 - protein, 202 aa, Panicum virgatum
  misc_feature: Ceres CLONE 2004667
  misc_feature (6)..(140): Pfam Name: Fasciclin Pfam Description: Fasciclin domain
  misc_feature: Useful for making plants with altered carbohydrate content
  misc_feature: Useful for making plants with altered cell wall content and/or composition
TDSTLRYSTLSPASRSYTAFRFRNSSFGNNGGGYTVFAPTDNAFNNLKPGTLNSLTQQQQVSLVQGHILPSFYSMDSFQTASNPVRTQASGRDGPYTLNITSDTNNQVNVSSGVVEVRINNALYSAKPLAVYSVDKVLLPMELFGAKAPAAAPTASEGKPKKGGSSDASSPAGSEDSDTGAASARAVGWSVAGLAAVLGYLL

SEQ ID NO: 40791 - DNA, 989 bp, Panicum virgatum
  misc_feature: Ceres CLONE 2004669
  misc_feature: Encodes the peptide sequence at SEQ ID NO. 40792
gaggcgagggacgattccgaacctcgcgattcagtctccgccggcagcgatgccggtgaggcggcggcagccgcggcgacaggagacgggtgcggcggagaggtacggggagatggggatcgcggcggcgctgtcgcggccctgggactatcccacggcctgcggcgagctggccgcgctcctgcgactcggatacgcggaccttcccaaggcagcccaggcgctcgttgcctccgacgtgctgctcgcgtttcgcctccttcccgatgcgcagacaggatatgcattaagtgcagctaatgctcttctccaggtggtagaagttgccctaccgaagcaaaaaaaagcacaggctgtttcagagttcaagcactctgttattgcatataaaaggcgtgcaagagttcaacaaaattcaggtttaccacacataccacaggatgtacttgttcatatcttcagttttcttgacatgcgttctttggtggcagcgggtcttgtctgctggtcttggaattcggctgcaaatgacgacgacctgtggaagatgaattactcccttttctttggtctctgccatttgagttgcaacagcattcctgtatctggtgtacagaaaagttgtgagcttgttcaaagtagcatcatctcggagtccattgatccaaattttaggtggaaagagtccttccacagtaaatatgcagaatgtgcatcatggaaatttgcatcaaatagagcactatgtgggcattgcagatcagttatttggctgagcaacctgacatgtgctgctccacaccattgccgtaggaaacgaagagatggagtaaaattacgacctctgttacctgatacagtaagttgtctaactactatgtggttttggacctagcaggctagcacactgcacatacatcacagctttgtgtaattccaacactgatagctgtagtctgtttgaatcagccgtacaattttatcctcgt

SEQ ID NO: 40792 - protein, 281 aa, Panicum virgatum
  misc_feature: Ceres CLONE 2004669
  misc_feature (123)..(170): Pfam Name: F-box Pfam Description: F-box domain
MPVRRRQPRRQETGAAERYGEMGIAAALSRPWDYPTACGELAALLRLGYADLPKAAQALVASDVLLAFRLLPDAQTGYALSAANALLQVVEVALPKQKKAQAVSEFKHSVIAYKRRARVQQNSGLPHIPQDVLVHIFSFLDMRSLVAAGLVCWSWNSAANDDDLWKMNYSLFFGLCHLSCNSIPVSGVQKSCELVQSSIISESIDPNFRWKESFHSKYAECASWKFASNRALCGHCRSVIWLSNLTCAAPHHCRRKRRDGVKLRPLLPDTVSCLTTMWFWT

SEQ ID NO: 40793 - DNA, 447 bp, Panicum virgatum
  misc_feature: Ceres CLONE 2004677
  misc_feature: Encodes the peptide sequence at SEQ ID NO. 40794
gagactaaccgctctgcctcaccgagtcctccactgacaccgcccgctccgcgacgctatggacgcgctccgcctcgcctccttcaccctccgcgcggcctccgcggcggtatccccctcctccggcgcggcgccgcggtccgcctccttcaccagtgcggcgcaggggctcccctcgctccgcctggccccgccccgccggcgcggggacctcgccaggccccgcgccgcgggcgacgccgagtcggagggctacgagaccgcgctgtccgaggtggacgccaagaacggcaccatcgagaacaccgtgtcagacatggaaaatctggacaagatgttcgcccaagaggccgtccccgatttcttcaactaccccaccgaggcgtgcgacgagatcgcccacctcagtgactagatcgcctagtcctccaagctgttcccgcgcgt

SEQ ID NO: 40794 - protein, 118 aa, Panicum virgatum
  misc_feature: Ceres CLONE 2004677
  misc_feature: SWISSPROT Homolog: EC 3.6.3.14 H(+)-transporting two-sector ATPase
MDALRLASFTLRAASAAVSPSSGAAPRSASFTSAAQGLPSLRLAPPRRRGDLARPRAAGDAESEGYETALSEVDAKNGTIENTVSDMENLDKMFAQEAVPDFFNYPTEACDEIAHLSD

SEQ ID NO: 40795 - DNA, 620 bp, Panicum virgatum
  misc_feature: Ceres CLONE 2004685
  misc_feature: Encodes the peptide sequence at SEQ ID NO. 40796
tcgtctcccgctcccgcgcccccacggttccagacatggccgacgacctgcccgcctccatctacgacatcgccgtcaaggatattaggggcaatgacgtaaaattgagtgagtatgctggaaaggttcttcttattgttaatgttgcatcgcaatgtggattgactaattcaaattacaaagagctgaatgtcttgtatgacaagtaccgaacaaaaggccttgagatacttgcatttccatgcaaccaatttgctggtcaagagcctggcagtaatgaagatattcaggagacagtttgtactaggttcaaagcagagtttcctatttttgataagtatttgaaatcacagaaaggaggcttccttggagatggaattaaatggaacttcaccaaatttcttgtcgataaagatggcaaggttgttgggcgatatgctcatacaacttctcctttgaagatagagaatgacatcgagaagcttcttggcaccgtatcatgatttatttgcatgaatcacgtgctcagatttagtatgtcaatctcctgagctgtataattcattgaaaataaggagctcggacatctcagtctgtgttccctacagttgaaattgtaa

SEQ ID NO: 40796 - protein, 155 aa, Panicum virgatum
  misc_feature: Ceres CLONE 2004685
  misc_feature (9)..(104): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Useful for making plants with modulated nitrogen use efficiency
  misc_feature: Useful for making plants with modulated flowering time
MADDLPASIYDIAVKDIRGNDVKLSEYAGKVLLIVNVASQCGLTNSNYKELNVLYDKYRTKGLEILAFPCNQFAGQEPGSNEDIQETVCTRFKAEFPIFDKYLKSQKGGFLGDGIKWNFTKFLVDKDGKVVGRYAHTTSPLKIENDIEKLLGTVS

SEQ ID NO: 40797 - DNA, 1509 bp, Panicum virgatum
  misc_feature: Ceres CLONE 2004712
  misc_feature: Encodes the peptide sequence at SEQ ID NO. 40798
attctgccaccaaccaccgccaccaccagtaccaccacacatccatcctcctctcctcctccctcacctctagctcttcttctctcgctccgacgacctccattaccgcacctctctcgatcttgttctttctccaagttagctgctgctgcccatcacgtcgtgatcctctctaacacacctttcaattcgtcgacagggcaccagcagcaagaagatcagatagctgttattagcatgtaggatgatcagatagcttttcgcaggtgtgtgtctagctagctagggtttgtgtggctcgtgatttggaagaacccagcacacaccttatcgtactcagatcaggtggaggtagtcagctagtgatccgtcgctcgatgatggccgcagcaccgccggtgcacatctgcatggactcggactggcttaagggcatcgtccccgaggagcccgggatggggtcgtcgtcgccgccggcggaccggcgcctgcggccgcagcacgaccagccgctcaagtgcccgcggtgcgagtccacgcacaccaagttctgctactacaacaactacagcctctcgcagccgcgctacttctgcaagacgtgccgccgctactggaccaagggcggctcgctccgcaacgtccccgtcggcggcggatgccgcaagaacaagcgcgccagcgccaagaagcccgccgcgccgccgatgctgcaggcgcacgcgcggcaggtggcggagaccggcctccacctgtccttctccagcatgcagcagctgccgcctccgcccgccgcggcggacccgctgtgcagcctcggcctcctggactggaagtacgacccgatccttgcaggatccggcggcgcggccggcgcactggatggcgccagctccgaggcgcacttcgcgggggcgggcatgatgggcatccctggcggcggcgagtgccacgcgctgagcgcgctccggtacgcggccggcctgggcgaccacctgcagctgcaggggctgccgttcggggcgcgcgccgagcacgacgccgtggaggtgaagccggcggcggcggagaggctgctgtcgctggactggtacggcgaggcgagccgtgcgccagagagcgccatcagctccctgggcgcgctgggcctgtggagcggcatgatcggcggggcgcaccagcaccacggctcctccgcggccatctgaatctggcagaaacgtgcctccatgcttgcgtggcatgcattagtggtttgctaatggcgttaacgagtgactacgtaggagtgcttgttttttctttcttctgttggttttgctattgtcatcttctgtttggtttcatcgttttgtttggacgatcgatgcttgcaagctcgtcatttcagacggtgtctctgttgttgtcccacttcaaagttcgaacatttgctgtggttcaaggttttaccgatcattgtggagccatatactcacttgttccgtaaagattattcatttagccttc

SEQ ID NO: 40798 - protein, 276 aa, Panicum virgatum
  misc_feature: Ceres CLONE 2004712
  misc_feature (41)..(103): Pfam Name: zf-Dof Pfam Description: Dof domain, zinc finger
  misc_feature: The sequence is a functional homolog of SEQ ID NO 1790 in the 10/374,780 US patent application
MMAAAPPVHICMDSDWLKGIVPEEPGMGSSSPPADRRLRPQHDQPLKCPRCESTHTKFCYYNNYSLSQPRYFCKTCRRYWTKGGSLRNVPVGGGCRKNKRASAKKPAAPPMLQAHARQVAETGLHLSFSSMQQLPPPPAAADPLCSLGLLDWKYDPILAGSGGAAGALDGASSEAHFAGAGMMGIPGGGECHALSALRYAAGLGDHLQLQGLPFGARAEHDAVEVKPAAAERLLSLDWYGEASRAPESAISSLGALGLWSGMIGGAHQHHGSSAAI

SEQ ID NO: 40799 - DNA, 593 bp, Panicum virgatum
  misc_feature: Ceres CLONE 2004721
  misc_feature: Encodes the peptide sequence at SEQ ID NO. 40800
acgaaccgcaagctgacccactttcccccacctcgacctcgcgcgcctagggtttcgtctcgcgccccaccaccaccgccgagatgccgaagaacaagggtaagggaggcaagaaccggaagaggggaaagaacgaggaggacgacgacaagcgtgagctggttttcaaggaggacgggcaggagtacgcacaggtgacgcgcatgctcggcaacggccgctgcgaggccatctgcgtcgacggcacgccccgcctctgccacatccggggcaagatgcacaagaaggtctggatcgcggcaggcgacatcgtcctcgtcggcctccgcgactaccaggacgacaaggccgacgtcatcctcaagtacatgaacgacgaggcgcgcctgctcaaggcctacttggagctccccagcctcaacaagggcgtcgacgtcgacgggcccgaggacggcgaagagggcagcgactacatccagttcgaggacgaggacatcgacaagatctaagattcctgtttctccttgcgattactttcttatttcttataagtagtagcatgtggtgatatggtttaggcttgttgttatgga

SEQ ID NO: 40800 - protein, 141 aa, Panicum virgatum
  misc_feature: Ceres CLONE 2004721
  misc_feature (30)..(94): Pfam Name: eIF-1a Pfam Description: Translation initiation factor 1A / IF-1
MPKNKGKGGKNRKRGKNEEDDDKRELVFKEDGQEYAQVTRMLGNGRCEAICVDGTPRLCHIRGKMHKKVWIAAGDIVLVGLRDYQDDKADVILKYMNDEARLLKAYLELPSLNKGVDVDGPEDGEEGSDYIQFEDEDIDKI

SEQ ID NO: 40801 - DNA, 680 bp, Panicum virgatum
  misc_feature: Ceres CLONE 2004734
  misc_feature: Encodes the peptide sequence at SEQ ID NO. 40802
acatccgaatctagggtttttatcctcttctccagccgccgccgctccaccggccgctcctccatcccttctgccaatggcgtgttcttcgcggagcttaacgagatgctcacccgtgagctcgccgaggacggctactccggcgtcgaggtccgtgtcacccccatgcgcaccgagatcataatccgcgccacccgcacccagaacgttctcggcgagaagggcaggaggatcagggaactgacttctgtggttcagaagcgcttcaacttcccggagggcggcgtcgagctctatgccgagaaggtgaacaaccgcggcctctgcgccattgcccaggctgagtcactccgctacaagctcctcggtggactcgccgtcagaagggcatgctatggcgttctacggtttgtcatggagagtggtgccaaaggctgtgaggttattgttagtgggaagctcagggcccaacgtgctaaatccatgaagttcaaggatggatacatgatctcttctggccatcctgtcaacctatatattgactcagctgtgaggcatgttctcctgagacagggtgtgctgggtatcaaggtaaagattatgctcgactgggatccaaagggcaagcaagggccaaccatgcctttacctgatcttgttaaattcaccccccaaaggaa

SEQ ID NO: 40802 - protein, 226 aa, Panicum virgatum
  misc_feature: Ceres CLONE 2004734
  misc_feature (116)..(200): Pfam Name: Ribosomal_S3_C Pfam Description: Ribosomal protein S3, C-terminal domain
  misc_feature (57)..(114): Pfam Name: KH_2 Pfam Description: KH domain
  misc_feature: Useful for making plants with modulated biomass
  misc_feature: Useful for making plants with modulated water use efficiency
TSESRVFILFSSRRRSTGRSSIPSANGVFFAELNEMLTRELAEDGYSGVEVRVTPMRTEIIIRATRTQNVLGEKGRRIRELTSVVQKRFNFPEGGVELYAEKVNNRGLCAIAQAESLRYKLLGGLAVRRACYGVLRFVMESGAKGCEVIVSGKLRAQRAKSMKFKDGYMISSGHPVNLYIDSAVRHVLLRQGVLGIKVKIMLDWDPKGKQGPTMPLPDLVKFTPQR

SEQ ID NO: 40803 - DNA, 664 bp, Panicum virgatum
  misc_feature: Ceres CLONE 2004747
  misc_feature: Encodes the peptide sequence at SEQ ID NO. 40804
cccgagccctatccttttcccctcccccgggtctcccctaccccccactcctatcctctcctccctcacccgcgccgccgcagcagcagccgccgccgccgccgccgcggcttcccttcctcacccgagccaagatgaatgttgacaagctcaagaagatggcaggtgcagtgcgcaccggtggaaagggtagcatgcgcaggaagaagaaggcagtccacaagactacaaccacagatgacaaaaggcttcagagcaccctgaaaagagtaggagtgaacactatccctggtattgaagaggtcaacatcttcaaggatgatgttgttattcagtttgtgaatcctaaagtgcaagcttctattggtgctaatacatgggtggtcagtggaactccacagacaaagaagctgcaagatctgcttccgtcgattatcaatcagcttggtcctgacaacttggacaacctgcggaggcttgcggagcaattccagaagcaggtccctggagcttcaagcgctgaggctggtgctagcacaggtgctgctcaggatgacgatgatgacgtccctgagcttgtccctggagagacatttgaggaggctgctgaagagaaaaaggagtcgtcataattttgctgcgtgcctgcagttgtgaagggttt

SEQ ID NO: 40804 - protein, 165 aa, Panicum virgatum; identical to SEQ ID NO: 39828
  misc_feature: Ceres CLONE 2004747
  misc_feature (34)..(92): Pfam Name: NAC Pfam Description: NAC domain
  misc_feature: Useful for making plants with modulated biomass
  misc_feature: The sequence is a functional homolog of SEQ ID NO 1617 in the 11/479,226 US patent application
  misc_feature: The sequence is a functional homolog of SEQ ID NO 786 in the 10/412,699 US patent application
  misc_feature: The sequence is a functional homolog of SEQ ID NO 1614 in the 11/479,226 US patent application
  misc_feature: The sequence is a functional homolog of SEQ ID NO 784 in the 10/412,699 US patent application

SEQ ID NO: 40805 - DNA, 733 bp, Panicum virgatum
  misc_feature: Ceres CLONE 2004758
  misc_feature: Encodes the peptide sequence at SEQ ID NO. 40806
attcgcgcaatcgcggaaaagtccaaccccaaaactccccagccggaggcgaggcgatctgagggagaggagaagccgcagcagacatgtcggggggaatcgctcgcggtcgcctcgccgaggagcgcaaggcctggcgcaagaaccacccgcatggtttcgtggcgaagccggagacgctgcccgacgggacggtgaacctgatgacctggcactgcaccatccccggcaagcaagggactgattgggaaggtggatacttccctcttacccttcatttcagtgaggattaccctagcaagcctccaaagtgcaagttcccacagggcttcttccacccaaatgtctatccttcgggaacagtctgcctttctattcttaacgaggatagcggttggagaccagctattactgtcaagcagattcttgttgggattcaggacttgcttgatcagccaaatcctgctgatcctgcacagactgatggttatcatctttttatccaggatccaacagaatataagaggcgcgttaagctgcaggctaagcagtatcccgcattggtctgaggacaattgcccatctagggatccatgctgcacatccgcatagttgttgctagtgtcttgaatgaaagaccaaatgtaacatggtgctttaagacatgaaactgtcgtcattgtgaaccaactggtctatgtgttgtctgactgatctaagtgcgaaggaacac

SEQ ID NO: 40806 - protein, 160 aa, Panicum virgatum
  misc_feature: Ceres CLONE 2004758
  misc_feature (9)..(153): Pfam Name: UQ_con Pfam Description: Ubiquitin-conjugating enzyme
  misc_feature: SWISSPROT Homolog: EC 6.3.2.19 Ubiquitin--protein ligase
MSGGIARGRLAEERKAWRKNHPHGFVAKPETLPDGTVNLMTWHCTIPGKQGTDWEGGYFPLTLHFSEDYPSKPPKCKFPQGFFHPNVYPSGTVCLSILNEDSGWRPAITVKQILVGIQDLLDQPNPADPAQTDGYHLFIQDPTEYKRRVKLQAKQYPALV

SEQ ID NO: 40807 - DNA, 682 bp, Panicum virgatum
  misc_feature: Ceres CLONE 2004783
  misc_feature: Encodes the peptide sequence at SEQ ID NO. 40808
aaaaaccgcccgccggcctccaaacccccgccaccatggtcgcggcggaggacccggaatccttcttcgccaccgcgccgccgctgggggacaccggcgccgtcgtcgccaggattcaggaattcgtcgcccgcaactcttcccacccgtcatcagagggcggcgggcggcggcggatcgtgtgcgtcacgtcgggcgggacgacggtgccgctggagcagcggtgcgtgcgctacatcgacaacttcagctccggccaccgcggcgccgcgtccaccgagtatttcttaaaggctggttatgctgtcatcttcgtgcatcgacgtgggagctgccaacctttctgtaggttcctgcctgatgattcatttctcaatttctttgatgtaactacagaatcgaaggttcaagtggttgagtcccacacgacagtggtaaagaaggcaattggggagtatagcaaggctattgaaggaggatctctgttgaaactcccattcaccacgatatttgaatatcttcagttactgaagatggtggctacatgtatgagctctgtgggtccccacgggatgttctatctcgctgccgctgtgtctgacttttatgttccgtgggatagcatggccaaacataagattcagtcagccggaggcccactggatatgaagctaagtcaggt

SEQ ID NO: 40808 - protein, 215 aa, Panicum virgatum
  misc_feature: Ceres CLONE 2004783
  misc_feature (42)..(215): Pfam Name: DFP Pfam Description: DNA / pantothenate metabolism flavoprotein
  misc_feature: SWISSPROT Homolog: EC 6.3.2.5 Phosphopantothenate--cysteine ligase
MVAAEDPESFFATAPPLGDTGAVVARIQEFVARNSSHPSSEGGGRRRIVCVTSGGTTVPLEQRCVRYIDNFSSGHRGAASTEYFLKAGYAVIFVHRRGSCQPFCRFLPDDSFLNFFDVTTESKVQVVESHTTVVKKAIGEYSKAIEGGSLLKLPFTTIFEYLQLLKMVATCMSSVGPHGMFYLAAAVSDFYVPWDSMAKHKIQSAGGPLDMKLSQ

SEQ ID NO: 40809 - DNA, 683 bp, Panicum virgatum
  misc_feature: Ceres CLONE 2004785
  misc_feature: Encodes the peptide sequence at SEQ ID NO. 40810
tcaaggaggcgatctcggcgctcaaggagaggaccggctcgagctcgcacgccatcgccaagtacatggaggacaagcacggcccgtcgctgccggccaactacaagaagatgctctccatccagctccgcgggttcgccgccaagggcaagctcgtcaaggtcaaggcctcctacaagctctccgacgccgccaagaaggaggcccccaaggccaagcccgcagccgccaagaccgtcgcggccaagccggccaaggccgccgcgaagccgaagaagagcgccgccgccgcgaagctgaagaagaccgcggccgccgccgccgggaccaagcgcaaggcgccggagaaagtcgtggcgaagccgaagaagtcccccgcggcgaaggccaaggccaagcccaagactgtgaagtcccccgcctccaagaaggcccggaaggtcgccgcatgagatagttccataggtcggagctctgattgtggtgtggttgtccctagggagttgtactctgattgtggtgtggttgtccctagggagttgtacaaatgaagtgcgttccccaagcgtctctgatccggtgttgtgttaggtcagttcaatgtatccaggtcggtgttagtgtaactgatggttaggtttcttgtgagggagatgtatctcgctctcttatatatgatatga

SEQ ID NO: 40810 - protein, 149 aa, Panicum virgatum
  misc_feature: Ceres CLONE 2004785
  misc_feature (1)..(62): Pfam Name: Linker_histone Pfam Description: linker histone H1 and H5 family
KEAISALKERTGSSSHAIAKYMEDKHGPSLPANYKKMLSIQLRGFAAKGKLVKVKASYKLSDAAKKEAPKAKPAAAKTVAAKPAKAAAKPKKSAAAAKLKKTAAAAAGTKRKAPEKVVAKPKKSPAAKAKAKPKTVKSPASKKARKVAA

SEQ ID NO: 40811 - DNA, 671 bp, Panicum virgatum
  misc_feature: Ceres CLONE 2004788
  misc_feature: Encodes the peptide sequence at SEQ ID NO. 40812
acagatcgagctagctgatcagcagcagcagcagcagcagcagcagcagcagcagcaagctctctctcgctctcgctcttggtctgagcttgcattgcattggtgcgtgtgaggatggccaaggacatcgaggccgcggcggcgccggagggcggggagtacacggccaaggactactcggacccgccgccggtgccgctgatcgacgcggaggagctgaccaagtggtcgctgtaccgcgcggtgatcgccgagttcgtggcgacgctgctctttctctacatcacgatggccacggtgatcgggtacaagcaccagacggacgcgacggcgtcgggccccgacgcggcgtgcggcggcgtgggcatcctcggcatcgcctgggccttcggcggcatgatcttcatcctcgtctactgcaccgcgggggtgtcgggtggccacatcaacccggccgtcacgctgggcctgttcctggcgcgcaaggtgtcgctggtgcgcgcgctgctctacatcgtcgcgcagtgcctgggcgccatctgcggcgtcgggctcgtcaagggcttccagagcgcctacttcgtgcgctacggcggcggcgctaacgagctcagcgacggctactccaagggcacggggctcgccgccgagatcatcggcaccttcgtgct

SEQ ID NO: 40812 - protein, 185 aa, Panicum virgatum
  misc_feature: Ceres CLONE 2004788
  misc_feature (34)..(185): Pfam Name: MIP Pfam Description: Major intrinsic protein
  misc_feature: Useful for making plants with modulated cold sensitivity
  misc_feature: Useful for making plants with modulated drought sensitivity
  misc_feature: Useful for making plants with modulated water use efficiency
MAKDIEAAAAPEGGEYTAKDYSDPPPVPLIDAEELTKWSLYRAVIAEFVATLLFLYITMATVIGYKHQTDATASGPDAACGGVGILGIAWAFGGMIFILVYCTAGVSGGHINPAVTLGLFLARKVSLVRALLYIVAQCLGAICGVGLVKGFQSAYFVRYGGGANELSDGYSKGTGLAAEIIGTFV

SEQ ID NO: 40813 - DNA, 655 bp, Panicum virgatum
  misc_feature: Ceres CLONE 2004792
  misc_feature: Encodes the peptide sequence at SEQ ID NO. 40814
aaagcaggcccacacaagcacaaccggtcaccggctcagcgcggagcctgcctgagagcagctgcacgggcgcccccaccattccccagctctgcctccaatggcaacgagggcggcggcagccacgctcacggcagcgacgtcctctctcctcaggcgctctgcctcgctgcggccgcagggtctccgggtcccccgtcgcgtgcctccccgaagatttgtgcgccacattgcttcatcaacaaatgaggaagctgctgccagagcagctgctgccactgctgatactggaggaccaaccatttttgacaagatcatctctaaggagattcctgcaagcgttgtctatgaagatgacaaagtcttaacatttagagatattaatccacaagcccctgtgcacgttctgatcatcccaaaagtgagagatggactaactggactatccaaggctgaaccaaggcatgctgagattctgggccagcttttttacgcagcgaaagtagtcgctgagaaggaaggtttggcaaatgggtaccgtgtcgtcttatacaatggagctgaaggatgtcaatctgtctatcatttgcacttgcatgtactcggtggaaggcagatgaagtggcctgctggttaaattacagagtgtgacata

SEQ ID NO: 40814 - protein, 178 aa, Panicum virgatum
  misc_feature: Ceres CLONE 2004792
  misc_feature (74)..(173): Pfam Name: HIT Pfam Description: HIT domain
  misc_feature: SWISSPROT Homolog: EC 3.6.1.29 Bis(5'-adenosyl)-triphosphatase
MATRAAAATLTAATSSLLRRSASLRPQGLRVPRRVPPRRFVRHIASSTNEEAAARAAAATADTGGPTIFDKIISKEIPASVVYEDDKVLTFRDINPQAPVHVLIIPKVRDGLTGLSKAEPRHAEILGQLFYAAKVVAEKEGLANGYRVVLYNGAEGCQSVYHLHLHVLGGRQMKWPAG

SEQ ID NO: 40815 - DNA, 713 bp, Panicum virgatum
  misc_feature: Ceres CLONE 2004806
  misc_feature: Encodes the peptide sequence at SEQ ID NO. 40816
attgcagattgttgtcgaggatttggagctgatgttataatgacatcagaatcatgcagaaatggatctgagcgctgctgtgaggcacttgaaaagcttgggaaacgttatgatattgttgtcaatattcaaggagatgagcctcttatcgaaccagagataatagatggtgtcgttatggcattgcagcgagctcctgatgcagtgttcagcacagctgttacttcactgaaacctgaagatgcatctgatacgaatcgagttaagtgtgttgtggataatcagggctatgcaatctacttttcaagagggctgataccatccaacaaatcagggaaagtcaatcctaattatccgtatcttctccatcttggaatctcgggctttgattcgaagttcttgatgatctatccagaacttccaccgacacctttacaactagaagaggacctagagcaactcaaagttcttgaaaacggctataggatgaaggtgatcaaagtggaccacgatgctcatggtgtagatgcacctgaggatgttcagaaaatcgaagaactgatgcgagggagaaacattcagtagaaaatgaagagtgtgtgttttgcattgccaccggcgtaggttcactcggagactttggctgtgctacattgtctgcagatagcatggtagtatgcaaacctgctgagttgatcaattaggagctgttc

SEQ ID NO: 40816 - protein, 194 aa, Panicum virgatum
  misc_feature: Ceres CLONE 2004806
  misc_feature (1)..(165): Pfam Name: CTP_transf_3 Pfam Description: Cytidylyltransferase
  misc_feature: SWISSPROT Homolog: EC 2.7.7.38 3-deoxy-manno-octulosonate cytidylyltransferase
IADCCRGFGADVIMTSESCRNGSERCCEALEKLGKRYDIVVNIQGDEPLIEPEIIDGVVMALQRAPDAVFSTAVTSLKPEDASDTNRVKCVVDNQGYAIYFSRGLIPSNKSGKVNPNYPYLLHLGISGFDSKFLMIYPELPPTPLQLEEDLEQLKVLENGYRMKVIKVDHDAHGVDAPEDVQKIEELMRGRNIQ

SEQ ID NO: 40817 - DNA, 677 bp, Panicum virgatum
  misc_feature: Ceres CLONE 2004813
  misc_feature: Encodes the peptide sequence at SEQ ID NO. 40818
aagtccaaaggggcaaaaccagaagttgcagttcgcctcctcctcggctcagatctctctccgtgcgcgcggctgcgatggcgtctttctcggaggctccccccggtaaccccaaggcgggcgagaagatcttcaagaccaagtgcgcgcagtgccacaccgtcgagaagggcgccggccacaagcaaggtccaaacttgaatggtctctttgggaggcagtccggtaccactgctggatactcctactctgcaggaaacaagaacaaggctgtggtctgggaggagaacactttgtatgagtacctgcttaaccctaagaagtacattcctggaaccaagatggtcttccctgggctgaagaaaccgcaggagcgtgctgatctcattgcatacctgaaggaagccactgcatagaaaaatggcatgctgaaccatgaagcaattcgttttacagtttaataaagaggtttagacaattcgggtcactctggttgaacagggtgcaatccacgagacaattattgagcattttggttcttatgtttgtttcgaatgtctaggtgtttagctgaacaaaaaacagtcaactttgactgctgcttgtttcaactgctggagaaatcccagcgccctatttttgaccaccgggtggtggaactggaaatctgggatgca

SEQ ID NO: 40818 - protein, 112 aa, Panicum virgatum; identical to SEQ ID NO: 12214
  misc_feature: Ceres CLONE 2004813
  misc_feature (12)..(111): Pfam Name: Cytochrom_C Pfam Description: Cytochrome c
  misc_feature: SWISSPROT Homolog: EC 1.9.3.1 Cytochrome-c oxidase

SEQ ID NO: 40819 - DNA, 652 bp, Panicum virgatum
  misc_feature: Ceres CLONE 2004814
  misc_feature: Encodes the peptide sequence at SEQ ID NO. 40820
aaaccatcccaagcacaagcttagactactcagaagctagctgtaccaagcagctcatagcacacttgaagctatagctagctaatagaaatggcgcagcatgccctgttcctctccctgactgtccttgccttcgcggcggcagtgcacggctgtacgccatcctgtcctaccccaccagtggttcccaccccgccggtcgtgccgacgccgtccggtggtggcggctcctgcccaatcaacgcactgaagctggaggtgtgcgccaatgtgttgaacctcctgaagctcaacatccctgtcacggggaacgaccagtgctgcccgctgttgcaggggctcgtcgaccttgacgccgcagtctgtctctgcactgctatcaaggccaatgtcctcggcatcaacctcaatgtgcccatcgacctgagcctcctcctcaaccactgtggcaagatctgccctgcagatttcacctgccccaattagccggcgaatgaaacattccacacgcccatgcatcatctgaatcttcatccatccactgcgatcgtgggcacctatcacctatgcggtcggtctgtgtgttggtttgcatcagcatgcacccatatatgtgttctcttctgttcgggttttgagtgatgcatggctc

SEQ ID NO: 40820 - protein, 131 aa, Panicum virgatum
  misc_feature: Ceres CLONE 2004814
  misc_feature (48)..(129): Pfam Name: Tryp_alpha_amyl Pfam Description: Protease inhibitor/seed storage/LTP family
  misc_feature: Useful for making plants with modulated biomass
  misc_feature: Useful for making plants with modulated flowering time
  misc_feature: Useful for making plants with modulated salt sensitivity
MAQHALFLSLTVLAFAAAVHGCTPSCPTPPVVPTPPVVPTPSGGGGSCPINALKLEVCANVLNLLKLNIPVTGNDQCCPLLQGLVDLDAAVCLCTAIKANVLGINLNVPIDLSLLLNHCGKICPADFTCPN

SEQ ID NO: 40821 - DNA, 658 bp, Panicum virgatum
  misc_feature: Ceres CLONE 2004816
  misc_feature: Encodes the peptide sequence at SEQ ID NO. 40822
cctgagatcagtaattatgctgggatgttcttcattcttcttttcgcctccatttttgccactggtatattggagctcagatggagtggagttggcattgaagattggtggaggaatgagcagttttgggttattggtggcacctctgcccatctcttcgctgtgttccagggtctgctgaaagtgttggctgggatcgataccaacttcacagttacctcaaaggcatctgatgaagatggtgactttgctgagctttatgtgttcaagtggaccagtttgctcatcccgccaaccactgtccttgtcattaacctggttggaatggtggcagggatttcgtatgccattaacagcggctaccaatcctggggtccactttttggaaagcttttcttctcaatctgggtgatcctccatctctaccccttcctcaagggtctcatgggcaggcagaaccgcaccccaaccattgtcattgtctggtccattctccttgcatctatcttctcgttgttgtgggtgaagatcgaccctttcatctccccaacacagagagctgttgctttggggcaatgcggcgtgaactgctgatcaggactagacccctcgtggaatgggctcaatcaggatctacctcctcgtgttgatagctgag

SEQ ID NO: 40822 - protein, 197 aa, Panicum virgatum
  misc_feature: Ceres CLONE 2004816
  misc_feature: SWISSPROT Homolog: EC 2.4.1.12 Cellulose synthase (UDP-forming)
  misc_feature: The sequence is a functional homolog of SEQ ID NO 6 in US patent 7285702
  misc_feature: Useful for making plants with altered cell wall content and/or composition
  misc_feature: Useful for making plants with modulated biomass
  misc_feature: Useful for making plants with altered carbohydrate content
  misc_feature: The sequence is a functional homolog of SEQ ID NO 26 in US patent 7312377
  misc_feature: The sequence is a functional homolog of SEQ ID NO 2 in US patent 7049481
  misc_feature: Useful for making plants with modulated plant growth and development
PEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQRAVALGQCGVNC

SEQ ID NO: 40823 - DNA, 646 bp, Panicum virgatum
  misc_feature: Ceres CLONE 2004817
  misc_feature: Encodes the peptide sequence at SEQ ID NO. 40824
ctcctccgccgtcgcctctccactttccccatccttcgccgccgtcgcggtcgcctcgcagtccgaagagccgcccccgactccgatggccagccgctgggtccgacccgaggtatacccgctgttcgcggcgatgggcgtggccgtcggcatctgcggatttcagctcttccggaacatcaccgggaacccggaagtcagggtaaacaagacagggagggcagctggtgtgcttgagaaccatgaggaggggaggcgttacgcaatgcacagcctcagaagctttgtgcatgacaagaccccagaaatcatgccggccatcaacaagttcttcactgagccaaagtgaagcgatttgctcgggtgctgctgctggagtcgctattgtcacgtgtacccatttaaggcattcaatatgtaatgtgattggtgagtgattggtgatggcttgctatgtgtatgatggtttatgagtgctgcatcacccctgtttgatgttcatgctcatctgtcatgtggatttgctgtgcctcagtgataaattgccagccaacgttcatttggttactgctactgatgttatgtgatgtgcatcccatatgcagtctgttaaactgcgggcttgactatgcatcatcatttcttc

SEQ ID NO: 40824 - protein, 87 aa, Panicum virgatum
  misc_feature: Ceres CLONE 2004817
  misc_feature (2)..(87): Pfam Name: B12D Pfam Description: B12D protein
MASRWVRPEVYPLFAAMGVAVGICGFQLFRNITGNPEVRVNKTGRAAGVLENHEEGRRYAMHSLRSFVHDKTPEIMPAINKFFTEPK

SEQ ID NO: 40825 - DNA, 736 bp, Panicum virgatum
  misc_feature: Ceres CLONE 2004819
  misc_feature: Encodes the peptide sequence at SEQ ID NO. 40826
gcgtttgattcagtctattgataagtaagcacttgtcccgagagcgcgaatcattccgcgcgccgcaaaaccctagcccagcaaccgatctcctctcatggcggccaccaccagccaggcgagcctcctcctgcagaagcagctcagagatctcgccaagcacccggtggatgggttctcggctgggctggtcgacgacagcaatgttttcgagtggcaggtcaccatcatcggcccgcctgacaccctatatgatggagggtactttaacgcgataatgagcttcccacaaaattacccaaacaacccgccgtcagtcagatttacctctgaaatgtggcatccaaatgtgtacccagatggtagggtgtgtatttctattcttcatccacctggtgaagatcccaacggctatgagctcgcgagtgagcgttggacacctgtgcacacagttgaaagtatagttctgagcattatttctatgctctctagtccaaatgatgagtctccagcaaatattgaggcagctaaggaatggagggagaagagggaggacttcaagaaaaaggttaggcgcattgtccgtaaatcacaggaaatgctctgaagaaagtaagtgtaatgcggaagctaaccgtgcaatgccaggctgcaagattttgttgtcgagctcccaaatgttcatttgataccagcgtcttgtatatattccatttagcgtccgaccatcagtgat

SEQ ID NO: 40826 - protein, 169 aa, Panicum virgatum
  misc_feature: Ceres CLONE 2004819
  misc_feature (11)..(162): Pfam Name: UQ_con Pfam Description: Ubiquitin-conjugating enzyme
  misc_feature: SWISSPROT Homolog: EC 6.3.2.19 Ubiquitin--protein ligase
MAATTSQASLLLQKQLRDLAKHPVDGFSAGLVDDSNVFEWQVTIIGPPDTLYDGGYFNAIMSFPQNYPNNPPSVRFTSEMWHPNVYPDGRVCISILHPPGEDPNGYELASERWTPVHTVESIVLSIISMLSSPNDESPANIEAAKEWREKREDFKKKVRRIVRKSQEML

SEQ ID NO: 40827 - DNA, 657 bp, Panicum virgatum
  misc_feature: Ceres CLONE 2004851
  misc_feature: Encodes the peptide sequence at SEQ ID NO. 40828
actcgcccacccgccgtcgccgtcgcgcgctcgcgtcgcgtccctccctccgccgcgcgtctcccacacaaagccgccgccgccgacccaggccacccacctcccgcctagctcctctccgaccagagcacacgagccgcccgccgcgtgccaccccatggccaccgcctgccgcttcgccgcgccgctcggcctcgccgcgccgccccgcggccgcgcccccgccggcgtcgtcgtggccgtcgcccaatgcggttccaaggtctcgagaggcgtcgccgtcagggcgacgtccagcggcgagggcgcgacggaggacgtgccggagatcgtcaaggctgcccaggacgcgtgggacaaagttgaggacaagtacgccgtggccaccatcggcgtcgccgccatcgtcgcgctctggacagcggcaggagctctcaaggccatcgagaagcttcctctcctgcccggtgtccttgagattgttggaatcggctatactgggtggttcacataccgcaacctcgtcttccagccggacagggaagctcttatcagcaaggtcaagagcacttacaaggagatcaccgggagcagcagctgatcaagcatcatttactagatggatcgttctgtaatcagatgctagaattgcatctg

SEQ ID NO: 40828 - protein, 147 aa, Panicum virgatum; identical to SEQ ID NO: 12328
  misc_feature: Ceres CLONE 2004851
  misc_feature: SWISSPROT Homolog: EC 6.1.1.9 Valine--tRNA ligase

SEQ ID NO: 40829 - DNA, 729 bp, Panicum virgatum
  misc_feature: Ceres CLONE 2004854
  misc_feature: Encodes the peptide sequence at SEQ ID NO. 40830
aattccgcctccaccctcccactccaaacccttgcgccgccgccgccacaggtaagcaggaagaaggcccggcgcgatggtgtccggctccggcttgtccgtgcgccgcatcgtggtggacgcgcgccaccacatgctcggccgcctggcctccatcatcgccaaggagctgctcaatgggcagaaggttgtggttgtccgctgcgaggagatctgcatgtccggcggcctcgtccgccagaagatgaagtacctccgcttcctccgcaagaggatgaacaccaagccgtcccacgggcccatccacttccgctcccccgccaagatcctctggcgcaccatccgcggtatgatcccgcacaagaccaagaggggagaggcagctctcgccaggctcaagacctacgagggagtcccgccgccgtacgacaggaccaagcgcatggtcatccctgacgcactcaaggttctgaggctgcagcctggtcacaagtactgccttctcggtgagctgtccaaggaggtcggatggaactaccacgacaccatcagggagcttgaggcgaagaggaaggagaaggccaaggttgcctatgagaggaggaagcaactggcgaagctgcgggtcaaggctgagaaggctgcggatgagaagctgggatctcagctggagattcttgccccgatcaaatactgagaagacagtgctttcgtgcattatcagttttg

SEQ ID NO: 40830 - protein, 206 aa, Panicum virgatum
  misc_feature: Ceres CLONE 2004854
  misc_feature (11)..(127): Pfam Name: Ribosomal_L13 Pfam Description: Ribosomal protein L13
  misc_feature: Useful for making plants with modulated nitrogen use efficiency
MVSGSGLSVRRIVVDARHHMLGRLASIIAKELLNGQKVVVVRCEEICMSGGLVRQKMKYLRFLRKRMNTKPSHGPIHFRSPAKILWRTIRGMIPHKTKRGEAALARLKTYEGVPPPYDRTKRMVIPDALKVLRLQPGHKYCLLGELSKEVGWNYHDTIRELEAKRKEKAKVAYERRKQLAKLRVKAEKAADEKLGSQLEILAPIKY

SEQ ID NO: 40831 - DNA, 635 bp, Panicum virgatum
  misc_feature: Ceres CLONE 2004856
  misc_feature: Encodes the peptide sequence at SEQ ID NO. 40832
atcgtctactccgacccctcgccccggccgcgcccgccttcgcatccggcaccccccccacctcgccctctccctctcccctctgaacccacgcccgccaccgccgccggcgcgatggccatgcgggtggtgcggaacctggacctggagcggtacgtggggcggtggtacgagatcgcgtgcttcccgtcggcattccagcccaagacgggcaccaacacgcgcgccacctacgcgctcaacccggacggcaccgtgcgggtgctcaacgagacgtggaccgacggccgccgcggccacatcgagggcacggcgtggcgcgccgacccggccggcgacgaggccaagctccgggtccgcttcttcgtcccgcccttcctccccgtcttccccgtcaccggcgactactgggtgctccacgtcgacgccgactaccagtacgcgctcgtcggccagccctccaggaagtacctctgggtgcgtgcgcgccgatccctccccaattctccacccaactgctgattccacacgcatctgtggtgtggctgacctctctgattgctcgcgcgcagatcctgtgcaggcagccgcacatggacgaggccgtgtacggcgagctggtgaggcggggcgag

SEQ ID NO: 40832 - protein, 135 aa, Panicum virgatum
  misc_feature: Ceres CLONE 2004856
  misc_feature (9)..(133): Pfam Name: Lipocalin_2 Pfam Description: Lipocalin-like domain
MAMRVVRNLDLERYVGRWYEIACFPSAFQPKTGTNTRATYALNPDGTVRVLNETWTDGRRGHIEGTAWRADPAGDEAKLRVRFFVPPFLPVFPVTGDYWVLHVDADYQYALVGQPSRKYLWVRARRSLPNSPPNC

SEQ ID NO: 40833 - DNA, 633 bp, Panicum virgatum
  misc_feature: Ceres CLONE 2004874
  misc_feature: Encodes the peptide sequence at SEQ ID NO. 40834
gtcggttcgcggctggtgtgttgttccgagaacacgaccaaaatccaaatcatcatcctcgcgactctcgtcgatccgctcgcccggcttcaagatgcagatcttcgttaagacccgtgctggtcaagaccatcccccgggaggaggagtcctccgacactatcgacaatgtcaaggccaagatccaggacaaggagggcattcccccagaccagcagaggctcatcttcgctggagagcagctcgaggatgggcgtacccttgccgactacagcggccagaaggagagcacgctccacctggtgctccgcctgaggggaggcgtgcagatctttgggaacaccttgactggcaagactatcaccctagaggtcaagtcttccgacaccatcgaccacgtccaggccaaaatccatgacaaggagggcatccgaccagaccagcagcgtctgatcttcgctggtcagcggctagaggatggtcgcacccttgccgactacaacatacagaatgagagcactctgcacctggtgctccgtctgaggggtgggatgcagatcttcgtgaagaccttgactggcaagaccatcactctggatgttgagagctccgacaccatcgacaatgttaagg

SEQ ID NO: 40834 - protein, 210 aa, Panicum virgatum
  misc_feature: Ceres CLONE 2004874
  misc_feature (113)..(181): Pfam Name: ubiquitin Pfam Description: Ubiquitin family
  misc_feature (38)..(105): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
RFAAGVLFREHDQNPNHHPRDSRRSARPASRCRSSLRPVLVKTIPREEESSDTIDNVKAKIQDKEGIPPDQQRLIFAGEQLEDGRTLADYSGQKESTLHLVLRLRGGVQIFGNTLTGKTITLEVKSSDTIDHVQAKIHDKEGIRPDQQRLIFAGQRLEDGRTLADYNIQNESTLHLVLRLRGGMQIFVKTLTGKTITLDVESSDTIDNVK

SEQ ID NO: 40835 - DNA, 724 bp, Panicum virgatum
  misc_feature: Ceres CLONE 2004880
  misc_feature: Encodes the peptide sequence at SEQ ID NO. 40836
acccaaccaaccgcgcttgtgtacactccactcactagtcccagctagcatccgggcctcatccagctccacccaagccaggcatcaacaagccaggaagcagagctagctagaggcgtccatggcggcgctccgggccctgtccgcggcggtggcgctggcgctggcgctggtggcggcgtcggcagcggcgtcggcgtcggcggactcgtggctgtacgagaagttcaccacggacggccacgtgcgcgccgactacaacgcgcaggggcagcaggtgacgtcgctcatcctcgaccgccagtccggcggcgccttctactcccgccagaagtacctctacggcgtcttcagcatccagatgaagctcatccgcggcaactctgccggcaccgtcacctccttctacctgacctccggcgacggccccgggcacgacgagatcgacatggagttcatgggcaactccagcggcgacccggtggtgctcaacaccaacgtctgggccgccggcgacggcaagaaggagcagcagttctacctgtggttcgacccggccgccgacttccacacctacaccatcatctggaacgaccggaacgtcatcttcaaggtggacgacctcttcgtccgcagcttccggcggcacgccgacctgccctaccccggcggggagcccatgtcggtgcacgccacgctctgggacggcagcttctgggccacg

SEQ ID NO: 40836 - protein, 200 aa, Panicum virgatum
  misc_feature: Ceres CLONE 2004880
  misc_feature (32)..(200): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MAALRALSAAVALALALVAASAAASASADSWLYEKFTTDGHVRADYNAQGQQVTSLILDRQSGGAFYSRQKYLYGVFSIQMKLIRGNSAGTVTSFYLTSGDGPGHDEIDMEFMGNSSGDPVVLNTNVWAAGDGKKEQQFYLWFDPAADFHTYTIIWNDRNVIFKVDDLFVRSFRRHADLPYPGGEPMSVHATLWDGSFWA

SEQ ID NO: 40837 - DNA, 653 bp, Panicum virgatum
  misc_feature: Ceres CLONE 2004887
  misc_feature: Encodes the peptide sequence at SEQ ID NO. 40838
attcccccacagcacacacagcagctaatccagactcacactactgtagcatttgctttgcttagcacgaccgccgatcgataattaataataatacaacgataatggcggctctgatgatgaagaacaagaagcagatgcaggcggtggtggccttggccgttgtggtggcggcggcggcgctggtggcgtcggcgtcggcggccatcacctgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagcgcagaccggcaggcggcgtgccggtgcctcaagagcctggccagcaccgtcaagtcggtgaacatgggcaccgtcgccaccatccccggcaagtgcggcgtctccgtgccattccccatcagcatgtccactgactgcaacaagtacgtacagtactagcttctctatcatcaccatcatctatatatcgtcgtcttcttttttatttttatatatattaattatatcttttactgatctacttgtatacgtgcgtgcgtccattttacagggtcaactaaataattgtgcatcaatataataatcctaccagctgatgag

SEQ ID NO: 40838 - protein, 128 aa, Panicum virgatum
  misc_feature: Ceres CLONE 2004887
  misc_feature (37)..(122): Pfam Name: Tryp_alpha_amyl Pfam Description: Protease inhibitor/seed storage/LTP family
MAALMMKNKKQMQAVVALAVVVAAAALVASASAAITCGQVGSALAPCIPYATGKASALPSSCCGGVRSLNSAARTSADRQAACRCLKSLASTVKSVNMGTVATIPGKCGVSVPFPISMSTDCNKYVQY

SEQ ID NO: 40839 - DNA, 643 bp, Panicum virgatum
  misc_feature: Ceres CLONE 2004888
  misc_feature: Encodes the peptide sequence at SEQ ID NO. 40840
ggccccaaagcacagcagagcagagcagagcagagctgagctgaaacaagaccatgtcgtcgtccaaggtcttcaccctcgaggaggtcgctaagcacaacaccaaggacgactgctggctcatcatcgctggcaaggtgtacaatgtgaccaagtttcttgaggatcaccctggaggtgatgatgttctgttgtcctccactgccaaggatgctactgatgactttgaagatgtgggccacagcaccactgctcgtgcgatgatggacgagtacttagtcggtgaaattgatgcaactacaatacccactaaggtgaagtacacgcccccgaagcagccgcactacaaccaggataagacccctgagttcatcatcaagattctccagtttttggcccccttggcgatattgggcttggctgtcgccgtaaggatctacaccaagtcggaatccacctaattattgtcatcacttggccaaagattacaactgaataagttagtgaggattgtacgagcgagcatggcctgtcatgaatttggaaactttagtctctgtgatggtatgattacgtgcaacatctattggtaaattgagactcgagtgaagtggatggatattcagttttatttttccttatt

SEQ ID NO: 40840 - protein, 135 aa, Panicum virgatum; identical to SEQ ID NO: 12038
  misc_feature: Ceres CLONE 2004888
  misc_feature (6)..(80): Pfam Name: Cyt-b5 Pfam Description: Cytochrome b5-like Heme/Steroid binding domain

SEQ ID NO: 40841 - DNA, 667 bp, Panicum virgatum
  misc_feature: Ceres CLONE 2004889
  misc_feature: Encodes the peptide sequence at SEQ ID NO. 40842
aacgatggctcggcgatatgattcaaagacgacaacgttctctcccgagggacgactgtaccaagtcgaatatgcaatggaatcagtatcgcacgctggctgcgtgattggcattttggcaccgggcaaagcgttggctcaagagctcaaagccgcagaagccaagacggacgcttcctccgtcatcgagagtgcccctgttcaagctgaagcatccaccagcgcggcggccaaggaagaagacattgccatggacgacggcaaatccgctgataccaagatccctggcattgtgctcgcagcggaaaagcgtatcaccagcaaattgctcgacaaggaagctggaggtggacgcgaaaagatcttcaacgttaacgacaacacactggcagcggttgcaggtataacagcggacgcgaactctctcgtgtcctttgcgcgcaacgccgcccaatcctacctctcctcctacaattccagcatgcctatcgaacaactcgtcaagcgcgtctgcgatctcaagcagggttacacccaatacggcggactgcggccgttcggcgtatccttcctgtttgccggctgggatccgctctaccagttccagctgtacggctcggacccatcaggcaactattccggctggaaggcatcgtgcatcggagcg

SEQ ID NO: 40842 - protein, 220 aa, Panicum virgatum
  misc_feature: Ceres CLONE 2004889
  misc_feature (91)..(220): Pfam Name: Proteasome Pfam Description: Proteasome A-type and B-type
  misc_feature: SWISSPROT Homolog: EC 3.4.25.1 Proteasome endopeptidase complex
MARRYDSKTTTFSPEGRLYQVEYAMESVSHAGCVIGILAPGKALAQELKAAEAKTDASSVIESAPVQAEASTSAAAKEEDIAMDDGKSADTKIPGIVLAAEKRITSKLLDKEAGGGREKIFNVNDNTLAAVAGITADANSLVSFARNAAQSYLSSYNSSMPIEQLVKRVCDLKQGYTQYGGLRPFGVSFLFAGWDPLYQFQLYGSDPSGNYSGWKASCIG

SEQ ID NO: 40843 - DNA, 659 bp, Panicum virgatum
  misc_feature: Ceres CLONE 2004894
  misc_feature: Encodes the peptide sequence at SEQ ID NO. 40844
atcacaccaccacaccgatctacaactgctccacacacagtcatcaatccgaccgacagagcaagatgtgcggcggtgcgatcctcgcggagctcatacccagcggcggccggaggggagcccccgccgcggcggcgaaggacgacgacttcgaggccgcattccaggacttcgacgagggctccgaggaagaggtcgtgatgctgacggagcgcgaggcgttcgcgcttggcgcccgcgcctccgccggggcccggcgcaacaggcgtccgagccggtaccacggcgtccggcggaggccctggggcaagtgggcggccgaggtccgcgaccccgtcaggggcgtccgcgtctggctcggcaccttcgccaccgccgaggccgccgcgcgcgcctacgacgacgcggcgcgcgacctccgcggcgccggcgccgagctcaacttcccgtcctccgccgacacggcgcgcacccgcaagcgccgcgccgccgccgcggtcgccaaggcgtcgacgtacggcgcctatgttgtcagcgcgcacgcgctgtcggccgaaaccagcgacgccatctcacgctacagcagctgcggctccctgccggacttctcgtggcagggcatgtccgcgaccgacgacggcgcggcgcggcctgatgat

SEQ ID NO: 40844 - protein, 197 aa, Panicum virgatum
  misc_feature: Ceres CLONE 2004894
  misc_feature (70)..(121): Pfam Name: AP2 Pfam Description: AP2 domain
MCGGAILAELIPSGGRRGAPAAAAKDDDFEAAFQDFDEGSEEEVVMLTEREAFALGARASAGARRNRRPSRYHGVRRRPWGKWAAEVRDPVRGVRVWLGTFATAEAAARAYDDAARDLRGAGAELNFPSSADTARTRKRRAAAAVAKASTYGAYVVSAHALSAETSDAISRYSSCGSLPDFSWQGMSATDDGAARPD

SEQ ID NO: 40845 - DNA, 1153 bp, Panicum virgatum
  misc_feature: Ceres CLONE 2004905
  misc_feature: Encodes the peptide sequence at SEQ ID NO. 40846
cactggagaaatttccattcgaagcgcagcctcgattcgattcccaattccccacccaccaccaccgtctctctctccacacccccatggccggctacccgccgcccggctccggctacccctacggccccgccgccgggggaagcggaggctacggcgccccgccgccctacggctcctcccccgccccctccgccccgccctacggcgacaagccccccaaggaaggcaagacctcctcctcctcctcctccgcgccgccctactacggcgccccgccctcctcccagccctacggcggcggcggcagcggaggctacggcgcccagcagtacggcgcgccctacggcgccccgccgccctcgtccgccccgccctacggcgcgccgcctcacgcgtccgcgccctacggggccgcgccgccggcgtacggggccccgggcgggtacggcgggagccccttcacgtcgctggtcccgtccgcgttcccgcccgggaccgaccccaacgtggtggcctgcttccaggcggcggaccgcgacggcagcgggatgatcgacgacaaggagctgcagtccgcgctctccggctacaaccagagcttcaacctccgcaccgtccacctcctcatgtacctattcaccaacgccaacgtccggaagatcgggcccaaggaatttacatctgtgttttacagtcttcagaattggagatcaatatttgaaaggtttgaccgtgatcggagtggtaagattgactcatcagaactgcgtgatgctcttctcagtctgggatattccgtctctccaactgtgctagacctccttgtgtctaaatttgacaagactgggggcaagagcagagcaattgaatatgataacttcattgaatgttgcctcactgttaagggactgacggagaagttcaaggagaaggacacggcatactccgggtctgcgacttttacttatgaggctttcatgctgaccgtgctccctttcctcatcgcctagtggcacagtacagagcaaaagctaaacataccatgccatttgtttaaaaatggttatgttcggagagttttttttggatttgattagtgttgcgaatcataaagttgatgggtgaaagctcagaaaatgctacaactgat

SEQ ID NO: 40846 - protein, 308 aa, Panicum virgatum
  misc_feature: Ceres CLONE 2004905
  misc_feature (207)..(235): Pfam Name: efhand Pfam Description: EF hand
  misc_feature: SWISSPROT Homolog: EC 3.4.22.53 Calpain-2
MAGYPPPGSGYPYGPAAGGSGGYGAPPPYGSSPAPSAPPYGDKPPKEGKTSSSSSSAPPYYGAPPSSQPYGGGGSGGYGAQQYGAPYGAPPPSSAPPYGAPPHASAPYGAAPPAYGAPGGYGGSPFTSLVPSAFPPGTDPNVVACFQAADRDGSGMIDDKELQSALSGYNQSFNLRTVHLLMYLFTNANVRKIGPKEFTSVFYSLQNWRSIFERFDRDRSGKIDSSELRDALLSLGYSVSPTVLDLLVSKFDKTGGKSRAIEYDNFIECCLTVKGLTEKFKEKDTAYSGSATFTYEAFMLTVLPFLIA

SEQ ID NO: 40847 - DNA, 916 bp, Panicum virgatum
  misc_feature: Ceres CLONE 2004916
  misc_feature: Encodes the peptide sequence at SEQ ID NO. 40848
atccatccacatccagtcacttcttatcgcataccactcttacatctcaaatcacctttcatctctcataccacatctaacctttcgcgttttcgcatctccaatccattcaaaatgcctccaaaagctgctgagaagaagcccaccaccggtggcaaggccccggctaaggctcctcccgctgagaagaaggaggccggaaagaagactgccgcagcaccatctggtgaaaagaagaagcgtggaaagacgaggaaggagacctactcttcatacatctacaaggtcctcaagcaagtccaccccgatactggtatctccaaccgtgccatgtccatcctgaactctttcgtcaatgacatcttcgagcgtgttgccactgaggcatccaagcttgcagcatacaacaagaagtctaccatctcttcccgagaaatccagacctccgtcagactcatcctacctggtgaacttgccaagcacgccgtgtctgagggcacaaaggctgtcaccaaatactcttcccaaagcaagtaaagtaacctagtcatggaggggtccaaatagggatgttacttggttcttgggttttcgcgtgtgatttcttatgcaatggggttgaggcacaatcggacacaggtgttctaaatgggttttgaagaacacaattacttatgatgcgtcatgggaatggggaataccgatgaatgcggccatggacatgggcctgctttttcatcaatcatcaatcatcaatgtcatgcttttacagctttcagagcttttgtttttcattattgaaaatggtgggaccatgtacaattattcaccaggctcaaagcatgacagcacagcatattccagctttgccttgaacaggactggatatgatcacagaaatccaaagcatgaaatc

SEQ ID NO: 40848 - protein, 140 aa, Panicum virgatum
  misc_feature: Ceres CLONE 2004916
  misc_feature (45)..(115): Pfam Name: Histone Pfam Description: Core histone H2A/H2B/H3/H4
  misc_feature: Useful for biocontainment applications
  misc_feature: Useful for making plants with modulated flowering time
MPPKAAEKKPTTGGKAPAKAPPAEKKEAGKKTAAAPSGEKKKRGKTRKETYSSYIYKVLKQVHPDTGISNRAMSILNSFVNDIFERVATEASKLAAYNKKSTISSREIQTSVRLILPGELAKHAVSEGTKAVTKYSSQSK

SEQ ID NO: 40849 - DNA, 637 bp, Panicum virgatum
  misc_feature: Ceres CLONE 2004918
  misc_feature: Encodes the peptide sequence at SEQ ID NO. 40850
gcctaactcaaccatccaatggcctccgcctccgccaccgccaccgtctccggcatcgtgtttccccacgccttcctctcccaccgctcgccgccgccgcaggtcgtcgccgtggcctcctcgttccgccggctctccctgtccgcctcccctcgctggatcacccacctagtcgcccgcgccgacgccagcgccgaagctgctggggaaccggagcctgaggctgaggccgagcctgccactgcctcagctgacgccgaggaaggggaggccgagggggctgtcgcggtggccgaggaagaggaggcagaggagccgccgccgccgccgagcaagccgaagtttaagttcggcgaaatcatcgggattctgaacaagcaattcattgaggctgagaaggtgaagactgtgccaggtctgaggcctggcgacatcgttgagcttaggatgcaacggcccaacaagaggagattgtcactctttaagggaataatcatcgcaaagcacaaagctggtgttcacaccacaatccgtgttagaaggatcattgctggtgtaggagttgagattaccttcccagtgtattcacccaggatcaaggagatcacagtaatcaggcacaagaaagtgaggcgag

SEQ ID NO: 40850 - protein, 206 aa, Panicum virgatum
  misc_feature: Ceres CLONE 2004918
  misc_feature (121)..(206): Pfam Name: Ribosomal_L19 Pfam Description: Ribosomal protein L19
MASASATATVSGIVFPHAFLSHRSPPPQVVAVASSFRRLSLSASPRWITHLVARADASAEAAGEPEPEAEAEPATASADAEEGEAEGAVAVAEEEEAEEPPPPPSKPKFKFGEIIGILNKQFIEAEKVKTVPGLRPGDIVELRMQRPNKRRLSLFKGIIIAKHKAGVHTTIRVRRIIAGVGVEITFPVYSPRIKEITVIRHKKVRR

SEQ ID NO: 40851 - DNA, 676 bp, Panicum virgatum
  misc_feature: Ceres CLONE 2004922
  misc_feature: Encodes the peptide sequence at SEQ ID NO. 40852
caaatgctccggttatgttgcctgttgaacctgcagaagaagagccaatttatgttaatgcaaagcaataccatgcaatccttaggaggagacagacacgtgctaaattggaggcccagaataagctggtgaaaggccggaagccataccttcatgagtctcgacaccgtcatgccatgaagcgagctcgaggatcaggagggcggttcctcaacacaaagcagctccaggagcagacccagcagcatcaagcatcaggtggttcgagctcctcaaaggtcattggcaacagcataagctcccagagtgaccccacccctgcaccttcaacttcaactccttcggacaccgcaagtgcttcaaaggccaaccaggaccgcacctgctttcctgttggcttgcgccctgccatgaacttcagtgcaccaggtggagaaggagcaaagctggttaggtgaaaaagtgaagtgggcatagaagcatcgccaggcacactgcctgcggcaactcatccttggcttttgaaacaatgaatatgcaatggacatgtagcttaagagtctcataataatcaaacggccgtatatatacaagtcctaagattgcactggctaaaagaactgtggttatgagtatgtttctagagactgaaatctatacatatggctggatgtgt

SEQ ID NO: 40852 - protein, 151 aa, Panicum virgatum
  misc_feature: Ceres CLONE 2004922
  misc_feature (13)..(69): Pfam Name: CBFB_NFYA Pfam Description: CCAAT-binding transcription factor (CBF-B/NF-YA) subunit B
  misc_feature: The sequence is a functional homolog of SEQ ID NO 2460 in the 10/374,780 US patent application
  misc_feature: The sequence is a functional homolog of SEQ ID NO 626 in the 10/412,699 US patent application
  misc_feature: The sequence is a functional homolog of SEQ ID NO 952 in the 10/225,066 US patent application
  misc_feature: The sequence is a functional homolog of SEQ ID NO 2132 in the 10/374,780 US patent application
  misc_feature: The sequence is a functional homolog of SEQ ID NO 668 in the 10/225,066 US patent application
  misc_feature: The sequence is a functional homolog of SEQ ID NO 1334 in the 11/479,226 US patent application
NAPVMLPVEPAEEEPIYVNAKQYHAILRRRQTRAKLEAQNKLVKGRKPYLHESRHRHAMKRARGSGGRFLNTKQLQEQTQQHQASGGSSSSKVIGNSISSQSDPTPAPSTSTPSDTASASKANQDRTCFPVGLRPAMNFSAPGGEGAKLVR

SEQ ID NO: 40853 - DNA, 615 bp, Panicum virgatum
  misc_feature: Ceres CLONE 2004930
  misc_feature: Encodes the peptide sequence at SEQ ID NO. 40854
ttcctttctctggtatatgctggtcaactcttgagcccattcgaagaaaactgcttggtcttgttggagaagaaggcaatgcagctagtgtattgggagcaaattttgctgctggctttgtagcaggtagtcttgctgctggtgctacatgccctctggatgttgcaaaaacaaggagacagatagagaaggatactgagaaggcaatgagaatgactacacggcaaacattaactgagatatggaggtctgcaggtgtgaaaggtttgttcactggggttggcccacgcgtggctcgtgctggtccatcagttggcattgtggtttccttttacgaggttgtcaaatatgctctccatcaaaggaacgcctcatgatccatatttgtcgagaagactgaactctcttgactctgtaaaaacaagacatacctctccctagaaagtacctctggttactccagggctccaagcatcggacggcagggctaggtgtcacttggaaagatcagagtactcagcatcgcacactcaacaaaggctttttcatggacgcagtccatttcagcctgataccatctcagttttgatttggtggagccggctccagttttgt

SEQ ID NO: 40854 - protein, 124 aa, Panicum virgatum
  misc_feature: Ceres CLONE 2004930
  misc_feature (30)..(122): Pfam Name: Mito_carr Pfam Description: Mitochondrial carrier protein
PFSGICWSTLEPIRRKLLGLVGEEGNAASVLGANFAAGFVAGSLAAGATCPLDVAKTRRQIEKDTEKAMRMTTRQTLTEIWRSAGVKGLFTGVGPRVARAGPSVGIVVSFYEVVKYALHQRNAS

SEQ ID NO: 40855 - DNA, 708 bp, Panicum virgatum
  misc_feature: Ceres CLONE 2004949
  misc_feature: Encodes the peptide sequence at SEQ ID NO. 40856
ctagcttcctcgtgccggatcactacgcctacgccttccctcttcctcttccacttcaactaccgagccaaccaaacaaacttctccagatgccgtttgaccaggaagaggctgagaaccatggcgtgatgccctcctccgaccattgtgggctataccagctgccggcactgccgttgggctgctctggcgccgcctcagccgcctgcggtgggaagcctacggcgggtttcatgcctagtactattagcgctgatgaggtctgcacctcgctgacgaaaggttgcaacgagatcagtaccagcacatggtggaagggctcggctaccatggcggagagagggaagatgaaggtgaggaggaagatgagggagccaaggttctgtttccagactagaagcgacatggatgtgctggatgatggctacaagtggaggaagtacgggcagaaggttgtcaagaacagcctccatccgaggagctacttccggtgcacgcacagcaactgccgcgtgaagaagcgggtggagcggctgtcgacggactgccgcatggtgatgaccacgtacgagggccgccacacgcactccccctgcagcgacgacgcctcctccggcgaccacaccgactgcttcagctccttctgaacctatacaccatccgccgccggcagtcaaaagtcgatcagaagcagccagatcgagcgca

SEQ ID NO: 40856 - protein, 214 aa, Panicum virgatum
  misc_feature: Ceres CLONE 2004949
  misc_feature (138)..(197): Pfam Name: WRKY Pfam Description: WRKY DNA -binding domain
  misc_feature: The sequence is a functional homolog of SEQ ID NO 1017 in the 10/412,699 US patent application
  misc_feature: The sequence is a functional homolog of SEQ ID NO 521 in the 10/374,780 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
SFLVPDHYAYAFPLPLPLQLPSQPNKLLQMPFDQEEAENHGVMPSSDHCGLYQLPALPLGCSGAASAACGGKPTAGFMPSTISADEVCTSLTKGCNEISTSTWWKGSATMAERGKMKVRRKMREPRFCFQTRSDMDVLDDGYKWRKYGQKVVKNSLHPRSYFRCTHSNCRVKKRVERLSTDCRMVMTTYEGRHTHSPCSDDASSGDHTDCFSSF

SEQ ID NO: 40857 - DNA, 737 bp, Panicum virgatum
  misc_feature: Ceres CLONE 2004970
  misc_feature: Encodes the peptide sequence at SEQ ID NO. 40858
ttgtggccaacttcgaaacatttcaaaggatgccctccacaaggatttcggaaaaaagattggtgatcttttatggaactattgcagaggaattgataattccgttgttggttctgttcaggaaacaaaatctgtgggtgctgaaatcaactggggagtcagatttaacgacaacaaagatgctgagcattttcttaccaacctctgcaaggaggtgtctctacgcttgcagggctgtggagttcagggacgaactattacccttaaggtgaaaacaagaagggaaggtgctggggagccaataaagtatatgggatgtggtgactgtgaaaccacaagtcgatccatgacgattgcaggtgcaacagacagttttgtcactctccagagagttgcaaaacaattattttcagctcttcatcttgatgtgaaggaagttcgtggagtaggattggcaatgtcaaagcttgagcatgcagatggatgaagtgctggctgcagttgcagagactataaagaactttgcagttatctacctcgttgacatcacggaggttcctgacttcaacacgatgtatgagctgtatgatccatcaaccgtgatgttcttcttccggaacaagcacatcatgattgatctcgggacaggaaacaacaacaagatcaactggggcttgaaggacaagcaggagttcatcgacattgtggagactgtgtacaggggttgcccggaaggg

SEQ ID NO: 40858 - protein, 161 aa, Panicum virgatum
  misc_feature: Ceres CLONE 2004970
  misc_feature: SWISSPROT Homolog: EC 2.7.7.7 DNA-directed DNA polymerase
CGQLRNISKDALHKDFGKKIGDLLWNYCRGIDNSVVGSVQETKSVGAEINWGVRFNDNKDAEHFLTNLCKEVSLRLQGCGVQGRTITLKVKTRREGAGEPIKYMGCGDCETTSRSMTIAGATDSFVTLQRVAKQLFSALHLDVKEVRGVGLAMSKLEHADG

SEQ ID NO: 40859 - DNA, 471 bp, Panicum virgatum
  misc_feature: Ceres CLONE 2004978
  misc_feature: Encodes the peptide sequence at SEQ ID NO. 40860
gtctccccccgtctgcgcagcccccagatccggcgccgtccgctcctcgatccccgcgcccgcaggtcggggggtttgcgcgccccgggcaccggaggaggaggagcggcatggcggcgccgccggcaagggcccgggccgactacgactaccttattaagctgctcctcattggggatagcggtgttggcaagagttgcctcctattgcggttctccgatggttccttcactacaagctttattaccacaattggtattgattttaagataagaacaatagagttggatggcaaacgcatcaagctacagatttggggtacagtggccattccgcacccatggggaaaaagacgacgacgatgacgagtttgttaggggctgtattttctgttgctgatatgggtgtttaaggtccgcattgtgtttgttgttaaagtttattatgaggttatagtattttgtcgagaat

SEQ ID NO: 40860 - protein, 84 aa, Panicum virgatum
  misc_feature: Ceres CLONE 2004978
  misc_feature (17)..(84): Pfam Name: Ras Pfam Description: Ras family
  misc_feature: Useful for making plants with altered lignin content
  misc_feature: Useful for making plants with modulated oxidative stress sensitivity
MAAPPARARADYDYLIKLLLIGDSGVGKSCLLLRFSDGSFTTSFITTIGIDFKIRTIELDGKRIKLQIWGTVAIPHPWGKRRRR

SEQ ID NO: 40861 - DNA, 511 bp, Panicum virgatum
  misc_feature: Ceres CLONE 2004980
  misc_feature: Encodes the peptide sequence at SEQ ID NO. 40862
accattacagtacgcactccggctgacgcgccccgcactctctcacaaagctcaagcctttcgctcgctcgctcgctcgcggctacatctacaatggcgcgcttccagctcgcggccctggccatggccatgctcatcgccgcggcggcggcgcaggccccggccgcccccccgacgccggcgcccagggcgtcccccccgccggcgacccctccgccgacaccggagccggggtctccgcccgcacaggcccacgacggacaaccaccggacccagatgaggatgcgcaggaccagtacggagaagacctgggaaagcgtatgccgcaacgaccgacctgcgcagtacaatgaagggtctggaaatctgcaccatgaacagcaggaacacttgaacagcaaggacaccgggaatcaatacaatgagacagcggcaaattcttagccacgaagagctggagaatgcatacaatgggcacaggagtcagcaggacaattctcagatcaatgc

SEQ ID NO: 40862 - protein, 86 aa, Panicum virgatum
  misc_feature: Ceres CLONE 2004980
  misc_feature: Useful for making plants with altered carbohydrate content
MARFQLAALAMAMLIAAAAAQAPAAPPTPAPRASPPPATPPPTPEPGSPPAQAHDGQPPDPDEDAQDQYGEDLGKRMPQRPTCAVQ

SEQ ID NO: 40863 - DNA, 645 bp, Panicum virgatum
  misc_feature: Ceres CLONE 2004988
  misc_feature: Encodes the peptide sequence at SEQ ID NO. 40864
aaaaaaaaaaaaaaagagagaccgcgtgcgaaccaagcagaccccagccgaagtagcgaaagcgaagtcgtcgccggagcaggaggaggaggaagcgcgccggagcaagatgtcgtggcagacgtacgtcgacgagcacctgatgtgcgagatcgaaggccagcatctcacctccgccgccatcgtaggccacgacggcagcgtctgggcgcagtccccgaacttcccccagtacaagcctgaagagattgctgccatcatgaaggacttcgatgagcctggtactcttgcaccaactggtctttttcttggaggcacaaaatacatggtgatccaaggtgaacctaatgttgtcatccgaggaaagaagggcactggaggcatcactgtcaagaagacgaccctagccttgatcattggtatctatgatgagccaatgactccagggcaatgcaacatgatagtggagaggctcggcgactacctgatcgagcagggtttctaagtttgtcatatgttattttggtcatttggcacttaagtttgcacctcatttggttcagtaatctgtgggcttgctcatctacttggcgaatcacattatattgcatgcagtgaataattagcttgggtttgtttgttggt

SEQ ID NO: 40864 - protein, 131 aa, Panicum virgatum; identical to SEQ ID NO: 11964
  misc_feature: Ceres CLONE 2004988
  misc_feature (2)..(126): Pfam Name: Profilin Pfam Description: Profilin
  misc_feature: Useful for biocontainment applications
  misc_feature: Useful for making plants with modulated biomass

SEQ ID NO: 40865 - DNA, 685 bp, Panicum virgatum
  misc_feature: Ceres CLONE 2004991
  misc_feature: Encodes the peptide sequence at SEQ ID NO. 40866
cttacagtagcttttctcatcaacatatctatcatatctgttagtggtgctgtctgcggttcaggtaatttgaaccctgaagatcaggcaaactgcagtgatctggatcttaacaaggcttcatttttgttaaagaatgtccttggaacctggagctcaaagttgtttgcagttgccttgttggcgtctggtcagagttctacaattacaggaacttatgctggacaatacgtcatgcagggggttttagatcttcggatgaaaccctggatacggaatcttctaactagatccttggctattctgccaagtttgatcgtgtcagtaattggtggttcctcagcagctggccagttgattatcattgcgtcgatgatactgtcattcgaactccctttcgctctagtaccactccttaaattcaccagtagcaaaacaaagatggggcagcacacaaattcagtatttacttctgtgctaacatggatgatcggttcatttatcgtcgtcatcaacacctacttcctgattacaagctttgtcaaattgctcctccacagcgggctgtccaccgtttcccaagtattttctgggattttcggtttcctgggcatgctcatatacatagctgcaatcctgtacctcgtcttccagaagaacaggaagtccacccagccattgctgg

SEQ ID NO: 40866 - protein, 228 aa, Panicum virgatum
  misc_feature: Ceres CLONE 2004991
  misc_feature (1)..(155): Pfam Name: Nramp Pfam Description: Natural resistance-associated macrophage protein
LTVAFLINISIISVSGAVCGSGNLNPEDQANCSDLDLNKASFLLKNVLGTWSSKLFAVALLASGQSSTITGTYAGQYVMQGVLDLRMKPWIRNLLTRSLAILPSLIVSVIGGSSAAGQLIIIASMILSFELPFALVPLLKFTSSKTKMGQHTNSVFTSVLTWMIGSFIVVINTYFLITSFVKLLLHSGLSTVSQVFSGIFGFLGMLIYIAAILYLVFQKNRKSTQPLL

SEQ ID NO: 40867 - DNA, 1014 bp, Panicum virgatum
  misc_feature: Ceres CLONE 2005007
  misc_feature: Encodes the peptide sequence at SEQ ID NO. 40868
ggaaaccggccgccgcacgccccttgaggacccaaacaactcggcaaccatgtcgtcgtcggcgttcctcgccgcccggctcctccgccgcgccgccaccgcctcctcgtcctctcctctctccgccctagcccgccgcgccctccacttgggctgtgcccccgttcccctcccgcgccgtctccccgccgccgccgccgccgccgccgccgccgccgcctcgtcgcccgcggccgccgcccgccggtttctggcgtcgcagtctccggcgtccgcctccaaggactccgccgacgagaacctgaggcgggtcatcgagtcggagatcgagtgcgtcgtccagtcggaggagagcttagccgacaagcacattgaactaccagatgacttcccttttgaggtcatagacaatcctggtgatcaatccataaccctcaaaagagagtttgctggtgagacaattaaagctgctgtctacaccaactttgatacagaggaagaattggatgaggatgatgggagtgacaatgacgaggaatctttcaagccagcaattcagatggttgtcactattcaaaaaccagaaggtccaatcctggaatttgactgcaactttaatgatgatgaactggcaattgaaagtatgagggtgctgaaccgtgatgaccctgatgctcagaatatgtatgagggaccaccattttcggacttggatgagagcttgcagaaggccttgcataggtaccttgaggcgagggggatcaagcactcactgcatgactggttgtacgagtacatgatgagaaaggatgagaaggagtatgtggtctggttgaagaacatgaaggagttcattggaaactgagtccctctgcctgttagttcccttttgttgggagaataagccttgcagttatcaccaaatttctgatcataattgcgcaaatatacctctcatggcaacacataccttgctgctccaagattttttgttgacctggttattcgttacgg

SEQ ID NO: 40868 - protein, 271 aa, Panicum virgatum
  misc_feature: Ceres CLONE 2005007
  misc_feature (89)..(269): Pfam Name: MAM33 Pfam Description: Mitochondrial glycoprotein
MSSSAFLAARLLRRAATASSSSPLSALARRALHLGCAPVPLPRRLPAAAAAAAAAAASSPAAAARRFLASQSPASASKDSADENLRRVIESEIECVVQSEESLADKHIELPDDFPFEVIDNPGDQSITLKREFAGETIKAAVYTNFDTEEELDEDDGSDNDEESFKPAIQMVVTIQKPEGPILEFDCNFNDDELAIESMRVLNRDDPDAQNMYEGPPFSDLDESLQKALHRYLEARGIKHSLHDWLYEYMMRKDEKEYVVWLKNMKEFIGN

SEQ ID NO: 40869 - DNA, 719 bp, Panicum virgatum
  misc_feature: Ceres CLONE 2005050
  misc_feature: Encodes the peptide sequence at SEQ ID NO. 40870
agccagcacattgtggaagacttccgtgactacgccaacatatgctttagggagtttggagacagggtcaagaactgggtaacattcaatgagccttggagtttcagtgttggtggctatgccagtggtatattagcacctggcagatgctcctcttggaaaaattcaggatgtagcattggagactctggaaaggaaccttacattgtagctcataaccaacttctcgctcacgcagcagcggttcaggtgtacagagacaaataccaggggaaacaaaaaggaaaaataggaattactctagtcagtaattggatttttccatactcaaattccaagaaagacaaggacgctgccaagcgtgcactggaatttatgtatggttggttcatggatcctttaactaagggagattatccactcagtatgaaaacattagttggtaatagattaccaagattaacgaaagaacagtcaaaggcaataaatggatcgttcgacttcatcggtctcaactactatacagcaagatacatacagagtaccaactacagtaacagtgtaaacaaaagctatagtactgattcactgaccaatcaaacagttgaaagacatgggacagctattggtccaaaggctggatctccttggctctacatctatccaaaaggtatagaagagctcctgctatacaccaagaagacgtacaacaatcctac

SEQ ID NO: 40870 - protein, 239 aa, Panicum virgatum
  misc_feature: Ceres CLONE 2005050
  misc_feature (1)..(239): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
  misc_feature: Useful for making plants with modulated biomass
SQHIVEDFRDYANICFREFGDRVKNWVTFNEPWSFSVGGYASGILAPGRCSSWKNSGCSIGDSGKEPYIVAHNQLLAHAAAVQVYRDKYQGKQKGKIGITLVSNWIFPYSNSKKDKDAAKRALEFMYGWFMDPLTKGDYPLSMKTLVGNRLPRLTKEQSKAINGSFDFIGLNYYTARYIQSTNYSNSVNKSYSTDSLTNQTVERHGTAIGPKAGSPWLYIYPKGIEELLLYTKKTYNNP

SEQ ID NO: 40871 - DNA, 546 bp, Panicum virgatum
  misc_feature: Ceres CLONE 2005058
  misc_feature: Encodes the peptide sequence at SEQ ID NO. 40872
acggtgaaaaagaaattcaaatccatcccccaatgttccatcggcacccaaatccttcttctccaccaaatccgtagtggagcagcaccagccgcagccgcagatgccgccgccgatggcgccgaacagctaccagcagtaccagcagcagctgcaccaggcgcaccagctcttccagcgggacgcgcagaccatcacccccgaggcgctgcagagcgtcaaggctgccctcgccaccagcgacgtcctcgaccccgccgccagcgccagcgccaggccctccgatccctccgccagcaagaagcccatcccccgccgcgccgcaggacagtcctgggaggaccccaccctcaccgactggcccgaaaatgattataggctgttctgtggagatctaggcaacgaagttaatgacgatgtcctctccaaagctttctcacggttcccctccttcaacatggcaagggttgttagagataagaggactggcaaaactaaaggttatggatttgtgagcttttcaaaccctactgatctggctgcagc

SEQ ID NO: 40872 - protein, 147 aa, Panicum virgatum
  misc_feature: Ceres CLONE 2005058
  misc_feature: SWISSPROT Homolog: EC 5.2.1.8 Peptidylprolyl isomerase
MPPPMAPNSYQQYQQQLHQAHQLFQRDAQTITPEALQSVKAALATSDVLDPAASASARPSDPSASKKPIPRRAAGQSWEDPTLTDWPENDYRLFCGDLGNEVNDDVLSKAFSRFPSFNMARVVRDKRTGKTKGYGFVSFSNPTDLAA

SEQ ID NO: 40873 - DNA, 661 bp, Panicum virgatum
  misc_feature: Ceres CLONE 2005060
  misc_feature: Encodes the peptide sequence at SEQ ID NO. 40874
gatctcaaacgccactcctccttctcttctccctctcctctcgtctcggcctcaggatcatcagcggcaatggcgatggcgtcgtcgagcgggctccggagctgcagcgccgtcggcgtgcccagcctgctggcgccgtcgtcgtcgcgcgccgggcggctgccgttctgtgccagcgccaccacctccggccgcgtcatcatgtccgccgagtggatgcccggccagccccgccccgcccacctcgacggctccaaggaccccgtcaagttcgaggagtacaagctcaaggagatcaagaacggccggctggcgatgctggcgttcgtggggttctgcgtgcagcagtcggcgtacccgggcacggggccgctggagaacctggccacccacctcgccgacccgtggcacaacaacatcggcgacatcatcatccccagaacgatctacccttgagctgatgagaccacggcggcggcgaagaacggagatgagacgagacgacgggcggacggaaagtgtgtactggatagatcaatggtgttttctgtgtgtggattactgctgggcactgcctgcgtgcgtgcagcaactgtacaacgaacgacggcggcggcgactttccggccgtcggccgggaacacattgtccttgtgtaatg

SEQ ID NO: 40874 - protein, 128 aa, Panicum virgatum
  misc_feature: Ceres CLONE 2005060
  misc_feature (4)..(94): Pfam Name: Chloroa_b-bind Pfam Description: Chlorophyll A-B binding protein
MAMASSSGLRSCSAVGVPSLLAPSSSRAGRLPFCASATTSGRVIMSAEWMPGQPRPAHLDGSKDPVKFEEYKLKEIKNGRLAMLAFVGFCVQQSAYPGTGPLENLATHLADPWHNNIGDIIIPRTIYP

SEQ ID NO: 40875 - DNA, 684 bp, Panicum virgatum
  misc_feature: Ceres CLONE 2005062
  misc_feature: Encodes the peptide sequence at SEQ ID NO. 40876
ctttcttccccgcaaagaaagaaagagcagcagcagcggaacgagagcgaagcagcagcagcgacgatggcgagcggcggcatgaagagggagatcagcgagacccacgacgccctccgcttcggcatcaacgccggcgtcaaggccgacctcgctccgccgcacccgctccagtccaccatccagtcggaggccaaattctgggcggacaagaaaaagttcgggacggaggccatctacggatccgccttcaacatccgcaaggatctcgatgcccaaatcctctccaggttccaaaggccccctggtgctttgccatcatctatgcttggatatgaggcactgacaggttccctggatgattttggatttgaagattatcttaacatgcctcaagattctgacagtttccgtcaacctgacttgcaccatggaatggaggttcgccttggcttatccaagggacctatctgcccttgcttcaattgatccatccatgtagttctgcagtacgttgtgcacctcagtccagtgcgtcggtcaatagaccatattatcatagtgaaaagtgaaaagtgaaaaccgacgaggctagcacctgttcaatgttcagtgtcatgtttcagtcaacacagaatttagctcttatccctatttgagcacacatttgatggttggtctgcc

SEQ ID NO: 40876 - protein, 140 aa, Panicum virgatum; identical to SEQ ID NO: 27076
  misc_feature: Ceres CLONE 2005062
  misc_feature (2)..(131): Pfam Name: UMP1 Pfam Description: Proteasome maturation factor UMP1

SEQ ID NO: 40877 - DNA, 665 bp, Panicum virgatum
  misc_feature: Ceres CLONE 2005072
  misc_feature: Encodes the peptide sequence at SEQ ID NO. 40878
aacacgccgacgccgatcgatccagctccgatcccaccgacgtcttctccttcccgcccgccacttcagcttgcgctgctttgatcttctccccggaggccatggccgctgagactgttgtactgaaggttgctatgtcatgcgagggttgcgctggggcggtcagaagagtgctcaccaagatggaaggagttgagaccttcgacatagacctcaaggaacagaaggtgacagtcaaaggcaatgtcaagcctgaggatgtcttccagacggtttccaagtcagggaagaagacctcctactgggagggcgaagccacagccccgccggcttcggctccagcagcagaagtagctccaagcaccgcgacggaatccgccgcggcagaagcacctgcaacggaggctgcaccagagataaccccagccaaagctgacgcttgaccgtcacatgtgatgctgtgaccccctaaaccttactctagaactagctgggaaactgagtttatggggtttgcatcatgttattgccactctagcaagtgactacgaattatggaataaatgataaaacccagtgtatgtgatttcaagatgaacacatcccttgcaggattcttgttcactatacatttaccattgcttttgagttccccctaacacttc

SEQ ID NO: 40878 - protein, 113 aa, Panicum virgatum
  misc_feature: Ceres CLONE 2005072
  misc_feature (6)..(67): Pfam Name: HMA Pfam Description: Heavy-metal-associated domain
  misc_feature: SWISSPROT Homolog: EC 3.6.3.4 Copper-exporting ATPase
MAAETVVLKVAMSCEGCAGAVRRVLTKMEGVETFDIDLKEQKVTVKGNVKPEDVFQTVSKSGKKTSYWEGEATAPPASAPAAEVAPSTATESAAAEAPATEAAPEITPAKADA

SEQ ID NO: 40879 - DNA, 632 bp, Panicum virgatum
  misc_feature: Ceres CLONE 2005073
  misc_feature: Encodes the peptide sequence at SEQ ID NO. 40880
atcacacgccgccgccgcagccgtcatcggtctcccgcgctccccttcgagagatcaagttgctgctgctgtagtcccccaaccgtcaccatgcagaacgaggagggtaagacggtggacctctatgtccccaggaagtgctccgccactaacaggatcattactgccaaggatcacgcctctgtccagatcaacattggtcacttggatgcgaatggcatgtatgatggtcactttaccacattcgctctctctgggtttgtccgcgctcagggtgatgctgacagctcgttggacaggctgtggcagaagaggaaggctgagatcaagcagtagatctcgttcatagtttcactaagaatcgactcttgagggatgctgccttagctatgttttgatttcatgtctccacaccgttgggatacaatgctgtgatttcagttggtatcttaaatctaaagacttaatatcgtttgttggattcctaatgagttttgatgtgtcctggtcacgttgtcaaatgaaagtagcttaactcccttctgcagcgacattgcgtaactagatctcagaatttatgatgattgtggtttcagatttttttttatgctaagcacaagtgttgcctcttc

SEQ ID NO: 40880 - protein, 81 aa, Panicum virgatum
  misc_feature: Ceres CLONE 2005073
  misc_feature (1)..(81): Pfam Name: Ribosomal_S21e Pfam Description: Ribosomal protein S21e
MQNEEGKTVDLYVPRKCSATNRIITAKDHASVQINIGHLDANGMYDGHFTTFALSGFVRAQGDADSSLDRLWQKRKAEIKQ

SEQ ID NO: 40881 - DNA, 1140 bp, Panicum virgatum
  misc_feature: Ceres CLONE 2005085
  misc_feature: Encodes the peptide sequence at SEQ ID NO. 40882
aaaaccccattcgttagggtttatcgccgcggcgcgccgcttcccgtcctcctctacccgccgcttccggccttccactaccctctcgaagcttccactgctccacagccccacccatatcaaccccaaccccctcccgtctcgtcgccaccgagacgccgccccgcgaagtactcgccgagcctctgcagccatgtcgactttctggggcgtggagattaagcctgggaagccctacaagctcacccacagcgactgcggcggccgcctgcgcctcacccaggcaaccctgggggatgaggtcgtcaagggggagaagggtgccggccggaagaagtgtgtgctacagtgcagtgtcgagagcaaggaccccgtttacctttgtgccctggtgccggagcagtgcgaaacatgccacatggagctcgagttcgatgaggaggaagtcactttttcggtgatcgggcagaggagcgtccatctcgttggatactacatcgctgatgcgaatgaggaagatatgagtcacagcggttctgagagtgactctcttcaaggctcagatgaggatggtttcttggaggatgatgatgataataataacatggttatgggatattcagacagtgaagatgattcggactatgattcagagtctgatgatgaagagatggaatacaatcagcctaagggcaaaagttcagttgttattgaggaaattcaagaggatgagaagccttctgcgggcgaagggcacaagggatcaaacaagaagcagagcggtgaaaatggtgataagtctcaacttcagcttgttgtgagggctcctgctactgaatccttggaaagtgaagatgaagatggctttcctgtatcgttctctgaatcaaagagttctgagagtgtgtcgaagaaaaaaggggggaaagacaaggaggctagcaatgaagaccggaaaaggaaaagtggagccattactgatcttggcgactcttcaggggatgtaaaggctgaagatgatggggcatcaaagaaaaagaaaaagaccaaggacaaaagcactgctatggacaacagaaaggtaaatgatgatgtaaaggagattaagcaacaagtttctcctgctgatcctgttagtgc

SEQ ID NO: 40882 - protein, 315 aa, Panicum virgatum
  misc_feature: Ceres CLONE 2005085
  misc_feature: SWISSPROT Homolog: EC 5.2.1.8 Peptidylprolyl isomerase
MSTFWGVEIKPGKPYKLTHSDCGGRLRLTQATLGDEVVKGEKGAGRKKCVLQCSVESKDPVYLCALVPEQCETCHMELEFDEEEVTFSVIGQRSVHLVGYYIADANEEDMSHSGSESDSLQGSDEDGFLEDDDDNNNMVMGYSDSEDDSDYDSESDDEEMEYNQPKGKSSVVIEEIQEDEKPSAGEGHKGSNKKQSGENGDKSQLQLVVRAPATESLESEDEDGFPVSFSESKSSESVSKKKGGKDKEASNEDRKRKSGAITDLGDSSGDVKAEDDGASKKKKKTKDKSTAMDNRKVNDDVKEIKQQVSPADPVS

SEQ ID NO: 40883 - DNA, 699 bp, Panicum virgatum
  misc_feature: Ceres CLONE 2005101
  misc_feature: Encodes the peptide sequence at SEQ ID NO. 40884
attcaattgactctgctatgaatgatggtggattcttgaacagaacttcatggccgcctgctcctctaaagaggatgagaacatttaccaaggtgtataaacgtggagctgttggccggtccatcgacattagtcagtattctggatacgatgagttgaagcatgctctggctcgtatgttcagtattgaggggcaacttgaggaacggcagagaattggctggaaacttgtctacaaggatcatgaggatgacatcctactccttggtgatgacccatgggaggaatttgtcaactgtgtgaggtgcattaggatcctgtcgcctcaggaagtgcagcagatgagcttggatggtgatctagggaacaacattctacctaatcaggcctgcagcagctcagatggtgggaacgtctggagggctcgctgcgatcagaactctggtaacccttctaatggttcatatgaccagtttgaatgacctaacctgccggtccatacatgttgtgctgtgctggtccaagtaggcgtcatctgaatggtcgtaggcgaaaggcgtgcattggcagaatgttgtgtagatgtgttaccagtttacatccttgagagcaaatggctccatggattagtagtgtttttgttcatatgtgtaggttttctcacatggaagagaaataggggatgtaaatgaagcttac

SEQ ID NO: 40884 - protein, 159 aa, Panicum virgatum
  misc_feature: Ceres CLONE 2005101
  misc_feature: Useful for making plants with modulated light quality sensitivity
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
SIDSAMNDGGFLNRTSWPPAPLKRMRTFTKVYKRGAVGRSIDISQYSGYDELKHALARMFSIEGQLEERQRIGWKLVYKDHEDDILLLGDDPWEEFVNCVRCIRILSPQEVQQMSLDGDLGNNILPNQACSSSDGGNVWRARCDQNSGNPSNGSYDQFE

SEQ ID NO: 40885 - DNA, 693 bp, Panicum virgatum
  misc_feature: Ceres CLONE 2005109
  misc_feature: Encodes the peptide sequence at SEQ ID NO. 40886
acacataacatagccatcagtaggaaaggaaatccaagcaacaaacttggcaccaccctgttcctgccaagagaaacaaccatgagacctcaggtgttgctcgccacactggctgctgtcgccgtcctcgcagctctgccactcatgagcaaagggagcgaggaggcaggagtggcagccgccggcgacgagaacgcgagcccatggccgtgctgcgaccagtgcgacttctgcttcaggtcgaacccgcccaagtgccggtgcctcgacatctcgcgccaaggttgccacccgtcgtgccgaaactgcgtcaagtacagagccgtcggtagcgcccacgagctgcccgtctaccgctgcgccgacaccctcaccaactactgcgagcgccgctgcacgccggccgccgccgccgctgcataatattatctgaatgaacgctgccagcgacctctgattatcagctagctttgccttctcctcctgcgtgcttcgtcagagaagaaaggcttcctttgcttgctcatcgttttctactgttactggaataaagagctgtgtgctgtgcgtacatgctcagagctcaagtgtttgtgttgcttcgtggcatgtactagcgctgtgttgtcatggcgggtaatctggtgtcatgtgtttgttgttgtaatgcctggtctgagaagtataactttc

SEQ ID NO: 40886 - protein, 113 aa, Panicum virgatum
  misc_feature: Ceres CLONE 2005109
  misc_feature (44)..(70): Pfam Name: Bowman-Birk_leg Pfam Description: Bowman-Birk serine protease inhibitor family
MRPQVLLATLAAVAVLAALPLMSKGSEEAGVAAAGDENASPWPCCDQCDFCFRSNPPKCRCLDISRQGCHPSCRNCVKYRAVGSAHELPVYRCADTLTNYCERRCTPAAAAAA

SEQ ID NO: 40887 - DNA, 772 bp, Panicum virgatum
  misc_feature: Ceres CLONE 2005123
  misc_feature: Encodes the peptide sequence at SEQ ID NO. 40888
gagagaccgcgtgcgaaccaagcagaccccagccgaagtagcgaaagcgaagtcgtcgccggagcaggaggaggaggaagcgcgccggagcaagatgtcgtggcagacgtacgtcgacgagcacctgatgtgcgagatcgaaggccagcatctcacctccgccgccatcgtaggccacgacggcagcgtctgggcgcagtccccgaacttcccccagtacaagcctgaagagattgctgccatcatgaaggacttcgatgagcctggtactcttgcaccaactggtctttttcttggaggcacaaaatacatggtgatccaaggtgaacctaatgttgtcatccgaggaaagaagggcactggaggcatcactgtcaagaagacgaccctagccttgatcattggtatctatgatgagccaatgactccagggcaatgcaacatgatagtggagaggctcggcgactacctgatcgagcagggtttctaagtttgtcatatgttattttggtcatttggcacttaagtttgcacctcatttggttcagtaatctgtgggcttgctcatctacttggcgaatcgcattatattgcatgcagtgaataattagcttgggtttgtttgttggtaacaatgttggaaaagagtctgaattggggtttatgtttggcctcgcgtcatatcaaactcagctgctgtttcactgagtaatgtacattttcctggtcatgctacttgtgggatctgctgctgtatggagatgagtgcttt

SEQ ID NO: 40888 - protein, 131 aa, Panicum virgatum; identical to SEQ ID NO: 11964
  misc_feature: Ceres CLONE 2005123
  misc_feature (2)..(126): Pfam Name: Profilin Pfam Description: Profilin
  misc_feature: Useful for biocontainment applications
  misc_feature: Useful for making plants with modulated biomass

SEQ ID NO: 40889 - DNA, 689 bp, Panicum virgatum
  misc_feature: Ceres CLONE 2005136
  misc_feature: Encodes the peptide sequence at SEQ ID NO. 40890
aagactgctctccccttcggcccttccccttccccttccccgtcccctggtccgtctccgcccagatccagatccagggttcaatcaccacaccaggataagcaaccgagacaatggcggcagactctggagctcgtaggcagccaaccttcaccaaggttgaccagctgcgcccggggacccatggccacaacctcatcgtcaaggtagttgactccaagatggtcgtccagaggggccgcgagggagggcagcagggcaggcagatgaggatcgctgagtgcttggtcggcgatgaaaccggcatcatcgtcttcaccgcaagaaacgaccaagtggatgtaatgaagcttggaacaactgttgaactgaggaatgcaaagattgacatgttcaagggttcgatgcggctcgcggtggacaagtggggaattgtgaaagctgctgaaagcccagctgagtttgccgtcaaggaggacaacaacctgtccttgattgagtttgagctggtgaccgtggtggagtgaagaccaccttttgtaggagggtggtgcgttatgttatgttgttgaacctatttggcaccaccaaagaaaatgaaccagtcatggttgatgttatcgcatgcatccgaggttggttatggttagtgatcgtcggcaatggacggcatctctctgagattgtag

SEQ ID NO: 40890 - protein, 137 aa, Panicum virgatum
  misc_feature: Ceres CLONE 2005136
  misc_feature: Useful for making plants with modulated drought sensitivity
  misc_feature: Useful for making plants with modulated water use efficiency
MAADSGARRQPTFTKVDQLRPGTHGHNLIVKVVDSKMVVQRGREGGQQGRQMRIAECLVGDETGIIVFTARNDQVDVMKLGTTVELRNAKIDMFKGSMRLAVDKWGIVKAAESPAEFAVKEDNNLSLIEFELVTVVE

SEQ ID NO: 40891 - DNA, 917 bp, Panicum virgatum
  misc_feature: Ceres CLONE 2005165
  misc_feature: Encodes the peptide sequence at SEQ ID NO. 40892
atccatcctccatccaatccaagcgaacagagctgcaagcaaaggggaaagcagcagcgtgggcaatggcggcgacgcaccagccagtgctgccctgcttcctgctcctgctgctcctcactgccggcgccgcgggcgcggggcgacacgccggcggccggacgctggtcttcatcctggcggggcagtccaacatgagcggccgcggcggcgccaccagcggcacctgggacggcgtcgtgccgcccgagtgcgcgccgtcgccgcgcatcctccgcctctcccccgcgctccgctgggaggaggcgcgcgagccgctgcacgccggcatcgacgtcggcaacgtcctcggcgtcgggcccggcatgcccttcgcccacgccgtgctcggcaaggtcgttccggcgagggccgccgccgtggggctcgtcccctgcgcgcagggcggcacgccgctcgccaactggacgcggggcacggagctgtacgaccagatggtgacgcgcgccagggcggccctgggygggggcggygagctggccgccgtgctgtggtaccagggggagaccgacgccatgaagaaagaggacgccgagctctaccaggggcgcatggaggcgctcgtgcgcgacgtccgccgcgaactcggtcgcccggacctcctcgtcatccaggtcgggatcgcgacggcgcagtacggcggcaagttcctcgaccgcgtcagggaagcccagaaggccgtcacgctctcgctccggaatgtcaagtacgtcgacgccatggggctgcccatcgcgagtgacaacacgcatcttaccactgaggctcaggtccagctcggcaacatgctagccaagtcctacttagaaactctgtaaactctaattggtcaatcgaatgaacacattgttcctgcc

SEQ ID NO: 40892 - protein, 270 aa, Panicum virgatum
  misc_feature: Ceres CLONE 2005165
  misc_feature: Useful for making plants with altered cell wall content and/or composition
MAATHQPVLPCFLLLLLLTAGAAGAGRHAGGRTLVFILAGQSNMSGRGGATSGTWDGVVPPECAPSPRILRLSPALRWEEAREPLHAGIDVGNVLGVGPGMPFAHAVLGKVVPARAAAVGLVPCAQGGTPLANWTRGTELYDQMVTRARAALGGGGELAAVLWYQGETDAMKKEDAELYQGRMEALVRDVRRELGRPDLLVIQVGIATAQYGGKFLDRVREAQKAVTLSLRNVKYVDAMGLPIASDNTHLTTEAQVQLGNMLAKSYLETL

SEQ ID NO: 40893 - DNA, 723 bp, Panicum virgatum
  misc_feature: Ceres CLONE 2005185
  misc_feature: Encodes the peptide sequence at SEQ ID NO. 40894
gcctcacctcactcccgaattcccccagcaaatcaaatcctccccccaaatccccccgccgccctttccctctcgccgccggctcgccgtcctcagcacccgccgagccccgatggcccgcacgaagcagacggcgcgcaagtcgacgggcggcaaggccccgcggaagcagctggcgaccaaggcggcgcgcaagtcggccccggcgacgggcggcgtgaagaagccccaccgcttccgccccggcaccgtcgcgctccgcgagatccgcaagtaccagaagagcacggagctgctcatccgcaagctccccttccagcgcctcgtccgcgagatcgcgcaggacttcaagactgacctccgcttccagtcctccgccgtcgccgcgctgcaggaggccgccgaggcctacctcgtcgggctcttcgaggacaccaacctctgcgccatccacgccaagcgcgtcaccatcatgcccaaggacgtccagctcgcgcgccgcatcaggggcgagagggcctgagcgggccccaccgccttcctcgccgttgtcgatccctccttctcgtgctgtctgcttgtaggatctgtgcttctcttgggttccttctggtggcatgttattagtactagtatcgttgtggttgtgttcgtagtgccaggagttgtgttcggtcgctgggtaacctgctagtttattttgccctgatgcagcttgctgta

SEQ ID NO: 40894 - protein, 136 aa, Panicum virgatum
  misc_feature: Ceres CLONE 2005185
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDVQLARRIRGERA

SEQ ID NO: 40895 - DNA, 253 bp, Panicum virgatum
  misc_feature: Ceres CLONE 2005186
  misc_feature: Encodes the peptide sequence at SEQ ID NO. 40896
ggacaccattgcgcgcacgcactccggctgaagcgccccgcactagctcacaaagctcaagcctttcgctcgctcccggctacatctacaatggcgcgcttgcagctcgcggccctggccatggacatgctcttcgccgcggcggaggcccaggccccagccgccaccgcgaccccggcgcccaaggcgtccaccccaccggcgacccctcagcctgcccctgctccggattctccgaacgcgcaggcccccg

SEQ ID NO: 40896 - protein, 54 aa, Panicum virgatum
  misc_feature: Ceres CLONE 2005186
  misc_feature: Useful for making plants with altered carbohydrate content
  misc_feature: Useful for making plants with altered cell wall content and/or composition
MARLQLAALAMDMLFAAAEAQAPAATATPAPKASTPPATPQPAPAPDSPNAQAP

SEQ ID NO: 40897 - DNA, 634 bp, Panicum virgatum
  misc_feature: Ceres CLONE 2005189
  misc_feature: Encodes the peptide sequence at SEQ ID NO. 40898
gctcaactcaaccaagctgctcccaactctccacaccctgacacccatctctcttctcttctcttcatcacattgctctcttctctgcatcacattacgagctgcaagcctgcaaacactctctctgcacctcttggcattgggcgccgtcgggcattgtcaccgttgagcagcatcatcgtctccatggagccgatctcggcgtctgtgccccggcccgcgtgctcggcgtacgggcggcggcggcgggcgacggcggcgaagcccgtgggcggcctcgccggggggtgcaacgccgtgctgaagcagaacaagacgaggctgtacatcctcggcaggtgcgtctccatgctcgtgtgctggcgcgaccacgacgccgactgacctcttggcatcggccggcagcgcgagcgagcttgctggaggggatcggctggtctgaccatgttgggtttcggtgtgtagggcggcttgaaatactttagagaggctagtgcgaaacagtaatgtggtgtattgcagtaaactgcttgctaaattggactgattataggtgatggtgaagtgatgaagttcagaagtgtaaatgaatggaatatacttatatacatatatactgaggtgatcatttagc

SEQ ID NO: 40898 - protein, 65 aa, Panicum virgatum
  misc_feature: Ceres CLONE 2005189
  misc_feature (40)..(58): Pfam Name: DVL Pfam Description: DVL family
MEPISASVPRPACSAYGRRRRATAAKPVGGLAGGCNAVLKQNKTRLYILGRCVSMLVCWRDHDAD

SEQ ID NO: 40899 - DNA, 887 bp, Panicum virgatum
  misc_feature: Ceres CLONE 2005192
  misc_feature: Encodes the peptide sequence at SEQ ID NO. 40900
ctctgctctccctccccctcgcaccattctccataggccactgtggccagcagcttctccagtgctcctctggcaccatcactgctcatctctccatagcaacacctcctagttttccggcagcatctccctgagctttactacgttgtttgatggaagagcctacacgagacacaagctagctctctcccttcaataatcttgctagctccaagaagatcttgcctgcttccctttgccgcggcctccatcgacctgcccatacatctatacattcctggctgtaagagatggtctcatggccgtgagctcacctcgccgggcactcctcgccgccgtgttccttggcttcctcctcggcgccgcgaccagcatccgcacggcgacgttttcctcttctcagaaccttgcggaggacaagtcgcggctggggtcgacgccgccgagctgccgcaaccggtgcagcgcgtgcaacccctgcacgcccgtccaggtgacgaccgtgccggggctcggcggcggcgcccgcgtcaccgacgacacggtggccggcttctcacgctactccaactacaagccgctggggtggaaatgccgctgcgacggccgcctctacgacccctagcgtgccggtgtcgcttctcttctccatggcgccgtgcagttcgtgcgtactactctgcttgctccgatggagattctggtctgctctcggttagctagctagctcatctgctctactcccccagattcttcttctcggacgtgtcgtctgttcttgcggcctcgccgtcgcagcttgtactgcccgtagcagtagtttttttttttttttttgctctccgctgaagcaatttactcgcgtgtaaagagtgattgggagcagc

SEQ ID NO: 40900 - protein, 108 aa, Panicum virgatum
  misc_feature: Ceres CLONE 2005192
  misc_feature: SWISSPROT Homolog: EC 3.2.1.15 Polygalacturonase
MAVSSPRRALLAAVFLGFLLGAATSIRTATFSSSQNLAEDKSRLGSTPPSCRNRCSACNPCTPVQVTTVPGLGGGARVTDDTVAGFSRYSNYKPLGWKCRCDGRLYDP

SEQ ID NO: 40901 - DNA, 406 bp, Panicum virgatum
  misc_feature: Ceres CLONE 2005204
  misc_feature: Encodes the peptide sequence at SEQ ID NO. 40902
ctcgagcgagctccagctctcaagaaaccacgccggatcatggccatggcgcctctccctcgcccgctcgtcctcgcgctcctgatcgcgtcctgcgccgcgcagcaggcgccgccggcgcagcccccgcagacgccgaacgccccgccgcaggcgcctccggctccccaagcgcctccggcgggcaacccgccgccggctccccaggcgcctccgaccggaaacccgcctcccgcacccaccactcctcctccggctccgacgaccacgccgcccccggcaccgaccacccctccggcggccccaaccacgccgcccccgggcaccggtgactgccccgccagcccccagcaagcaggcgacgtcgccggcgatgtcaccacaccccgctgacccacgaccacgg

SEQ ID NO: 40902 - protein, 115 aa, Panicum virgatum
  misc_feature: Ceres CLONE 2005204
  misc_feature: Useful for making plants with altered cell wall content and/or composition
MAPLPRPLVLALLIASCAAQQAPPAQPPQTPNAPPQAPPAPQAPPAGNPPPAPQAPPTGNPPPAPTTPPPAPTTTPPPAPTTPPAAPTTPPPGTGDCPASPQQAGDVAGDVTTPR

SEQ ID NO: 40903 - DNA, 685 bp, Panicum virgatum
  misc_feature: Ceres CLONE 2005226
  misc_feature: Encodes the peptide sequence at SEQ ID NO. 40904
ggatactgatgttgtatcagcacgatttcagaggagagacgtatacggtgcttgggaacaataccttggcttggagcacactgatacaacatcaaaaaggtcttacacagccaatcagaatcgtcacacatatgagaagcctgtgaaaatttataattgagaaaccttcatctggacctccatccaacaaaggcctctcatttgagtcagtttgccaaagattttaagagacgtcccagaaagaaaaagggcagagaaatcaattgctgcttgtatgccgaggccttcatgactcagcaatggcgccaacagtcggtatccctcctgttgttgattggccaaagggtattctttccgaggctttcccatcttgcttccaagcaaccaagcatgtgtgttgtttttttcatcgtgtcgagtatgatggcccctgctaggataggtgtttgcttaatttgtagagcaaagctagtacataagaaaaaagattttggtagggggcatgtatacaggattatagccggagactgattgctgaattggcgcctcttgtagcttgggggaacaatgggagagattgtataatgggtttggtattggttccaattttccgtgttgttgagagatgtaagatgataaccgagcagatagtacagttttgagttccagcgtagtcaatcttgtt

SEQ ID NO: 40904 - protein, 52 aa, Panicum virgatum
  misc_feature: Ceres CLONE 2005226
  misc_feature: SWISSPROT Homolog: EC 3.1.2.15 Ubiquitin thiolesterase
DTDVVSARFQRRDVYGAWEQYLGLEHTDTTSKRSYTANQNRHTYEKPVKIYN

SEQ ID NO: 40905 - DNA, 700 bp, Panicum virgatum
  misc_feature: Ceres CLONE 2005266
  misc_feature: Encodes the peptide sequence at SEQ ID NO. 40906
cccgagcggcctcgcgagaaaaaaaaggcgcagcgccgccgccccgcttccgtccagcgccgttgtcctgcctccgccgcccctactccgtcaagcgccaccgctccgtctctatcccagtgtcgccgctgctccgcctctttcccaactccgtcgagccccaccgcttccccgtcgagatgccgccgcgccgatctacatcgagacctccacctcggccggctgctccgcagcttgtattcgtacttgctcatgtagtaggaacaccaagtcacatgtgcccggaacttcttgtggatataccttatggtaacaaatccgatatttggtcgctagtgtgctgcatgtatgaaacggctgcactcagacccgcatttaaagcttttgatatgcaagcccttatcaataagattaccaagtcgattgtatcacctttgcccacaagatattctggtgcattcctgtgcaccgcgtgcttctacttctgctgttaggctgccacgagacatgcaagtgcagcttctgcttctgcgtgcttctgcttctgtcttcatgaatttctcaagaattttatcctgttgtgtgatggatgaattggacgtgttgggatttgatcgatggaaaactactctgtcttgcattggggtcggttgagaatgaattgaatatattttgtacgtcgcaaattttgagttttcac

SEQ ID NO: 40906 - protein, 104 aa, Panicum virgatum
  misc_feature: Ceres CLONE 2005266
  misc_feature: SWISSPROT Homolog: EC 2.7.11.1 Non-specific serine/threonine protein kinase
MPPRRSTSRPPPRPAAPQLVFVLAHVVGTPSHMCPELLVDIPYGNKSDIWSLVCCMYETAALRPAFKAFDMQALINKITKSIVSPLPTRYSGAFLCTACFYFCC

SEQ ID NO: 40907 - DNA, 543 bp, Panicum virgatum
  misc_feature: Ceres CLONE 2005273
  misc_feature: Encodes the peptide sequence at SEQ ID NO. 40908
acctcgagaaggcaaatcacgcgcaaagccacctccgcgtcatcgtcgtcgtctcctctccaagcaagcgaagcggcctcgagatcttctccgcgccgccatggacgccgtggactcggtggtcgacccgctccgggagttcgccaaggacagcatccgcctcgtcaagcgctgccacaagcccgaccgcaaggaattcaccaaggtggcggcgcggacggcgatcggcttcgtcgtcatgggcttcgtcggcttcttcgtcaagctcatcttcatccccatcaacaacatcatcgtcgggtcaggctgatccggtcccagcaggtgaggggccgcaggactggacaatggcaacaataccttggaagcagttttcagccctatatcataaagaatcatttaggttttctttttgttaaggactgctcctcctgttttgtctcgaaagatttggtacacttgaaactctttttgtaacctgatactgattaggcatgcgtgagctaacaggtaacaaaatccaatggtgacagtttccgcacc

SEQ ID NO: 40908 - protein, 69 aa, Panicum virgatum; identical to SEQ ID NO: 11942
  misc_feature: Ceres CLONE 2005273
  misc_feature (10)..(66): Pfam Name: SecE Pfam Description: SecE/Sec61-gamma subunits of protein translocation complex

SEQ ID NO: 40909 - DNA, 628 bp, Panicum virgatum
  misc_feature: Ceres CLONE 2005279
  misc_feature: Encodes the peptide sequence at SEQ ID NO. 40910
accgagccatacgtgctttcagcatcatctgatggtcaagttcagctgcgggactatgagaagggaatggtgttaaataaatcgttttctgtgataccatgcggcgggccatgtctggcgtttgatccatccggcaagagttttgctagtgcttgcggtgattcaataaagattagtaatctccatgatgatgtatgtaagatactattgcgtgggcattcacgagaggttacttgtttggagtacttcgctcatcgagagacgacatacttgatcagcggttccgaagatggaactgccaagatctgggactgcaagaaagggcattgtgtaaagacactgcaagtgttttcacctgttcgtacggtgtgctcccatccggttcttccagtgctaattataggttcttatgacgggtcagttcgcgtatggaactccactaccttcaggcgtgagcgcagaattaaacttggtctcaaaggtttatcggctatagcatgtttgatgggatcaacaaggattgtgattggacattacaatggtttagcacttgcggaaattcggcgcgaggaaccaaaagcattgtaagcttattacaacggtttaacccttgcggaaatggtttagc

SEQ ID NO: 40910 - protein, 195 aa, Panicum virgatum
  misc_feature: Ceres CLONE 2005279
  misc_feature (64)..(104): Pfam Name: WD40 Pfam Description: WD domain, G-beta repeat
  misc_feature (108)..(145): Pfam Name: WD40 Pfam Description: WD domain, G-beta repeat
  misc_feature: SWISSPROT Homolog: EC 2.7.11.7 [Myosin heavy-chain] kinase
TEPYVLSASSDGQVQLRDYEKGMVLNKSFSVIPCGGPCLAFDPSGKSFASACGDSIKISNLHDDVCKILLRGHSREVTCLEYFAHRETTYLISGSEDGTAKIWDCKKGHCVKTLQVFSPVRTVCSHPVLPVLIIGSYDGSVRVWNSTTFRRERRIKLGLKGLSAIACLMGSTRIVIGHYNGLALAEIRREEPKAL

SEQ ID NO: 40911 - DNA, 652 bp, Panicum virgatum
  misc_feature: Ceres CLONE 2005304
  misc_feature: Encodes the peptide sequence at SEQ ID NO. 40912
atccgccgccgcgcagaaaccctagcctccgccccccgccgccgccagtcatccccttcctcctcgggctcgctctccctccctcgtcgatccaggatgaagtttgttgctgcctatctgcttgctgtcctcgctggcaaccccagcccctctgcggaggatttgtcggccatcctggagtccgttggctgtgaaattgacaatgaaaagatggagctcctgctgtcccaactgagtgggaaggacattactgagctaatcgctgcaggcagggagaagtttgcttccgtcccatgcggcggcggtggtgtggctgtcgcagcagctgccccagctgctggtggagctgctcctgcggctgaggcgaagaaggaagagaaggtggaggagaaggaagaaagcgatgatgacatgggcttcagcctcttcgactaggctcgtgcagttatcagagttgtcttttggtcagaaaaaatcaagagtcatgatgtttggatttcaaccatgttttattttgctaatcaccggaacaactgttgctgtcttgaatcttgatatgtagtaattcagatgtaggttactatgctggttggggtttactgctgaaccagagttttccctatcctatatatcagatgaatgaattggttgc

SEQ ID NO: 40912 - protein, 112 aa, Panicum virgatum; identical to SEQ ID NO: 40124
  misc_feature: Ceres CLONE 2005304
  misc_feature (17)..(111): Pfam Name: Ribosomal_60s Pfam Description: 60s Acidic ribosomal protein
  misc_feature: Useful for making plants with altered oil content
  misc_feature: Useful for making plants with modulated biomass

SEQ ID NO: 40913 - DNA, 644 bp, Panicum virgatum
  misc_feature: Ceres CLONE 2005329
  misc_feature: Encodes the peptide sequence at SEQ ID NO. 40914
agatcggcagcattcgtgctccttgcgagctgcctgcaaatttgcttgctagggttccgtcggtggtctgtgggctctccaggatcccggaattgcatccgcgccgagggcaatggcgggaaggcataccatcattctcatgcaaccatcgcagaacagagctacgaggacatttatggacttcgattcagttaaccacgcactggatggaatatgtggcctctatgaaaggaaaatcaggaacatcaacccgatggtcaggaacttgacttatgatatcagtgacctgtacaatttcatcgatggcctgatggacataagtgcactggtgttcgacgactccctccatgctttcctgccatatgaccgccagtggataaaacagaagctgtttcagcacctaaagaggctggctgaacagtagagcatgatcaccgctggttttcggcaccgcatgcgtcgaggacgaaggtgcccggttgctggttcaggcttggttcgaaattcctggcatgttgtgtaaaggtctatctggcgctctggcagtgtgtagtgtttgacgtgaaccatgtggtttgcacggcgaccaggcactatatggtgaactgcggaacaaatgcaagcttccagatgatcatctcgtc

SEQ ID NO: 40914 - protein, 103 aa, Panicum virgatum
  misc_feature: Ceres CLONE 2005329
  misc_feature (3)..(103): Pfam Name: ER Pfam Description: Enhancer of rudimentary
MAGRHTIILMQPSQNRATRTFMDFDSVNHALDGICGLYERKIRNINPMVRNLTYDISDLYNFIDGLMDISALVFDDSLHAFLPYDRQWIKQKLFQHLKRLAEQ

SEQ ID NO: 40915 - DNA, 713 bp, Panicum virgatum
  misc_feature: Ceres CLONE 2005331
  misc_feature: Encodes the peptide sequence at SEQ ID NO. 40916
acaaatatacacggcgaggcccgggctgcttggtgacccacccaaacccaaaccctccccccatttctttcttgcctcccacgccgccgccgccgcattccgccatggccgatccgcggctgttcccgtcgggatctgacgaccgccgcgacgactccggccgccgcctctacaacccgtaccaggacctcaacatcccctacaagcagctctacgacctgcccacctccccggagttcctcttccaggaggaggccatcgcgcagcgccgctcctggggcgagaacctcacctactacacaggtatcggctacctgggcggcgccgtggccggggccgcgctggggctccgcgacgccgcgcggggcgcagagcccggcgagcccgccaagatccgggccaaccgtgtcctcaactcctgcgggagctcgggccgccgcttcggcaacacactcggggtcataggcctcatgtacgccgggatcgagagcgccatggtcgctgcccgcgaccgcgacgactggatcaatagcgtcgcggcagggctaggcaccggcgcgctcttccgggccgccaacgggccgcgctcagccgccgtcgcgggcgccgttggaggggttctcgccggcgccgccgcggccgccaagcaggttggcaagagatacgtgcccgccctctgatgcctccgtacggtactctctctgctgtgatca

SEQ ID NO: 40916 - protein, 191 aa, Panicum virgatum
  misc_feature: Ceres CLONE 2005331
  misc_feature (51)..(184): Pfam Name: Tim17 Pfam Description: Tim17/Tim22/Tim23 family
MADPRLFPSGSDDRRDDSGRRLYNPYQDLNIPYKQLYDLPTSPEFLFQEEAIAQRRSWGENLTYYTGIGYLGGAVAGAALGLRDAARGAEPGEPAKIRANRVLNSCGSSGRRFGNTLGVIGLMYAGIESAMVAARDRDDWINSVAAGLGTGALFRAANGPRSAAVAGAVGGVLAGAAAAAKQVGKRYVPAL

SEQ ID NO: 40917 - DNA, 876 bp, Panicum virgatum
  misc_feature: Ceres CLONE 2005369
  misc_feature: Encodes the peptide sequence at SEQ ID NO. 40918
tgctaattcgctccggaggagaaacgcatccttacgctcgcgagcccacgatggagacgagaagaattccgcgccctgtaatcctctccccaccttttgtttccgctgattcgattgattattgtgatgtttcggggggttcgttcgtttggtccccgatccaagcggcggcattcttatacgcaggcggcgctgctggcggcgtgcgccggcgcgtcccgggcggggtgccggaagcacgtggcgaagatcacggagtacggcgccgtcggggacgggaagacgctcaacacggcggcgttcgccaaggcggtggcggacctgtcggcgcgcgcgcggcgcggcggcgctgcgctggtggtgcccccggggaaatggctcacggggcccttcaacctcaccagaaacactactcacgtggattcacggtcgctcccctgcactctgttcggcagctgcagcggcctccagaccaacagtatttttttctcagatcgctccagcaccaatttacagccaccagccaaccaataatatttttctctcacaccactccagccatcagttccagctcaatccagcgaacagagtggtcgctagggacaatgaccttttgccttggggcccctgatcccttcttttctaagcaagccactgccatcatctgtgcaacgcctagtgtcgttgtgctcttgaatcttcggatagattcgagtgtaatttccttccatcgatgccatggttccatgtgatggcacagtagtatgccataaagccatagcctgcaaatctgcataaaacgcttgcgaatggttgtagtgtatccaagacgtttcagagaataatgcagttactgcagtctgcttaagaatggct

SEQ ID NO: 40918 - protein, 135 aa, Panicum virgatum
  misc_feature: Ceres CLONE 2005369
  misc_feature: SWISSPROT Homolog: EC 3.2.1.67 Galacturan 1,4-alpha-galacturonidase
  misc_feature: Useful for making plants with altered carbohydrate content
  misc_feature: Useful for making plants with altered cell wall content and/or composition
MFRGVRSFGPRSKRRHSYTQAALLAACAGASRAGCRKHVAKITEYGAVGDGKTLNTAAFAKAVADLSARARRGGAALVVPPGKWLTGPFNLTRNTTHVDSRSLPCTLFGSCSGLQTNSIFFSDRSSTNLQPPANQ

SEQ ID NO: 40919 - DNA, 684 bp, Panicum virgatum
  misc_feature: Ceres CLONE 2005374
  misc_feature: Encodes the peptide sequence at SEQ ID NO. 40920
agagcaaaaaccactcaaacacaattcaagcaggacccaaggcagcaacagcatcccgggctcaagcaatcttcaagtgatcagaattccgaacaagatgtgcccaatcaagagggagatgagcgccgagtcgtcgggctccccgtgcagctcagccacgccctcgacctcgtcggagcagcaccagacggtgtggacgtcgccgccaaagcggcccgcggggcggaccaagttccgggagacgctgcaccccgtgttccgcggcgtgcggcgccggggcaacgccgggcggtgggtgtgcgaggtgcgcgtgccgggccggcgcggctgcaggctctggctcggcaccttcgacaccgccgagggggccgcgcgcgcgcacgacgccgccatgctcgccatcgcgggcccgggcgcgtgcctcaacttcgcggactcggcgtggctgctcgccgtgccggcctcgtacgccagcctcgccgaggtgcgccacgcggtcgccgaggccgtggaggagttccagcgccgggaggcgctcccggaggaggaggaggacgcgcgctcggccacgtcctcgacgccgtcgtcccctgccagcgacgacggcagcgccaccgacggcgaggggtcctctgactcctccgcggccaccggggcctcgccgttcgagctggacgtcttcag

SEQ ID NO: 40920 - protein, 195 aa, Panicum virgatum
  misc_feature: Ceres CLONE 2005374
  misc_feature (52)..(105): Pfam Name: AP2 Pfam Description: AP2 domain
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 2 in US patent 7138277
  misc_feature: The sequence is a functional homolog of SEQ ID NO 1248 in the 10/374,780 US patent application
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1221 in the 10/374,780 US patent application
  misc_feature: The sequence is a functional homolog of SEQ ID NO 1410 in the 10/412,699 US patent application
  misc_feature: The sequence is a functional homolog of SEQ ID NO 720 in the 11/435,388 US patent application
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 752 in the 11/435,388 US patent application
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1229 in the 10/374,780 US patent application
  misc_feature: Useful for making plants with modulated water use efficiency
  misc_feature: The sequence is a functional homolog of SEQ ID NO 692 in the 11/435,388 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 1236 in the 10/374,780 US patent application
MCPIKREMSAESSGSPCSSATPSTSSEQHQTVWTSPPKRPAGRTKFRETLHPVFRGVRRRGNAGRWVCEVRVPGRRGCRLWLGTFDTAEGAARAHDAAMLAIAGPGACLNFADSAWLLAVPASYASLAEVRHAVAEAVEEFQRREALPEEEEDARSATSSTPSSPASDDGSATDGEGSSDSSAATGASPFELDVF

SEQ ID NO: 40921 - DNA, 724 bp, Panicum virgatum
  misc_feature: Ceres CLONE 2005381
  misc_feature: Encodes the peptide sequence at SEQ ID NO. 40922
aaaccctcttcctcccttccccacctctccagcggatcactcgccgccgccgctgccgccggacgccgccgtgatgctgtccctgtcgagggctctcgggaggcggctcttctcatccgccgcggcggtgtccgagtccgccgcggccgcgtcgacgtcggcggtgaggaaggcgcagaaccctctcgaggagttcttcgaggttgagcggagcaccgaggaggacaagccccgtccctactacggtcgtagttggaaggcttctgaattgcgcctaaaatcgtgggatgatcttcagaagcattggtatgttcttatgaaggaaaagaacatgcttatgactcagcgacagatgctgcatgcagagaacttgcattttccaaatccagagcgtatttccaaggtgaagaaatcaatgtgccggataaagcatgtcttgactgagagggccatagctgagccagacccaaggaggtcagcagaaatgaagcggatgatcaacaccctctgattcactcacatgctttcctgtgggactaaggttgaaaggctaagtagcacttagaaagatttgcttcgttgtgttgtatgtttatcctagaagacgtgtaagaccgatccttttttatgtccgtggtatgcctgcaacacgccttgttgacattaacatctggggttcaataattgagcttttatgtaaaatatacatacatacatatataca

SEQ ID NO: 40922 - protein, 145 aa, Panicum virgatum
  misc_feature: Ceres CLONE 2005381
  misc_feature (38)..(125): Pfam Name: MRP-L47 Pfam Description: Mitochondrial 39-S ribosomal protein L47 (MRP-L47)
MLSLSRALGRRLFSSAAAVSESAAAASTSAVRKAQNPLEEFFEVERSTEEDKPRPYYGRSWKASELRLKSWDDLQKHWYVLMKEKNMLMTQRQMLHAENLHFPNPERISKVKKSMCRIKHVLTERAIAEPDPRRSAEMKRMINTL

SEQ ID NO: 40923 - DNA, 646 bp, Panicum virgatum
  misc_feature: Ceres CLONE 2005382
  misc_feature: Encodes the peptide sequence at SEQ ID NO. 40924
ccccaccagcctcccaaagcctccgcctccccctgcctcctccgccgccgccgcgcgcgcagacgacccgcgacccacaggcatgggcgtgtacaccttcgtgtgccgcaacaccggcggcgagtggacggccaagcagcactccggcgagatcgaggcctccgccaccaccccctacgagctgcagcgccgcctcgtcgccgccgcctccgcggccgactccgcggccggcgtccagtcctccttctccatggtctctcccagctccgccgtcttccaggtgattgttggtgctgtcggtggcggtgcgatgatcagtggaggtgctgcagttggtggcgctgctgcctcaggtggtggtgcggctgagccccccaaggaggagaagaaggaagaggagaaggaagagagtgacgatgacatgggtttctccctgttcgactagattatttagctcccataagtggtggtttggtcctattatggtacttaattttgctgtcctgtctacacaagccagtggcttgtgaacctgaaaactctgttaattcaggcaatgaagttccttggcttgccgcactcgggatgacggcgagagactacagccattgttgcactcacgagcagcagcgtgtttcccaaccat

SEQ ID NO: 40924 - protein, 120 aa, Panicum virgatum
  misc_feature: Ceres CLONE 2005382
  misc_feature (41)..(119): Pfam Name: Ribosomal_60s Pfam Description: 60s Acidic ribosomal protein
MGVYTFVCRNTGGEWTAKQHSGEIEASATTPYELQRRLVAAASAADSAAGVQSSFSMVSPSSAVFQVIVGAVGGGAMISGGAAVGGAAASGGGAAEPPKEEKKEEEKEESDDDMGFSLFD

SEQ ID NO: 40925 - DNA, 609 bp, Panicum virgatum
  misc_feature: Ceres CLONE 2005390
  misc_feature: Encodes the peptide sequence at SEQ ID NO. 40926
tatgaggagctaatcgcattgggtgaagtagttggtacagaaagcagaggtctctctgctgatacacttgcctctttaccttcagtgaagtacaagacacaaaatgttcaggatgacaacgcagagcaatgtgtaatttgccgtgtggaatttgaggaaggtgaatctttgattgcacttccctgcaagcactcataccaccctgaatgcataaaccagtggctgcaaataaataaggtatgccctatgtgcagcacagaagtttcaacctcgggcaacaaggaggcagaagtttcagcctcgggcaacaaggaagcgtgacccactctcatatgaccattttcggcacttaatgggaataactagcagcatcagtgtagcatctgtattgttgaagcaaaagcagaaaaacgtattagaacatgaaaggatattgtgtttcaaacaaaaaaaaacatgcaaggaggtcaggaaatatttaatcctcgtttcactctttttctcttggctatgctcactgaactttctctgccttgccgaaatgctttatgtacccttgggacgccttgtggctgtaatatgatccataaatgcactgattatatttac

SEQ ID NO: 40926 - protein, 106 aa, Panicum virgatum
  misc_feature: Ceres CLONE 2005390
  misc_feature (44)..(84): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: Useful for making plants with altered terpenoid content
YEELIALGEVVGTESRGLSADTLASLPSVKYKTQNVQDDNAEQCVICRVEFEEGESLIALPCKHSYHPECINQWLQINKVCPMCSTEVSTSGNKEAEVSASGNKEA

SEQ ID NO: 40927 - DNA, 671 bp, Panicum virgatum
  misc_feature: Ceres CLONE 2005415
  misc_feature: Encodes the peptide sequence at SEQ ID NO. 40928
atcatttgtctggtgatcctaattgtcttgagacacttcaacgcacagatgcaatcaagcatctgataccgattcttgaacttcatgatggacctctggtatatcaaatacatagtgaggtcctcaacgctttgttcaacctttgcaagattaataaaagaagacaggaacaagcagctgaaaatgggatcatccctcacttgatgaattttgttatgtcagactcacccctaaggcagtatgccctgcctttgctgtgtgatatggcccatgcttctcgcaactctagagagcagttgagggctcatggagggctagatgtgtacttaaatcttttggaggatgatgcatgggcatgcacagcattagattctattgctgtttgtttggctcatgataatgatcacagaaaagtagaacaagcgctgttgaagaaagaggcaattcagaaattagtgaaattcttccaagactgcccagaacaatattttgttcatacattggatgctttcttgaagataatcacgaaatcttctcggataaatactgcaatggccaccaatggtttgacaacattgcttattgcaagacttgaccatcgagaagctattgctcgcttgactttgctgaaactcataaaggttgtctatgagcaccatcctccaccaaaa

SEQ ID NO: 40928 - protein, 222 aa, Panicum virgatum
  misc_feature: Ceres CLONE 2005415
  misc_feature: SWISSPROT Homolog: EC 2.7.11.1 Non-specific serine/threonine protein kinase
HLSGDPNCLETLQRTDAIKHLIPILELHDGPLVYQIHSEVLNALFNLCKINKRRQEQAAENGIIPHLMNFVMSDSPLRQYALPLLCDMAHASRNSREQLRAHGGLDVYLNLLEDDAWACTALDSIAVCLAHDNDHRKVEQALLKKEAIQKLVKFFQDCPEQYFVHTLDAFLKIITKSSRINTAMATNGLTTLLIARLDHREAIARLTLLKLIKVVYEHHPPP

SEQ ID NO: 40929 - DNA, 692 bp, Panicum virgatum
  misc_feature: Ceres CLONE 2005425
  misc_feature: Encodes the peptide sequence at SEQ ID NO. 40930
cttctccactccctcccccgcctccactactcccatcccaggcgctgcccaggtaagtcggcggcgatgacgacccgcttcaagaagaaccgcaagaagcgcggtcacgtgtccgccgggcacggccgtatcgggaagcacaggaagcaccccggtggccgcggtaacgccggtggcatgcaccatcaccgaatcctcttcgacaagtaccatccggggtacttcggcaaagtgggtatgcgctacttccacaagctccgcaacaagttctactgcccggctgtcaacgtcgagcgcctctggtcgatggtgcccgccgagaaggaggcgggggccggcgccgataaggccccgcagatcgacgtcacccagttcggctacttcaaggtgctcgggaaggggaagctgccgtccaagcccatcgtcgtcaaggccaagctcatctccaaggtcgccgagaagaagatcaaggccgccggcggcgccgtcgtgctcaccgcttaggtttcagtccttgcttgcctctgttttgagatctatatctgaactagtactgccttcctgtctcagctatttgtgttaagaagacttgctagctttttaaattgccgtggctactgcctggtggaacagtacttatgaggatttttgcacttagtgatgccagttcatatcaaatatctcagatatat

SEQ ID NO: 40930 - protein, 145 aa, Panicum virgatum
  misc_feature: Ceres CLONE 2005425
  misc_feature (107)..(139): Pfam Name: L15 Pfam Description: Ribosomal protein L15
MTTRFKKNRKKRGHVSAGHGRIGKHRKHPGGRGNAGGMHHHRILFDKYHPGYFGKVGMRYFHKLRNKFYCPAVNVERLWSMVPAEKEAGAGADKAPQIDVTQFGYFKVLGKGKLPSKPIVVKAKLISKVAEKKIKAAGGAVVLTA

SEQ ID NO: 40931 - DNA, 712 bp, Panicum virgatum
  misc_feature: Ceres CLONE 2005450
  misc_feature: Encodes the peptide sequence at SEQ ID NO. 40932
agtggggcttcaggactcgacctctcgcgccgccgccatgaccttcaagcgccgcaacggcggccgcaacaagcacggccgcggccatgtcaagtacatccgctgctccaactgcgccaagtgctgccccaaggacaaggcgatcaagaggtttcaggtgaggaacatcgtggagcaggcggccatcagggacgttcaggaggcgtgcgtccatgacggatacgtccttcccaagctctacgccaaggtgcaccactgcgtctcgtgcgcgatccacgctcacatcgtccgcgtccgttcccgtgagaagcgcagggaccgcaagccaccggaacgcttcaggcgcaggctatcatctcaggacagagcagcattttcaggaaaaaatagtttcctattgtttggacatcgatgctggaaattttgttgaagcactcctcttcacaacgtacaacctgatgcttcctcctctgctatcggagaatcacttttggagcacactgcagctgctcttactggtacactttatttggcggccacaacttatggttattgaagcgttacgcacgctgggaaattgccatatgaagcccggcccgtttctttttgttttaagattaccagcccgtttcgttgacccgaacgaggccttggtccattatttgtctcgttgcggtctcttagtttttttctttgaaagagtctcttctta

SEQ ID NO: 40932 - protein, 130 aa, Panicum virgatum
  misc_feature: Ceres CLONE 2005450
  misc_feature (1)..(114): Pfam Name: Ribosomal_S26e Pfam Description: Ribosomal protein S26e
  misc_feature: Useful for making plants with modulated nitrogen use efficiency
MTFKRRNGGRNKHGRGHVKYIRCSNCAKCCPKDKAIKRFQVRNIVEQAAIRDVQEACVHDGYVLPKLYAKVHHCVSCAIHAHIVRVRSREKRRDRKPPERFRRRLSSQDRAAFSGKNSFLLFGHRCWKFC

SEQ ID NO: 40933 - DNA, 447 bp, Panicum virgatum
  misc_feature: Ceres CLONE 2005452
  misc_feature: Encodes the peptide sequence at SEQ ID NO. 40934
actgctcgagcgagctccagctctcaagaaaccacgccggatcatggccatggcgcctttccttcgcccgctcgtcctcgcgctcctgatcgcgtcctgcgccgcgcagcaggcgccgccggcgcagcccccgcagacgccgaacgccccgccgcaggcgcctccggctccccaggcgcctccggcgggcaacccgccgccggctccccaggcgcctccggccggcaacccgcctcccgcacccaccactcctcctccggctccgacgaccacgccgcccccggcaccgaccacccctcctccggcccccaccacgccgcccggggcaacggtgactctcccgccagagccgacaactccgccggcagcgacgctcgcgtgaccccaggccgtccccggccgcacgagacgatgtccgtcccccatgattccggaaacgaccctggc

SEQ ID NO: 40934 - protein, 110 aa, Panicum virgatum
  misc_feature: Ceres CLONE 2005452
  misc_feature: Useful for making plants with altered cell wall content and/or composition
MAPFLRPLVLALLIASCAAQQAPPAQPPQTPNAPPQAPPAPQAPPAGNPPPAPQAPPAGNPPPAPTTPPPAPTTTPPPAPTTPPPAPTTPPGATVTLPPEPTTPPAATLA

SEQ ID NO: 40935 - DNA, 684 bp, Panicum virgatum
  misc_feature: Ceres CLONE 2005453
  misc_feature: Encodes the peptide sequence at SEQ ID NO. 40936
acactgcttataaaaagaaaaaaaactctcgcttctgctcttctcctctcccccacgagatctcctccacgccgcatcctctctctctctcggtcccggcgttcctctcctcagctcctcccgccggtgatagggccagtggcgccgcgccacctttggccagttcttcgttgggcgctgcgccgaggacgagcatccgacagggctgacaggaaatttacctttatctatctattccacattcttttgcgattatggcactagctgctatctacagccttttcatcattaacaaatccggtggccttatatactacaaggactatggttcagcagggaggatggacaccaatgacagtctcagattggcaagtctctggcattcaatgcatgctatctcccagcaactctcccctacccctggctgtaatggcattgacctcctacaagcccataatttcgatcttcattgcttccaatccctgacaggtacaaaattttttgttgtatgcgagactggcgcaccaaatatggaaatgctgctgaaagtgatctatgagttgtacactgactttgttttgaagaacccgttctatgagatggagatgccgattcggtgtgagctctttgatctcaacctggcacaggtgatccagaaggaccgtgttgcactcttgggtcggt

SEQ ID NO: 40936 - protein, 143 aa, Panicum virgatum
  misc_feature: Ceres CLONE 2005453
  misc_feature (6)..(136): Pfam Name: Sybindin Pfam Description: Sybindin-like family
MALAAIYSLFIINKSGGLIYYKDYGSAGRMDTNDSLRLASLWHSMHAISQQLSPTPGCNGIDLLQAHNFDLHCFQSLTGTKFFVVCETGAPNMEMLLKVIYELYTDFVLKNPFYEMEMPIRCELFDLNLAQVIQKDRVALLGR

SEQ ID NO: 40937 - DNA, 648 bp, Panicum virgatum
  misc_feature: Ceres CLONE 2005474
  misc_feature: Encodes the peptide sequence at SEQ ID NO. 40938
gaaaggagagcagcagagcaacaggaaagactccgtcagatcgagccttgttctccctctcatccaagaacagcatcaaacaagaaaccagagaggtagaacagagcaagatggcctgagccaggctaagccaaacgcacgcacgctcctcctagacgcacgcacgcacgtagaggacggacgcgcaggaaggacttgcactccggcgcatgggtctcctggaccagctgtgggatgacacggtggccgggccgcgcccggactccggcctcggcaagctccgcaagtacgcctccttctcgccctcctcctcctcggtgtccaaggccgcggccgcgtcgccgcccgcggagggggcggccgggggcgtggcgccaggggtgacgcgcagcatcagcatgctccgcccctcggcgctgtccgtcgtcacgtcgccgcgcagcgagtccagctctgcgccgtcgtcgccggccagcggcgctccggactcgcccttcggcgcagcgacgacgcccgagggagagggctggaagaagctgcgccggaaaggcaggatggccgccgacggcgccgacgcccccggcacgccgaggagccccaccgtctacgactgggtggtgatcagctcgctggaccggtgaacgacag

SEQ ID NO: 40938 - protein, 143 aa, Panicum virgatum
  misc_feature: Ceres CLONE 2005474
  misc_feature (7)..(143): Pfam Name: Auxin_repressed Pfam Description: Dormancy/auxin associated protein
MGLLDQLWDDTVAGPRPDSGLGKLRKYASFSPSSSSVSKAAAASPPAEGAAGGVAPGVTRSISMLRPSALSVVTSPRSESSSAPSSPASGAPDSPFGAATTPEGEGWKKLRRKGRMAADGADAPGTPRSPTVYDWVVISSLDR

SEQ ID NO: 40939 - DNA, 631 bp, Panicum virgatum
  misc_feature: Ceres CLONE 2005490
  misc_feature: Encodes the peptide sequence at SEQ ID NO. 40940
aatggcctaatctgtccaccacgccagctactcctctactcgccgagtcgtccgccggcgccgcctccctcgccctcccctcgacctcgtgcccgcggcggccgctgctcatctgctccgatggctactgtgccagtcaaccctaaacctttcttgaacaacctaacagggaagcctgtaattgtcaaacttaagtggggtatggagtacaaaggttatcttgtttctgttgactcctacatgaatcttcagcttgctaacacagaggagtacattgatgggcaattctctgggaacttgggagagattttgatcaggtgcaacaatgttctgtacctccgaggtgttccagaggatgctgagatagaggatgcggagtgagaagacttgaaccatgtttagattgattgatgtaaggacgtgtgtttgggtgtgccggggacaacctattctgccgaatcctagctttgaactttatgattgatgaagtgtatcctgctttcagttaggctatactgtcatgaacatttgaagtttgaactgaaagctaggactagagatgatgttcaaactttcagttaagagtattctgtcattctgctgaatctgagaagcatcagatttcctgacc

SEQ ID NO: 40940 - protein, 86 aa, Panicum virgatum; identical to SEQ ID NO: 24879
  misc_feature: Ceres CLONE 2005490
  misc_feature (10)..(75): Pfam Name: LSM Pfam Description: LSM domain

SEQ ID NO: 40941 - DNA, 699 bp, Panicum virgatum
  misc_feature: Ceres CLONE 2005495
  misc_feature: Encodes the peptide sequence at SEQ ID NO. 40942
ctgatccacaggcagccatggcgttgcagcggatatcggaagtgatccgatttctgcactcgcccccgcatcgtgggttgatggtccgctccgctatcctctgggggctcggcgacgtcgccgcccaggccatggtccactactccgctcaggataaagatgaggagtccatttctttcgggaataaagataaggagttcaaaatcaattggtatagagtgtacaaaacaagtgtttttggagcttttgcttgtattggaccagctgcatattaccggtttaggtttaataagaggctgtggagctccattactacagctgaagttgttagctcagcagctcgtgaaggtctctgggcaactataaatcttgccacgttcttcccgttcgtgggttccacgccaaggactaggagtgtggagcaggccaaggaagacatgaagagaggtttcacccctgctctagtgctgggcggagctgtggtgccaaccttgctgttcacaaactggcgcttcgtccccacgccataccagcttcattgtgccagcttgttcgccctggtaggcagctgttccctctcattgattgacttgagcaccacaaggatgatggcgcagcgtttctggaaggatggaacgagtatggcttgatctgacatctgcttttgagctagtagtagtcatgtgtgtatgtgggtac

SEQ ID NO: 40942 - protein, 210 aa, Panicum virgatum
  misc_feature: Ceres CLONE 2005495
  misc_feature (126)..(196): Pfam Name: Mpv17_PMP22 Pfam Description: Mpv17 / PMP22 family
MALQRISEVIRFLHSPPHRGLMVRSAILWGLGDVAAQAMVHYSAQDKDEESISFGNKDKEFKINWYRVYKTSVFGAFACIGPAAYYRFRFNKRLWSSITTAEVVSSAAREGLWATINLATFFPFVGSTPRTRSVEQAKEDMKRGFTPALVLGGAVVPTLLFTNWRFVPTPYQLHCASLFALVGSCSLSLIDLSTTRMMAQRFWKDGTSMA

SEQ ID NO: 40943 - DNA, 722 bp, Panicum virgatum
  misc_feature: Ceres CLONE 2005499
  misc_feature: Encodes the peptide sequence at SEQ ID NO. 40944
ccatcccgcaggccaaccaacagtgacgcgagcacgagcacccctcccccacctctccttccgcgtcgcgtgccctcgccgcagcccatcctcatggcggaccagctcaccgacgagcagatcgcggagttcaaggaggcgttcagcctcttcgacaaggacggcgacggttgcatcactaccaaggagcttggaactgtgatgcgctcccttggccagaaccctactgaagcagagctgcaggacatgatcaacgaggttgatgctgatggcaacgggaccatcgacttcccagagttcctgaacctgatggcaaggaagatgaaggacactgactctgaggaggaactcaaggaggctttccgtgtcttcgacaaggaccagaacggtttcatctcggctgctgagctccgccatgtcatgaccaaccttggtgagaagctgaccgatgaggaagtcgacgagatgatccgcgaggctgacgtggacggcgatgggcagatcaactatgaggagtttgtcaaggtcatgatggccaagtgaggagcggtcccccataaataagtctgtcaggagcaaaccgaattatcaggctcacaagctgtactttgtcatgtcccgttgatgagtacgtatcagtatcatgcaggtggtaatgttgagtagtggtcgggttaggtggtgtagtcatgggaacgcgacatcagatacctgtttctttt

SEQ ID NO: 40944 - protein, 149 aa, Panicum virgatum; identical to SEQ ID NO: 9768
  misc_feature: Ceres CLONE 2005499
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Useful for making plants with modulated salt sensitivity

SEQ ID NO: 40945 - DNA, 648 bp, Panicum virgatum
  misc_feature: Ceres CLONE 2005517
  misc_feature: Encodes the peptide sequence at SEQ ID NO. 40946
atcagttcatcagcaacctatgcattacatctagctagcagcagctgagtaccgacagaatattctgtgaacattcagccaggaaagcaggaaaagcaaccatgatcactgccaagagacttgttcagatggcgaagaagtggcagagaatggccgctctggcgaggaagcggctcacgtcgacaccaatgaaagaagctgaaggatcatgcggtacctcatcgtccatggccagcaagggccactgcgtcgtgtactcggccgatggccggcgattccaggtcccactggcgtaccttggtacggcggtcttcggcgagctcctaatgatgtcacaggaagagtttgggttctccagcgacgaaggcaggatcacgctgccctgcgacgctgcggtcatggagtacgtgctgtgtttgcttagaagaaacgcctctgaagaggttgtgagggcgttcttgagctccatggtcaggccgtgccacaatgtcagcggcgtggtgccatgcaaccagccgttagctgtttgtgtatagcctttttttagctcctgacgcactataccatttttggttcaaccggatgtaaagttgtagaatcatgtaggagattgaaatcatgaaatgttgttatatcacaagcctcact

SEQ ID NO: 40946 - protein, 144 aa, Panicum virgatum
  misc_feature: Ceres CLONE 2005517
  misc_feature (10)..(108): Pfam Name: Auxin_inducible Pfam Description: Auxin responsive protein
MITAKRLVQMAKKWQRMAALARKRLTSTPMKEAEGSCGTSSSMASKGHCVVYSADGRRFQVPLAYLGTAVFGELLMMSQEEFGFSSDEGRITLPCDAAVMEYVLCLLRRNASEEVVRAFLSSMVRPCHNVSGVVPCNQPLAVCV

SEQ ID NO: 40947 - DNA, 667 bp, Panicum virgatum
  misc_feature: Ceres CLONE 2005525
  misc_feature: Encodes the peptide sequence at SEQ ID NO. 40948
gtcactctcttccccagcggccggctctagtgagctcttcagatcaggctcgccttcccctcccgctctcccgccgccgccgccctcgtcgaccccgtgaactgcgccggagcggcgatccgtcgaaccacctggatcgacctcttctgccgctggaccaagatggacgttattatcatcatctctcttgtcattcttttggcactaggagctgtctttgtgatcccgaagtcccaaaacaaaggtaaatcaaagggaactgattcagtagatggaatgacatctaagaggtatacaaaggaagagatctctgaacataacacaaggaaggattgttggatcatcatcaaagacaaggtctatgatgtcactccttatgtggaggaacatcctggcggagatgccattctaactaatgctggtggtgattccacagaaggcttttttggaccacagcacggcactagagtcttcgatattatcgaggatttctgtatcggacagttgaaggattcatgaaattgagggtagattgtattgatttcatggaattttcctggcatcagtttatgagaagctatatatatggtagccatgttttcagccttgtcaaggtccaggtgtgatatgtcagagtcaaactgttctgcactcgtgatcagggctg

SEQ ID NO: 40948 - protein, 118 aa, Panicum virgatum
  misc_feature: Ceres CLONE 2005525
  misc_feature (43)..(116): Pfam Name: Cyt-b5 Pfam Description: Cytochrome b5-like Heme/Steroid binding domain
MDVIIIISLVILLALGAVFVIPKSQNKGKSKGTDSVDGMTSKRYTKEEISEHNTRKDCWIIIKDKVYDVTPYVEEHPGGDAILTNAGGDSTEGFFGPQHGTRVFDIIEDFCIGQLKDS

SEQ ID NO: 40949 - DNA, 664 bp, Panicum virgatum
  misc_feature: Ceres CLONE 2005537
  misc_feature: Encodes the peptide sequence at SEQ ID NO. 40950
gatcgcatcgcattctcgctctgttgtgtgactgattgccaagaaggaaacgctctctgcttgtgttccagcctctgaatctcgtgtgaggatgtcgtgctgcggaggcaactgcgggtgcggctccggctgcaagtgcggctccggctgcggagggtgcaagatgtacccggacatggctgagcagggcaccaccaccaccaccaccaccaccacccagactgtcatcatgggcgttgcaccaaacaacaaggggcatgccgagggcgggttcgaggctggcgccggagccgagaacggcggctgcaagtgcggcgacaactgcacctgcaacccctgcacctgcaagtgaggagctcatggccatggccggaccggaggagatctcggaaggacaaaaaagctagtatagcagtgttgtgtatgtgcgtcgttcgtttgtctgaaagtgtgtgtggcatgcttagtaacagtgttgcgcgtgctgctagtagatggtactgatgaggaacaataataatgatggtgctgagatgtcgtcggcgtcgccgccgtcgtgtccttcctccccggccggtcgagcacctgtggcggtgctctagcagtgtgtcggtgtgtgcagcaggccatgctctgatctgtggtgtaggtgtgtggcctgctt

SEQ ID NO: 40950 - protein, 86 aa, Panicum virgatum
  misc_feature: Ceres CLONE 2005537
  misc_feature (1)..(85): Pfam Name: Metallothio_2 Pfam Description: Metallothionein
MSCCGGNCGCGSGCKCGSGCGGCKMYPDMAEQGTTTTTTTTTQTVIMGVAPNNKGHAEGGFEAGAGAENGGCKCGDNCTCNPCTCK

SEQ ID NO: 40951 - DNA, 692 bp, Panicum virgatum
  misc_feature: Ceres CLONE 2005538
  misc_feature: Encodes the peptide sequence at SEQ ID NO. 40952
atatcatacatctgttcccgatactatcgggctccagagctcatatttggtgccactgaatatactacagcaattgacatttggtctgctggatgtgttcttgctgagcttatgctaggccagcctttgtttcctggtgaaagtggcgtggaccaacttgttgaaatcatcaaggttcttggtacccctacaagggaagaaattaagtgcatgaacccgaattacacagagttcaaattcccacagatcaaagcacacccatggcacaaggtatttcacaaaaggatgccaccggaagctgttgatctggtgtcccgactgctccagtactcccccaatctaagatgcactgctgttgaggcacttgttcacccattctttgatgagctccgagatcctaatacccgtcttccaaatggacgctttctgccaccccttttcaacttcaagccgcatgaactgaaaggagtcccagcagacatttttgcgaaattgattccagaacatgcaaagaagcaatgcccctatgtgccttgaggccataacccgccactgcatctgtgcattttcccttggaatttggatgattggcggcctgcacacctgttggttgaagatgctaggtcacctgcgtgtacaagtacaacagctgtgacctgtgtagttgagtagtgtatgtcgcaatgacatgt

SEQ ID NO: 40952 - protein, 178 aa, Panicum virgatum
  misc_feature: Ceres CLONE 2005538
  misc_feature (1)..(127): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated water use efficiency
  misc_feature: Useful for making plants with modulated biomass
ISYICSRYYRAPELIFGATEYTTAIDIWSAGCVLAELMLGQPLFPGESGVDQLVEIIKVLGTPTREEIKCMNPNYTEFKFPQIKAHPWHKVFHKRMPPEAVDLVSRLLQYSPNLRCTAVEALVHPFFDELRDPNTRLPNGRFLPPLFNFKPHELKGVPADIFAKLIPEHAKKQCPYVP

SEQ ID NO: 40953 - DNA, 518 bp, Panicum virgatum
  misc_feature: Ceres CLONE 2005539
  misc_feature: Encodes the peptide sequence at SEQ ID NO. 40954
agcggagctgagggctcagttgaagagctcaggttatgcttcgacaaagaattgaagcctcgtgattgccttactacttctttgacgaatggaagtgtgtcaaaaacaaagcattgcccacagtacatcacactgccaaaatatgatccccttgtgcttgccaattcaactggagagatcatgaaacagttcgatgactttgaggtgtctgcagcaatttatacagcctaacatgtagttgttgcagcagagcaatccatggctgtgacgaaacaaatgtcttcagggccacgaactgcatttatgatagcaggtggttgcctgagcattccagggaaattgatgtctgtgaatcaattatttgtacactaggaagagaaccgtactcttttagatccatgcgaattgaaatttacaggttttacgaaaccttgaaggtcggatcaatgtatatacacattccatagctggatggtgtccttgttgccattattctaaaggtttctggtgcaagtttt

SEQ ID NO: 40954 - protein, 76 aa, Panicum virgatum
  misc_feature: Ceres CLONE 2005539
  misc_feature: SWISSPROT Homolog: EC 3.1.27.1 Ribonuclease T(2)
SGAEGSVEELRLCFDKELKPRDCLTTSLTNGSVSKTKHCPQYITLPKYDPLVLANSTGEIMKQFDDFEVSAAIYTA

SEQ ID NO: 40955 - DNA, 663 bp, Panicum virgatum
  misc_feature: Ceres CLONE 2005553
  misc_feature: Encodes the peptide sequence at SEQ ID NO. 40956
  misc_feature (585)..(585): n is a, c, t, g, unknown, or other
tgattgatgagacaaactcaatgtcagacgtctatactgctttctatgagttttctttattgctcgaatcaaagattgacgacaatgatccaaatgctgcactaacacgaaaacgtgttgattcaataaagcaaacttgcaggtcatcaagtttgctaaagagcagggggtaccatttggacaagtcaccttacaagcatattctgctcatgattgttcttctggtggtggctattatatttggggtactgtataccaagtgaagccctgctagttggcctttttttttttcatatggagacttaagagagcaactacgccaatacgattttgttttgtactttgtagtctacaaaggctgtgaaaatccagaagtagtgactgtagatggaatgctggatatggctgcatgctactgtttccgcaatcctatgttccttttctttcctcgcgtgttgcaccgtttgaagctgtttcaagggaatagaaactagttgcgctgacatgtttcctcttcctttatttacaaaaacccgtgtaaaagcattgtgtttttccggaatcgtgtagtggaaagaacatcangcgtgttgagcagcctatgtatgggcgataacaggcgaagatatgatgtgtaaataaagacctgttgatgtacagctt

SEQ ID NO: 40956 - protein, 86 aa, Panicum virgatum
  misc_feature: Ceres CLONE 2005553
  misc_feature: SWISSPROT Homolog: EC 2.5.1.21 Squalene synthase
IDETNSMSDVYTAFYEFSLLLESKIDDNDPNAALTRKRVDSIKQTCRSSSLLKSRGYHLDKSPYKHILLMIVLLVVAIIFGVLYTK

SEQ ID NO: 40957 - DNA, 964 bp, Panicum virgatum
  misc_feature: Ceres CLONE 2005591
  misc_feature: Encodes the peptide sequence at SEQ ID NO. 40958
gaactcaaactcctcggctcacagagtcagtcacatgagcgagggagtgagaaacagagaaagggggaagacgccgccgcggccatgaagatcttagttgcggtgaagcgggtggtggactatgccgtgaaggttcgtgtgaagccggaccggacaggcgtggagacgaccaatgtcaagatgtcgatgaaccccttctgcgagatcgccgtggaggaggcgctccggctccgcgaggccggcgtcgcaaccgaggtcgtcgccgctaccgtcgggcccgcccaatccgccgacaccctccgcaccgcgctcgccatgggcgccgaccgcggcgtccacgtcctccacgaccccgaccccgcgcgcccgctccttcccctcgccgtcgccaagatcctccgcgccgtcgccctccaagaaaagcccgggctcgtcatcctcggcaagcaggcgattgatgacgattgcaaccaaacaggacaaatgttagctggattgcttcaatggccgcaggggacatttgcctcaaaggttatactgggcaaggagaaacaaaaggctactgtggagagggaggtcgatggtggaatcgaaaccatctgccttgatttaccagctgtgatcaccactgatttaagactgaaccagccaaggtatgcgacattaccaaacataatgaaggcaaaatctaaagttatcaagaaaatcaccccccaagagctcaatgtagatatcagatcagacttggaggtcgttgaggtcaatgagccaccaaaaaggaaagcaggggtaattctttcatctgtcgatgagcttcttgacaaattgaaaactgaagcacgtgtcttgtaacaatttgtatattatttctgatatggtctggtgttttaagtatgtaagtaaataaaatgcctttgtgaatgctcaaactgttcatactattcacaaataaaatttagttgac

SEQ ID NO: 40958 - protein, 255 aa, Panicum virgatum
  misc_feature: Ceres CLONE 2005591
  misc_feature (23)..(217): Pfam Name: ETF Pfam Description: Electron transfer flavoprotein domain
MKILVAVKRVVDYAVKVRVKPDRTGVETTNVKMSMNPFCEIAVEEALRLREAGVATEVVAATVGPAQSADTLRTALAMGADRGVHVLHDPDPARPLLPLAVAKILRAVALQEKPGLVILGKQAIDDDCNQTGQMLAGLLQWPQGTFASKVILGKEKQKATVEREVDGGIETICLDLPAVITTDLRLNQPRYATLPNIMKAKSKVIKKITPQELNVDIRSDLEVVEVNEPPKRKAGVILSSVDELLDKLKTEARVL

SEQ ID NO: 40959 - DNA, 670 bp, Panicum virgatum
  misc_feature: Ceres CLONE 2005602
  misc_feature: Encodes the peptide sequence at SEQ ID NO. 40960
actattctcaaggaatctattctgagaacctcttcccacactttccccttcacccttgagaggccatctccaattcatcaccctgctattccttcatactcaggccatcatcatacgagatttgacaatcagcaaagactggtaagaagatgctgaagaaattgttgccaaagactaagagcaagaagaagaaggacgcagcctcctctgcgatacccacgttggatcggctccatgagactctagaaatgctggagaagaaagagtgtttccttcagaaaaagtgttctgctgaaatagaaaaggctaaggattatacaaaatcgaagaataagaatgctgcaattcagtgtctaaagaaaaagaagctgtacgagacacaaattgaacagctatcaaaatttcaattgcgagttcatgaccagattataatgcttgaaagtgcaaaggcaactaccgatactgttgatgctttgcgttctggatcatctgctgtcaaagctattcagcaatcactggacatcgatgatattgagaacgccattgatgaggcaaacggacagacagaaaatatgaggcgaggcgaggcttcgacgcgagacctggaggcggcggtgcgcgaggcgaggcagcagcgatagcgcgcgaggcgccaaggcggcggcgcgag

SEQ ID NO: 40960 - protein, 163 aa, Panicum virgatum
  misc_feature: Ceres CLONE 2005602
  misc_feature (23)..(160): Pfam Name: Snf7 Pfam Description: Snf7
MLKKLLPKTKSKKKKDAASSAIPTLDRLHETLEMLEKKECFLQKKCSAEIEKAKDYTKSKNKNAAIQCLKKKKLYETQIEQLSKFQLRVHDQIIMLESAKATTDTVDALRSGSSAVKAIQQSLDIDDIENAIDEANGQTENMRRGEASTRDLEAAVREARQQR

SEQ ID NO: 40961 - DNA, 642 bp, Panicum virgatum
  misc_feature: Ceres CLONE 2005605
  misc_feature: Encodes the peptide sequence at SEQ ID NO. 40962
aatgtgcaagctagctcactgcgacccagtgtgtgatgatggctcagggaagaggcagtgcaagctgcggcgccctcgccgccgcggcgctcctggtcatcggcctcctcgtgatggcgacgagcgcgccgctcgccgaggcggcggcgtcgtacatggtcggcgactacggcggctggaagttcaacgtcgaccggtgggccaaggggaggaccttccgcgctggcgaccagctcgtgttcaactacaaccgggcggtgcacgacgtggcggcggtgaacgcggcggcgtaccggagctgcgtggtgcccaggggcgccagggtgctgcggagcgggcgcgacaaggtgaggctcggcaggggcacgcactacttcgtctgcaccgtgcggggccactgccaagccggcatgaagatcgccgtcagggccgtgtagggggctgggctgggctgggccgtcgggcggcggctatatccgacttccagagtccagatccaaatccacgccagaaacgccaaaaactttgtggtagctcattagtttgcttagttatactctagtggcgtgcaatctggtggtggtgttgtttctaatgtacgtccaggcttcgtttgccaagtggcttctgtgctgtcactgt

SEQ ID NO: 40962 - protein, 132 aa, Panicum virgatum
  misc_feature: Ceres CLONE 2005605
  misc_feature (47)..(125): Pfam Name: Cu_bind_like Pfam Description: Plastocyanin-like domain
MAQGRGSASCGALAAAALLVIGLLVMATSAPLAEAAASYMVGDYGGWKFNVDRWAKGRTFRAGDQLVFNYNRAVHDVAAVNAAAYRSCVVPRGARVLRSGRDKVRLGRGTHYFVCTVRGHCQAGMKIAVRAV

SEQ ID NO: 40963 - DNA, 669 bp, Panicum virgatum
  misc_feature: Ceres CLONE 2005621
  misc_feature: Encodes the peptide sequence at SEQ ID NO. 40964
aaggcctaagcctttcttccccgcaaagaaagaaacgagcagcagcagcggaacgagagagaagcagcagcagcgacgatggcgagcggcggcatgaagagggagatcagcgagacccacgatgccctccgcttcggcatcaacgccggcgtcaaggccgacctcgcgccgccgcatcctctccagtccaccatccaatcggaggccaagttctgggcggacaagaagaggttcgggacggaggctatctacggatccgccttcaacatccgcaaggatctcgatgcccaaatcctctccaggttccaaaggccccctggtgctttgccatcatctatgcttggatatgaggcactgacaggttccttggatgattttggatttgaagattatcttaacatgcctcaagattctgacagtttccgtcaacctgacatgcaccatggaatggaagttcgccttggcttgtccaagggacctatctgccctagcttcaattgatccatccatgtagttctgcagtacgttgtgcaccacacagtccagtacatcggtcaatagaccatattatcatggtgaaaagtgaaaaccgatgagccttgccacctgttcagtgttcagtgttcagtgtcatgtttcagtcaacaccgaatttagttcttatcccta

SEQ ID NO: 40964 - protein, 140 aa, Panicum virgatum; identical to SEQ ID NO: 10287
  misc_feature: Ceres CLONE 2005621
  misc_feature (2)..(131): Pfam Name: UMP1 Pfam Description: Proteasome maturation factor UMP1

SEQ ID NO: 40965 - DNA, 948 bp, Panicum virgatum
  misc_feature: Ceres CLONE 2005624
  misc_feature: Encodes the peptide sequence at SEQ ID NO. 40966
atccggccatcccccctcccaggaagcgaagcatcccagtcagagtcagccggagcaccacccacccccatggcgcacgcggaggcctccttcgatctgcgccgccggaggatgcaggaccaacgcgccgccatccagcgccggatcacccacgcccgagaccgcgcctccgcaacagccgacgccttcagcgccgccctcctctccgcgcgctccatcgccaaccaaaccgtctccaaccgagcacaactcaaccaactaaaacaacagctccggaaattagaagcggatcttgcacgagccctctccgtccaaacaagcaaaacgtcaaaacacaagctcatgggcgactcaattttgaacaccactgcaacgaacgagcagctcaggagcctgctcatggatcagagggctacaagagatgaatatgtgaatgccatatcaaaccaatcccaagctgttgaatccattaaagctgagagtgatgcaaaaggggataagaacctagacaatgctatcatgtggtacgacaagtttcttggttttcaagttgttggaggagaaggggtgagatttgtgttcagcaaaatagacatgcaaagtcctgacaaggagtattctttttgcataaagcttattgatgaaagatacatcttagtccattgtgctccctttgtgcatggctccgaagaacttgtgaaggatcttaactgcaacaatgagctgtacaaatttgtgaggaccatgagagagaggttccagatcgctacaatcagtggtactttatgatacatattctctttacctgttctgtttcagaaaagaatgtctacattaatggaacttcaatcatgtcaaaggttccaggttcaggagtattgagcatgacaaagtcttatgaacttgactccactatctgtgtatgtgcgtcagtgaaacttcacagcc

SEQ ID NO: 40966 - protein, 239 aa, Panicum virgatum
  misc_feature: Ceres CLONE 2005624
  misc_feature (153)..(230): Pfam Name: Spindle_Spc25 Pfam Description: Kinetochore protein Spc25
MAHAEASFDLRRRRMQDQRAAIQRRITHARDRASATADAFSAALLSARSIANQTVSNRAQLNQLKQQLRKLEADLARALSVQTSKTSKHKLMGDSILNTTATNEQLRSLLMDQRATRDEYVNAISNQSQAVESIKAESDAKGDKNLDNAIMWYDKFLGFQVVGGEGVRFVFSKIDMQSPDKEYSFCIKLIDERYILVHCAPFVHGSEELVKDLNCNNELYKFVRTMRERFQIATISGTL

SEQ ID NO: 40967 - DNA, 672 bp, Panicum virgatum
  misc_feature: Ceres CLONE 2005625
  misc_feature: Encodes the peptide sequence at SEQ ID NO. 40968
atagaagtggtttaatagctgacaaactggaaaaggaaccatcacttagctaccaaactgatgattattggtctcagattgttgataaaaggtacatgtttgatatgccaaaactggaagctgaagagcttaggacaattaagaaggctgatgttatcgattggtataatacatacataagatcaccggccccaaagcgtagacgactagcaatccatgtgtatggttgcaatgcggacattgctgaggctgccaaactccaggaacagttgtggactgcgattgataacgtacaatcgtttaaggtttcgtctcaattttattcaagcctctgctgaggatggcactatctgttgctgtgaaatcacaattcctacagatgagcatctccaaagaaacatcacaattcctacatatgagcatctccaaagaaacaatttttagcagacatttgtggacgtctggatgcacaactcggacattccggaggcatgccaaggtgcaagagtgtcatggacagatggaccataacaaatgactcaggatcctgctgctgatagacgccatgtgaacctgtagttggtctacaggcaagaaattgaagagcattgttgtgacctagcatcaacgttcataatcccattgtttcttatatagttgggcaagaatcag

SEQ ID NO: 40968 - protein, 111 aa, Panicum virgatum
  misc_feature: Ceres CLONE 2005625
  misc_feature: SWISSPROT Homolog: EC 3.4.24.56 Insulysin
RSGLIADKLEKEPSLSYQTDDYWSQIVDKRYMFDMPKLEAEELRTIKKADVIDWYNTYIRSPAPKRRRLAIHVYGCNADIAEAAKLQEQLWTAIDNVQSFKVSSQFYSSLC

SEQ ID NO: 40969 - DNA, 720 bp, Panicum virgatum
  misc_feature: Ceres CLONE 2005639
  misc_feature: Encodes the peptide sequence at SEQ ID NO. 40970
gcgaaagagggagagagggaggagcttagtttaagcggctgcctccccgtctcctgtgccccggcccccgcccccacgcgcgcgccaccgcctccgatccgagctgccgcctacagagtcagcccaggcaacctcaatgttccttgtgagataacatgtctgaacagcaggaacgtgttagcaaaagctcttcctcgagtattagcagcagtactcaggagagtgaggaggaagtgaccattggtacacttataactgaagcaacaaacacaacaaacagtgggaagagccttggaaggcgcctgtcccacttagattcgatcccacacactcctcgagtgaatgggaaaattccagattttaataatgcgacgatagatcatgaatcgttattggaaagattgggcacgtacggcttagctgaatatcagatagaaggagatgggaattgtcagttccgagccctggcagaccagatattccggaatcctgactatcacaaacacgtgaggaaggcagtagtaaagcagctaaaggaattcaggaagcactatgaaggctatgtaccaatggaatataaggtttatctgaagaaaatgaaaagatctggggaatggggagatcatgtgaccttacaggcggctgcagacaggttttctgctaaaatatgcctgttgacatcgtttagagacacatgcctagtcgagataatatcccgag

SEQ ID NO: 40970 - protein, 188 aa, Panicum virgatum
  misc_feature: Ceres CLONE 2005639
  misc_feature (94)..(186): Pfam Name: OTU Pfam Description: OTU-like cysteine protease
MSEQQERVSKSSSSSISSSTQESEEEVTIGTLITEATNTTNSGKSLGRRLSHLDSIPHTPRVNGKIPDFNNATIDHESLLERLGTYGLAEYQIEGDGNCQFRALADQIFRNPDYHKHVRKAVVKQLKEFRKHYEGYVPMEYKVYLKKMKRSGEWGDHVTLQAAADRFSAKICLLTSFRDTCLVEIISR

SEQ ID NO: 40971 - DNA, 603 bp, Panicum virgatum
  misc_feature: Ceres CLONE 2005643
  misc_feature: Encodes the peptide sequence at SEQ ID NO. 40972
atcacaccactcgaattctcgcgctcagattccccaattttccctcctccaaagctctcccgaagcgcggcagcggcgaccatggacgccagcggagccaccgggaaggtgaagaagggggcggccgggcgcaaggcgggtggccccaggaagaagtcggtgtcgcggtccgtgaaggccgggctccagttccccgtaggccgcatcgggcgctacctcaagaagggccggtacgcgcagcgcgtcggcaccggcgcccccatctacctcgcggccgtcctcgagtacctcgccgccgaggtgctggagctggccggcaacgcggcgagggacaacaagaagacgcgcatcatcccgcgccacgtgctccttgcgatccgtaacgacgaggagctcgggaagctgctggccggcgtcaccatcgcccacggcggcgtcctccccaacatcaacccggtgctgctgcccaagaaggccgcggagaaggcggccagcggcggcgccaaggaggccaagtcgcccaagaagggcgccaaatccccgaagaaggcttagacagtagagactccagtagcactgtggtgtaacatgttggtgtttaga

SEQ ID NO: 40972 - protein, 157 aa, Panicum virgatum; identical to SEQ ID NO: 40238
  misc_feature: Ceres CLONE 2005643
  misc_feature (29)..(102): Pfam Name: Histone Pfam Description: Core histone H2A/H2B/H3/H4

SEQ ID NO: 40973 - DNA, 241 bp, Panicum virgatum
  misc_feature: Ceres CLONE 2005645
  misc_feature: Encodes the peptide sequence at SEQ ID NO. 40974
gacaccattacagtacgcactccggctgacgcgccccgcactctctcacaaagctcaagcctttcgctcgctcgctcgctcgcggctacatctacaatggcgcgcttccagctcgcggccctggccatggccatgctcttcgccgcggcggcggcgcaggccccggccgcccccccgacgccggcgcccagggcgtcccccccgccggcgacccctccgccgaccacggcgccggtgtctc

SEQ ID NO: 40974 - protein, 48 aa, Panicum virgatum
  misc_feature: Ceres CLONE 2005645
  misc_feature: Useful for making plants with altered carbohydrate content
  misc_feature: Useful for making plants with altered cell wall content and/or composition
MARFQLAALAMAMLFAAAAAQAPAAPPTPAPRASPPPATPPPTTAPVS

SEQ ID NO: 40975 - DNA, 704 bp, Panicum virgatum
  misc_feature: Ceres CLONE 2005651
  misc_feature: Encodes the peptide sequence at SEQ ID NO. 40976
agcagtcactgagccaagagggccaaggcggatacagcgcccaacgccaccatctcgccggggacggtcgcttctggccacccacagagctttggagtggtgggatggccacccataagaactttcaggatgaacagcctattcaaccaggccaaagacaatgcttcagaggctagcaccaagaaggccgctgatgaatctgacatgcagaaagacgaggagagcgagaagaaagggcgggttgtcggttgggtgaaggtgaacatggatggagatatcattggaaggaaggtcgatcttaacgcccatcgttcgtataagactcttgcctcagcacttgagctgatgttcatgaagccatccatcagtctttacacttctagtagtgcaaagtctctgaatctattggacagctcatcggaatatcagctcacctatgaggactgggatggggattggatgctcgtcggagatgttccatgggagatgtttgtaggttcagtgaagaggctcaagatcatgagggcatcagatgctaatggtctgggtctgcgattccaaggggttcacagagctgcagctttcacaagagctagaacttgagaagcactgatggcgttcgatctagagagctataccactggtgaagcttgaaatttgtttcatatcacataacagcagtccgtatctttggcatagttgtg

SEQ ID NO: 40976 - protein, 157 aa, Panicum virgatum
  misc_feature: Ceres CLONE 2005651
  misc_feature (2)..(143): Pfam Name: AUX_IAA Pfam Description: AUX/IAA family
  misc_feature: The sequence is a functional homolog of SEQ ID NO 1149 in the 10/412,699 US patent application
  misc_feature: The sequence is a functional homolog of SEQ ID NO 742 in the 10/374,780 US patent application
  misc_feature: The sequence is a functional homolog of SEQ ID NO 1780 in the 10/412,699 US patent application
  misc_feature: The sequence is a functional homolog of SEQ ID NO 2008 in the 10/374,780 US patent application
  misc_feature: The sequence is a functional homolog of SEQ ID NO 678 in the 11/479,226 US patent application
  misc_feature: The sequence is a functional homolog of SEQ ID NO 204 in the 10/225,066 US patent application
  misc_feature: The sequence is a functional homolog of SEQ ID NO 292 in the 10/412,699 US patent application
  misc_feature: The sequence is a functional homolog of SEQ ID NO 40 in the 10/225,068 US patent application
  misc_feature: The sequence is a functional homolog of SEQ ID NO 82 in the 10/374,780 US patent application
  misc_feature: Useful for making plants with altered terpenoid content
MNSLFNQAKDNASEASTKKAADESDMQKDEESEKKGRVVGWVKVNMDGDIIGRKVDLNAHRSYKTLASALELMFMKPSISLYTSSSAKSLNLLDSSSEYQLTYEDWDGDWMLVGDVPWEMFVGSVKRLKIMRASDANGLGLRFQGVHRAAAFTRART

SEQ ID NO: 40977 - DNA, 686 bp, Panicum virgatum
  misc_feature: Ceres CLONE 2005653
  misc_feature: Encodes the peptide sequence at SEQ ID NO. 40978
actattcgcctttccgcacccgccgctcggtcgccttcgagttccaccagccaccaaacccgccggggagaagtcgagaggagcaagtcgccgagaagaggagatggcccgtacgaagcagaccgcccgcaagtccaccggagggaaggcccctcgcaagcagctcgccaccaaggcggcgaggaagtcggcgccgacgaccggcggcgtgaagaagccccaccgctacaggcccgggaccgtggcgctccgcgagatccgcaagtaccagaagagcacggagctcctgatccgcaagcttcccttccagcgcctggtccgcgagatcgcgcaggacttcaagacggacctccggttccagagccacgccgtgctggcgctccaggaggccgccgaggcctacctcgtcgggctcttcgaggacaccaacctctgcgccatccacgccaagcgcgtcaccatcatgcccaaggacatccagctcgcccgccgcatccgcggcgagcgcgcgtaagccgcagccgccgctgccgtaccagtagtggagatggaggaggtcaagatggatctggatttagctgtactagttgtcgttctcggtttggttagtgtaaaaacaggtttacaagtctattttgtgcttcgctgctattgtggctctcgcttcatgatgaagcgaccttgtt

SEQ ID NO: 40978 - protein, 136 aa, Panicum virgatum; identical to SEQ ID NO: 9871
  misc_feature: Ceres CLONE 2005653
  misc_feature (58)..(132): Pfam Name: Histone Pfam Description: Core histone H2A/H2B/H3/H4

SEQ ID NO: 40979 - DNA, 701 bp, Panicum virgatum
  misc_feature: Ceres CLONE 2005663
  misc_feature: Encodes the peptide sequence at SEQ ID NO. 40980
ccagcccctacccgcccgtccagccccacccgcccatcccccgacgccgcccccagacccccgcttctcgtcgccacctcctcgcggcccgcctccgccgcccgcctgccgccgcaagcccgcagcgccgccacccactggtaagccacacagccccctttccccacctcgatctcgcacgcctagggtttcgtctcgccgccttccaccaccgccaagatgccgaagaacaagggtaagggaggcaagaaccggaagcggggtaagaacgaggcggacgacgacaagcgcgagctcgtcttcaaggaggacgggcaggagtacgcccaggtgacccgcatgctcggcaacggccgctgcgaggccatctgcgtcgacggcacgcgccgcctctgccacatccggggcaagatgcacaaaaaggtctggatcgcggcgggcgacatcgtcctcgtcggcctccgcgactaccaggatgacaaggccgacgtcatcctcaagtacatgaacgacgaggcgcgcctgctcaaggcctacggcgagctccccgagacgctcaggctcaacgagggagtcgacgtcgacgggcccgaggacggcgaggagggcagcgactacatccagttcgaggacgaggacatcgacaagatctaagattcctgtttctcctcgcggttactttcttatatgcgacttattgt

SEQ ID NO: 40980 - protein, 144 aa, Panicum virgatum; identical to SEQ ID NO: 10083
  misc_feature: Ceres CLONE 2005663
  misc_feature (30)..(94): Pfam Name: eIF-1a Pfam Description: Translation initiation factor 1A / IF-1

SEQ ID NO: 40981 - DNA, 955 bp, Panicum virgatum
  misc_feature: Ceres CLONE 2005675
  misc_feature: Encodes the peptide sequence at SEQ ID NO. 40982
atccatcacacccagctcccactctctcctccatcctacagctatagctagtagctactctactccaagggcatgaagagcaggaagggctacggcgggcagcagggccacctgctgagcccggtgggcagcccgccgtcggacaacgagtccggcgcggcggcggcggccgggtgcgggagcagcgcggggtacgccggcggcggggactcgccggccaaggagctggaccggttcctgccgatcgcgaacgtgtcgcgcatcatgaagcggtcgctgccggcgaacgccaagatctccaaggaggccaaggagacggtgcaggagtgcgtgtcggagttcatcagcttcgtcaccggggaggcctccgacaagtgccagcgcgagaagcgcaagaccatcaacggcgacgacctgctctgggccatgaccacgctcggcttcgaggcctacgtcggcccgctcaagtcctacctcaaaccgctaccgcgaggccgagggcgagaaggccgccgtgggcggcgcgcggcacggcgacggcgccgccgacgagggcccgctcggcgcgggcgccgtcgcggcggcggcgcccgctgaccgcgcgggccaccacgacgccggcggctcgatggacgtcgggctcttgatgggggtcggcgccggcaggttcggcgccggcggcgggacgtcgtcgtactactcggcggccgcggggagggcgtacggcggggacgggtccaaggtgctggagttcgacggcgaggaggagaacggccgcggcatgcagagggggttcggcgccggccacctccacggcgccgtgcaattgtgaagggcgcgccgtagctgtagttgtaggaggcgacgaacggcatatgcttcgtaatcgtaattaattaactaaatttgcttcgcgtactaatgaactgttgccgctctgcagctgttaagcagc

SEQ ID NO: 40982 - protein, 174 aa, Panicum virgatum
  misc_feature: Ceres CLONE 2005675
  misc_feature (54)..(119): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 791 in the 10/374,780 US patent application
  misc_feature: The sequence is a functional homolog of SEQ ID NO 60 in the 10/675,852 US patent application
  misc_feature: The sequence is a functional homolog of SEQ ID NO 62 in the 10/675,852 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 44 in the 10/675,852 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 66 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 14 in the 10/675,852 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 64 in the 10/675,852 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: Useful for making plants with modulated biomass
  misc_feature: The sequence is a functional homolog of SEQ ID NO 12 in the 10/675,852 US patent application
  misc_feature: The sequence is a functional homolog of SEQ ID NO 42 in the 10/675,852 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: Useful for making plants with modulated drought sensitivity
  misc_feature: Useful for making plants with altered alkaloid content
  misc_feature: Useful for making plants with altered terpenoid content
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 793 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 803 in the 10/374,780 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 795 in the 10/374,780 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 22 in US patent 7166765
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
MKSRKGYGGQQGHLLSPVGSPPSDNESGAAAAAGCGSSAGYAGGGDSPAKELDRFLPIANVSRIMKRSLPANAKISKEAKETVQECVSEFISFVTGEASDKCQREKRKTINGDDLLWAMTTLGFEAYVGPLKSYLKPLPRGRGREGRRGRRAARRRRRRRGPARRGRRRGGGAR

SEQ ID NO: 40983 - DNA, 705 bp, Panicum virgatum
  misc_feature: Ceres CLONE 2005688
  misc_feature: Encodes the peptide sequence at SEQ ID NO. 40984
gagccgcccattcgcgccgccgccgctcgccgccacccttagcgccgccgccctcggttgtcgccgcccgcggccgctcgatccgatggctcccacgaagaagtcggtacgaaccctaaccgatcttctcgtgcactattcctcccatttcgcggtcagtgttttcgcccgtgttgttgttttcctgatggttttcgatctgtgcagaagaagagcacggagagcatcaacaacaagctgcagctggtgatgaagagcggcaagtacacgctcggctacaagaccgtcctcaagacgctgcgcaactccaaggggaagctgatcatccttgcgaacaactgccctccgcttaggaagtctgagatcgagtactatgccatgctcgccaaagttagcgtgcatcatttccatggaaacaatgttgatctcggcactgcctgcggcaagtactacagagtgtgctgcctcagtatcattgacccaggtgactcggacatcatcagcaccacccctggcgcccagtgagcaaagaagaggagcgagctttgcctatccctagttgagatgagatatagggctcagaccttgccaggccaatggccgtttcttgtttgtctttagtctatgatgagttgatcttgcatacatacctcatggttgttatgtatggcatatctatggttttgtttgatgagatcgtcataa

SEQ ID NO: 40984 - protein, 91 aa, Panicum virgatum
  misc_feature: Ceres CLONE 2005688
  misc_feature (1)..(85): Pfam Name: Ribosomal_L7Ae Pfam Description: Ribosomal protein L7Ae/L30e/S12e/Gadd45 family
MKSGKYTLGYKTVLKTLRNSKGKLIILANNCPPLRKSEIEYYAMLAKVSVHHFHGNNVDLGTACGKYYRVCCLSIIDPGDSDIISTTPGAQ

SEQ ID NO: 40985 - DNA, 705 bp, Panicum virgatum
  misc_feature: Ceres CLONE 2005726
  misc_feature: Encodes the peptide sequence at SEQ ID NO. 40986
cccccgagccctatccttttcccctcccctgggtctccccacccccaaggccccaactcctatcctctcctcacctcacccgcgccgccgcagcagcgccgccgccgccgcggcttcccttcctcacccgagccaagatgaatgttgacaagctcaagaagatggcaggtgccgtgcgcaccggtggaaagggtagcatgcgcaggaagaagaaggcagtccacaagactacaaccacagatgacaaaaggcttcagagcaccctgaaaagagtaggagtgaacactatccctggtattgaagaggtcaacatcttcaaggatgatgttgttattcagtttgtgaatcctaaagtgcaagcttctattggtgctaatacatgggtggtcagtggaactccacagacaaagaagctgcaagatctgcttccgtcgattatcaatcagcttggtcctgacaacttggacaacctgcggaggcttgcggagcaatttcagaagcaggttcctggagcttcaagcgctgaggctggtgctagcacaggtgctgctcaggatgacgatgatgacgttcctgagcttgtccctggagagacatttgaggaggctgctgaagagaaaaaggagtcgtcataatgttgctgcgtgcctgctgttgtgaagggtttataagtcaagcattgccattagaaaagacattctgttg

SEQ ID NO: 40986 - protein, 165 aa, Panicum virgatum; identical to SEQ ID NO: 39828
  misc_feature: Ceres CLONE 2005726
  misc_feature (34)..(92): Pfam Name: NAC Pfam Description: NAC domain
  misc_feature: Useful for making plants with modulated biomass
  misc_feature: The sequence is a functional homolog of SEQ ID NO 1617 in the 11/479,226 US patent application
  misc_feature: The sequence is a functional homolog of SEQ ID NO 786 in the 10/412,699 US patent application
  misc_feature: The sequence is a functional homolog of SEQ ID NO 1614 in the 11/479,226 US patent application
  misc_feature: The sequence is a functional homolog of SEQ ID NO 784 in the 10/412,699 US patent application

SEQ ID NO: 40987 - DNA, 693 bp, Panicum virgatum
  misc_feature: Ceres CLONE 2005737
  misc_feature: Encodes the peptide sequence at SEQ ID NO. 40988
aaaggcgacgaccttttccacgagagagagggatgggctgctgcagcagccggagcaccgattctccggccagccgcgcgacgcggtggcgctccacgggcatcgtcgccctccgcgacgccaggttgaaggaagtgccaaatgaagtgctgcaagtgggaaattccttgagaactctggatttgacaaacaacaaactagttgagattccccaggatgttggcagacttgtgaatatgcaaagacttgttttggctgctaatttgattgaaatcattccagctaactttggacacctgcggaatcttaaaatcctcacccttgacagaaataggatctctatgttgcctgaagaattgggttctttgtcaaaccttcaacaactttctatttctcagaattctttactgtgcctgcctaagagtgtaggagatttgcgcaatatgtcaatactcaatgtatttgataacaaattaaaggaacttccggaatcaattggaggttgcaattccctggaagaattgcgggcaaatggtaattcaattgaagacatgccctcgtcaatttgcaaccttgtgtgccttaaatccttatcactgaatggaaacaaaattcgtcagctttcgcaaaacttactgaaagactgcacggctcttcagagtatatcgctgcatgacaaccccatcacaatgg

SEQ ID NO: 40988 - protein, 220 aa, Panicum virgatum
  misc_feature: Ceres CLONE 2005737
  misc_feature: SWISSPROT Homolog: EC 2.7.11.1 Non-specific serine/threonine protein kinase
MGCCSSRSTDSPASRATRWRSTGIVALRDARLKEVPNEVLQVGNSLRTLDLTNNKLVEIPQDVGRLVNMQRLVLAANLIEIIPANFGHLRNLKILTLDRNRISMLPEELGSLSNLQQLSISQNSLLCLPKSVGDLRNMSILNVFDNKLKELPESIGGCNSLEELRANGNSIEDMPSSICNLVCLKSLSLNGNKIRQLSQNLLKDCTALQSISLHDNPITM

SEQ ID NO: 40989 - DNA, 594 bp, Panicum virgatum
  misc_feature: Ceres CLONE 2005756
  misc_feature: Encodes the peptide sequence at SEQ ID NO. 40990
cccgattcgatcagccgccatggcccgctcctcctcgcagtcccagtcctccgtcggcggcgccggcgctggcgccggagcccgcccggccaccgttggcccgcgcggcacggccgcagctgccgccggcatgcgccgccgccgcgccaccgccagcgccgggggagggggcttctccggcggcggagggagcaacatgcttcgattctacaccgacgaggccccgggtctgcgcctctcgccaaccatggtgctcgtcatgtcgctgtgcttcatcggattcgtcaccgccctccacgtcttcggcaagctctaccgctcccgcaccgcagcagcctccgcgtgatccatcccatcgcatccctccggcgcgagtatcatcagatcacaaggttttcaatatatcatcatcagtctacttactcgtgtcttgcctagctttccttcctgtgctagatctggagggagatgaatggaaccctacaacttaaatgatgccccttcttttgccttgttcatcccctttccttttttttagtgcctttttatttactcccaagatgcaaagagttgtgccaagtcactgtaatcatg

SEQ ID NO: 40990 - protein, 108 aa, Panicum virgatum; identical to SEQ ID NO: 27967
  misc_feature: Ceres CLONE 2005756
  misc_feature (54)..(99): Pfam Name: Sec61_beta Pfam Description: Sec61beta family

SEQ ID NO: 40991 - DNA, 650 bp, Panicum virgatum
  misc_feature: Ceres CLONE 2005779
  misc_feature: Encodes the peptide sequence at SEQ ID NO. 40992
ttcctcccacaacattggtccgaagcatacatagggggaagagctttaagattgggtcactgcagatgttcatggagaacagtggaagcactgaggatatgggtcctcgagctttccctgtcaaggaggttcacaaaatagcagttttggatattaggttagcaaatgctgatcgtcatgctgggaatattctagtgcacaaggaggaagaaggtgacaactacaagctgattccaattgatcatggctactgcttgcctgagaagtttgaagactgtacatttgagtggctctactggccccaagcccgtgagccattcagcggtgaaactgttgaatacatcaaatcacttgatgctgagaaggacatcaaacttctcaagtttcatgggtgggagctgtctccgaaatgtgctcgtgtcctgcgcatcagcaccatgcttctcaagaaaggtgcagctcgtggcctcacaccatttgacatagggcgcatactgtgtagggaaactgtgaatagagactctgagattgaggacatcatccaggaagcagaggattctgttctcccagggtcaagcgaaaatatgttcttagagaccatatctgatatcatagaccgtcacctcgacaaggagtttgcttagagtttt

SEQ ID NO: 40992 - protein, 213 aa, Panicum virgatum
  misc_feature: Ceres CLONE 2005779
  misc_feature (1)..(168): Pfam Name: PI3_PI4_kinase Pfam Description: Phosphatidylinositol 3- and 4-kinase
PPTTLVRSIHRGKSFKIGSLQMFMENSGSTEDMGPRAFPVKEVHKIAVLDIRLANADRHAGNILVHKEEEGDNYKLIPIDHGYCLPEKFEDCTFEWLYWPQAREPFSGETVEYIKSLDAEKDIKLLKFHGWELSPKCARVLRISTMLLKKGAARGLTPFDIGRILCRETVNRDSEIEDIIQEAEDSVLPGSSENMFLETISDIIDRHLDKEFA

SEQ ID NO: 40993 - DNA, 223 bp, Panicum virgatum
  misc_feature: Ceres CLONE 2005791
  misc_feature: Encodes the peptide sequence at SEQ ID NO. 40994
acagtacgcgctccggctgacgcgccccgcacacaaaagctcaagtcttgcgctcgctcgctcgcggctacgtctacaatggagcgcttccagctcgcgaccctggccatggccatgctcttcgccgcggcggcggcgcaggccccggccgccgccccgacgccggcgcccagggggtcccccccgccggcaactcctccgccgaccccggcgtaacgagtgt

SEQ ID NO: 40994 - protein, 45 aa, Panicum virgatum
  misc_feature: Ceres CLONE 2005791
  misc_feature: Useful for making plants with altered carbohydrate content
MERFQLATLAMAMLFAAAAAQAPAAAPTPAPRGSPPPATPPPTPA

SEQ ID NO: 40995 - DNA, 866 bp, Panicum virgatum
  misc_feature: Ceres CLONE 2005798
  misc_feature: Encodes the peptide sequence at SEQ ID NO. 40996
agcaatctttgcggccaaaagaaaagggtggagaagcgaggaggaaaagggtggcaagaaaccacggagcgtcttcctcctaccgtctataaattcccctccctttctccttccctatataggaggcatcgacgccaagaagagggaggagcaccaaggacttccggcgcctgttcaggatctacatcttcccgagcgagttcttggttgatctcttcctcttcgaccacctcccaggcccttggtgtagcttgccactctcgccagtcaagttttcatgtctgatcttggcattcagatcccaactgccttcgatccctttgctgaggccaatgctggggactctggtgcggcagcaggatcaaaggactacgttcatgtacgcagccagcagcgtaatggtcgcaagagtctgactactgtccagggattgaagaaggaattcagctacagcaagatcctaaaagatctcaagaaagagttctgctgcaatggtacagtggttcaggacccagagcttggacaggtcattcaactccagggtgatcagaggaagaacgtctcaaatttccttgtccaggccggcattgtgaagaaggaacatatcaagattcatggtttctgagcaaccgtcgggtctatagcaagccctgcatgcaaagcagctatatatccggggtggagcatatccggctgtgtaaaagcaggcctacgcctgtgcgttctaccatacacataaaacctagccacctctctgcttgtatgcttgttaccattgtgtccaaacctgtacgaggcaccatcgttcgatggcttgcttctctatcagaaggttgaataaatgcaatttcgctatgctgtgtgcc

SEQ ID NO: 40996 - protein, 115 aa, Panicum virgatum; identical to SEQ ID NO: 12590
  misc_feature: Ceres CLONE 2005798
  misc_feature (27)..(108): Pfam Name: SUI1 Pfam Description: Translation initiation factor SUI1
  misc_feature: Useful for making plants with modulated biomass
  misc_feature: Useful for making plants with modulated flowering time

SEQ ID NO: 40997 - DNA, 597 bp, Panicum virgatum
  misc_feature: Ceres CLONE 2005827
  misc_feature: Encodes the peptide sequence at SEQ ID NO. 40998
agttgctgtttttatatcattctttgtttctgctgtactccacgagctatgtgttgctgttccctgccacatactcaagttctgggctttcttaggaatcatgttgcagattccccttatcgtattgacatcttacctcaaaaataaattcagagacacgatggttggcaatatgatcttttggttctttttctgcatctacgggcaacctatgtgcgttctcttgtattaccatgatgtgatgaacaggatcaactagacaacataaacttctgcaagtccttctttgcgagtcactcttccatcatggaatctgaaaagcaataatttgtgttcactccgccaactgcatatattttttatccctttgctacggccatccaggtttttcaagggaatccagtgtatatcattttatcatgtgtatgatagctagccttatctcactcttgtatctgtacataagcttcattctggtgaggttctacatgtaactgtaatggaaatattattcccctttctgcactggtagtgcactagtgccacatgctgacctgctcatgatgctagtataacatcatttggtgtctagcatgg

SEQ ID NO: 40998 - protein, 85 aa, Panicum virgatum
  misc_feature: Ceres CLONE 2005827
  misc_feature: SWISSPROT Homolog: EC 2.3.1.20 Diacylglycerol O-acyltransferase
  misc_feature: The sequence is a functional homolog of SEQ ID NO 2 in US patent 7067718
VAVFISFFVSAVLHELCVAVPCHILKFWAFLGIMLQIPLIVLTSYLKNKFRDTMVGNMIFWFFFCIYGQPMCVLLYYHDVMNRIN

SEQ ID NO: 40999 - DNA, 645 bp, Panicum virgatum
  misc_feature: Ceres CLONE 2005856
  misc_feature: Encodes the peptide sequence at SEQ ID NO. 41000
cttttctttcccgtctccccggttctcttcctcctctgctctctctctttctccggcaaccgagcgcacaagagtggtgaggaggcccgccggcccggtgccgccgtgggacccctcactggcgagcgcgctccctttggggtgagcgcgctgccgtcgagtggcctcgctgtagtgcccagagggcacgcgcagcgctcccagacccggagctccggggctatacggtggctgtaggcagccgcgccggcggtgacccccacgaccaggaggccagaaggctcgcgatgagattgacgcatgcgtcgggaaaccaaaacgcctactggaggcgaccgacgtccccaagctgccatacctgcgatgcatcatcctagagacgcttcgcctgtacccagttgtaccgcttctagtccctcgtgaatcctctgcagactgcaccgtcaatgggttccatattcccaaaggaaccatgcttctcgtgaacacatttgtgatctatagggatcctagggcatgggatgacccagaaacgttcctcccggaaaggtttgaggatggcaggaacaataatcaagctggtaagatggccatgtcatttggcatggggagacgacggtgcccagcagagaaccttggcatgca

SEQ ID NO: 41000 - protein, 57 aa, Panicum virgatum
  misc_feature: Ceres CLONE 2005856
  misc_feature: SWISSPROT Homolog: EC 1.14.13.89 Isoflavone 2'-hydroxylase
  misc_feature: Useful for making plants with modulated nitrogen use efficiency
MLLVNTFVIYRDPRAWDDPETFLPERFEDGRNNNQAGKMAMSFGMGRRRCPAENLGM

SEQ ID NO: 41001 - DNA, 705 bp, Panicum virgatum
  misc_feature: Ceres CLONE 2005888
  misc_feature: Encodes the peptide sequence at SEQ ID NO. 41002
aaaaaaaaactctccgactcctccccttggtcttccttcctggcggcggcgactgggcgagcggcggcgctactcgtcacgtcttcgcccagccctttgccggcgacgagcatccaccaggggaaatggttgagtacctcttggacgataacttcagtgtgagcaggctcgatcctgatggcaagaagtttgacagagtcactcgcatcgaagctcataatgagcagatgcacatgcaactagatattgctactgagatttacccgatgcgtgccggtgacaagttcaacatggtgttagctcctactctgaatctggatggaacaccagacactggctactacacacaggctggaaggaaaacacttgctgacaagtttgactatgtcatgcatggaaagctttacaagatctcagaagacagttccaccagctcatctactaaagtggagatctatgcctcttttggtggcctcctgatgctgcttaggtgtgatagttccagtgcagctagcttcgagctggatcagaggctgtttcttcttatcagaaaggtgtaaacgtattggctactcgaaaggctggttaccttgttgactgtactcaacttccaccctatatgtactatcagtgggctttcaattggtagaaacaacttctaccatgcagtgatgtaatctcgctacaactgagcccgtgaagggc

SEQ ID NO: 41002 - protein, 144 aa, Panicum virgatum
  misc_feature: Ceres CLONE 2005888
  misc_feature (7)..(143): Pfam Name: RNA_pol_Rpb8 Pfam Description: RNA polymerase Rpb8
MVEYLLDDNFSVSRLDPDGKKFDRVTRIEAHNEQMHMQLDIATEIYPMRAGDKFNMVLAPTLNLDGTPDTGYYTQAGRKTLADKFDYVMHGKLYKISEDSSTSSSTKVEIYASFGGLLMLLRCDSSSAASFELDQRLFLLIRKV

SEQ ID NO: 41003 - DNA, 345 bp, Panicum virgatum
  misc_feature: Ceres CLONE 2005912
  misc_feature: Encodes the peptide sequence at SEQ ID NO. 41004
agaacccgcccctcctcctccgccgccgccgcacccgccggccgctcgccgctcgcgccatgggtatcgacctcgtcgacgggggccggaataagaacaccaagcgcaccgctcccaaggccgacgatgtctacctcaaggtcctcgtccagctgtaccgctacctggttcgcaggagcaagaacgactacgccgccacgatcatgatgcgtctcttcaggagcaagaccaacctaccgccgctctcgctcccccgcctctaccagtgcatggagggcaaggaaaactagattgctgtgatcgtgggcaccgtgaccgacgacaacagggtctacaaggtgccga

SEQ ID NO: 41004 - protein, 76 aa, Panicum virgatum
  misc_feature: Ceres CLONE 2005912
  misc_feature: Useful for making plants with modulated nitrogen use efficiency
MGIDLVDGGRNKNTKRTAPKADDVYLKVLVQLYRYLVRRSKNDYAATIMMRLFRSKTNLPPLSLPRLYQCMEGKEN

SEQ ID NO: 41005 - DNA, 675 bp, Panicum virgatum
  misc_feature: Ceres CLONE 2005940
  misc_feature: Encodes the peptide sequence at SEQ ID NO. 41006
actcactctccatccagcgcgagctcgcgagagggggcagcaggtcggcagcagagcgagagcgcgcgtgccagcccatggcgagcaccaacatggcgtcggccacctcgcggttcatgctggccgcgggcgtgcccgcggcggcgggcagcggcggccgcgtcggcttcgcgtcgccgcccggcagggtgcagggcaggaggctcgtggcgcgcgccgaggaggaggccgcacccgcggcggaaggggagggcgccgtggccaccaagcccaaggccgagaagccgccgccgatcgggcccaagaggggcgccaaggtgaagatcctgaggagggagtcctactggtacaacgggattggcaacgtcgtcacagttgatcaggaccccaacacccgctacccggtggtggtgcggttcaacaaggtgaactacgccggcgtgtccaccaacaactacgccttggacgagatccaggaggtgaaatgaaaatgagccaggctgcctcaagggccgccgtgcccccgtgttgtcactgtagcctgtgaaacgagggtgttaaagctgctgtgctagcgcgtcacgacatcttgtgtgtaatagcttaatctctgtaatcattgtgtaattgcttgcttgctacaccacggacgactcaataatctcctgctcttaa

SEQ ID NO: 41006 - protein, 136 aa, Panicum virgatum
  misc_feature: Ceres CLONE 2005940
  misc_feature (75)..(136): Pfam Name: PSI_PsaE Pfam Description: Photosystem I reaction centre subunit IV / PsaE
MASTNMASATSRFMLAAGVPAAAGSGGRVGFASPPGRVQGRRLVARAEEEAAPAAEGEGAVATKPKAEKPPPIGPKRGAKVKILRRESYWYNGIGNVVTVDQDPNTRYPVVVRFNKVNYAGVSTNNYALDEIQEVK

SEQ ID NO: 41007 - DNA, 638 bp, Panicum virgatum
  misc_feature: Ceres CLONE 2005962
  misc_feature: Encodes the peptide sequence at SEQ ID NO. 41008
aacagctagcgtagcgaggcgagcagagcagccaagcatggagtccgaaggcgccggcgaggtgcggcactgggccgcggacgtcaacggcatctccctccacgtcgccgagcgtggcccctccaccgggccggcagtcctcctcatccacggcttcccggagctgtggctctcctggcgccaccagatggccgcgctcgccgcccgcggcttccgcgcgctggcccccgacctccgcggctacggcgactcctctgttcccgccgacccagccgcctactccatcttccacatcgtcggcgacttggtcgccctcctcgaccacctgcgcctcccaaaggtgttggtcgttgggcacgattggggtgcgcatgtggcgtggcacctctgcttgttccggccggacagggtgcgcgccgccgtcatcctgggcattccctactttccccgcggccctcgcccgatgaccgagtcctttgcaaagctcggcgacggcttttacatcaatcagtttcaggtgaggatctcttgcgctgctcaactacttcagagctattatgtggactggaaatttcagtggcattgcaatgcttggtgatagtgaaatgctggtgggattatttgctacttttcgcaag

SEQ ID NO: 41008 - protein, 186 aa, Panicum virgatum
  misc_feature: Ceres CLONE 2005962
  misc_feature: SWISSPROT Homolog: EC 3.3.2.10 Soluble epoxide hydrolase
MESEGAGEVRHWAADVNGISLHVAERGPSTGPAVLLIHGFPELWLSWRHQMAALAARGFRALAPDLRGYGDSSVPADPAAYSIFHIVGDLVALLDHLRLPKVLVVGHDWGAHVAWHLCLFRPDRVRAAVILGIPYFPRGPRPMTESFAKLGDGFYINQFQVRISCAAQLLQSYYVDWKFQWHCNAW

SEQ ID NO: 41009 - DNA, 512 bp, Panicum virgatum
  misc_feature: Ceres CLONE 2005969
  misc_feature: Encodes the peptide sequence at SEQ ID NO. 41010
ctttcgatatgggtgctcctccacatggaggcattgcctatggattggatcggttggtgatgctcttggctggtgagagctcaatccgggatgtgatagcattccccaagactacgacagctcagtgtgcactcaccaaagcaccatctgctgtagatcctcagcaactgaaggatcttgccttcccaaagtctactttgtaacactgttgagaattttgggttatattttgaggcgcattctagttttgcatggtagggaatgcgctttgttcacgagaactttccaaccctggaaaatctatagaagacggttaatacaaagttcaggaaatatggattctcaagagtttcggcagcgatgctatgcatttgtatacatccgccttgtaaattattcaacataatacgaattgttgtgcaaaatgtgaactgcacggtgctccatttgtttgcacctggtagttttttcttcatgcaataaagatttctcccaggcttatgcttggaaat

SEQ ID NO: 41010 - protein, 66 aa, Panicum virgatum
  misc_feature: Ceres CLONE 2005969
  misc_feature: SWISSPROT Homolog: EC 6.1.1.12 Aspartate--tRNA ligase
FDMGAPPHGGIAYGLDRLVMLLAGESSIRDVIAFPKTTTAQCALTKAPSAVDPQQLKDLAFPKSTL

SEQ ID NO: 41011 - DNA, 622 bp, Panicum virgatum
  misc_feature: Ceres CLONE 2005975
  misc_feature: Encodes the peptide sequence at SEQ ID NO. 41012
cattagcgcttatatggtctgtgcggggaggaaactcttctcttctaccacaaacgctacagctggtgacagtaataacaaagcagaagctaaaatatctgtgacttttgtcgataaggatggtgaggaaaagcttgttaaagttcctcttggaatgtcaatgctagaggctgctcatgagaatgacatagaacttgaaggagcatgtgaaggctctcttgcatgttcaacatgccatgtgattgtaatggatgtaaactactacaacaaaatggaagatcctgtggatgaagaaaatgatatgctggaccttgcttttgggctcactgagacatctcgccttggctgccaagtaattgcaagccctgagcttgatggcatacgtttggcactgccatcagcaaccagaaatttcgctgttgatgggtatgttgcgaaatcacactgactgacggagagcattaagatcatgaaagtcgcatgttggaattgggtacctgctcagtttaacagaataagagaatcaaataaattttttcttatgcttttcttgtcatatcttcaattctgaaattcatattaacctggtttccttctctaattttggtgagatggaaaatcc

SEQ ID NO: 41012 - protein, 148 aa, Panicum virgatum
  misc_feature: Ceres CLONE 2005975
  misc_feature (37)..(122): Pfam Name: Fer2 Pfam Description: 2Fe-2S iron-sulfur cluster binding domain
ISAYMVCAGRKLFSSTTNATAGDSNNKAEAKISVTFVDKDGEEKLVKVPLGMSMLEAAHENDIELEGACEGSLACSTCHVIVMDVNYYNKMEDPVDEENDMLDLAFGLTETSRLGCQVIASPELDGIRLALPSATRNFAVDGYVAKSH

SEQ ID NO: 41013 - DNA, 635 bp, Panicum virgatum
  misc_feature: Ceres CLONE 2005979
  misc_feature: Encodes the peptide sequence at SEQ ID NO. 41014
attcccccacagcacacacagcagctaatccagactcacactactgcagcatttgcttttcttagcacgaccgccgatcgataattaataataatacaacgataatggcggctctgatgatgaagaacaagaagcagatgcaggcggtggtggccttggccgttgtggtggcggcggcggcgctggtggcgtcggcgtcggcggccatcacctgcgggcaggtgggttcggcgctggcgccgtgcatcccgtacgcgacggggaaggcgagcgcgctgccgtcgtcgtgctgcggcggcgtgcgcagcctcaacagcgcggcgcgcacgagcgcagaccggcaggcggcgtgccggtgcctcaagagcctggccagcaccgtcaagtcggtgaacatgggcaccgtcgccaccatccccggcaagtgcggcgtctccgtgccattccccatcagcatgtccactgactgcaacaaggtcaactaataaattgtgcatcaatataataatcctaccagctgatgaggaagctcagaagctagctgctagctagcgagctatattcaggagaataaaataaagttgaggcaccatcagcagcacatcatctatatatattattgttgtactcgatct

SEQ ID NO: 41014 - protein, 126 aa, Panicum virgatum; identical to SEQ ID NO: 40598
  misc_feature: Ceres CLONE 2005979
  misc_feature (37)..(122): Pfam Name: Tryp_alpha_amyl Pfam Description: Protease inhibitor/seed storage/LTP family

SEQ ID NO: 41015 - DNA, 666 bp, Panicum virgatum
  misc_feature: Ceres CLONE 2005981
  misc_feature: Encodes the peptide sequence at SEQ ID NO. 41016
cttcgcacttccgctccgccccgcctcgccgtctcgcgccgccgctcgcctctccgcccgccgcgaggatgccgttcaagaggttcgtggagatcgggcgcgtggccctgttgaactacggcaaggactatggccgcctcgtcgtcatcgtcgacgtggtcgaccagaacagggcacttgtggatgcccctgacatggtcaggtgccagatgaacttcaagcggctctcacttactgacatcaagattgacatcaaacgtgtacccaagaagacaaccctgatcaaggcgatggaggaagctgatgtgaagaccaagtgggagaacagctcatggggcaagaagctgattgtccaaaagaggagagcagcgctcaatgactttgataggttcaaggtcatgttggcgaagatcaagaggggtggggcggtccggcaagagcttgccaagctcaagaaggcgtccacagcttagagtatcttttggagttttggtgaatggcatgttgagtttttggtaccttgttggatcagtcattcgtttgagtgttgttaaagccagaattagcactactgtttcctatgaactcttttcaaaccttaatcaagaatggctgtgctctggagatttttgtcatggatgttatgaaatatctaaggtagtttgc

SEQ ID NO: 41016 - protein, 134 aa, Panicum virgatum
  misc_feature: Ceres CLONE 2005981
  misc_feature (44)..(120): Pfam Name: Ribosomal_L14e Pfam Description: Ribosomal protein L14
MPFKRFVEIGRVALLNYGKDYGRLVVIVDVVDQNRALVDAPDMVRCQMNFKRLSLTDIKIDIKRVPKKTTLIKAMEEADVKTKWENSSWGKKLIVQKRRAALNDFDRFKVMLAKIKRGGAVRQELAKLKKASTA

SEQ ID NO: 41017 - DNA, 903 bp, Panicum virgatum
  misc_feature: Ceres CLONE 2005991
  misc_feature: Encodes the peptide sequence at SEQ ID NO. 41018
gcccaccatctccgggctcccggccaggtgcgcgcctcggcctccccgactcctcctttcttctctctctcgcctccggccacgggcaggaaccgatctcggagccctccccgtcgcggcgttgttcgttggcggttcggttgccgcttgatcgggcaagaagaagaagaagaagaagaggggagccgggagccgaaatggtgaaggacagtgcgtactacgacatcctggaggtcagcactgacgcctcagtggcccagatcaagaaggcctattacctcaaggccaagctggtgcacccagacaagaatcccggcaaccctgacgcggcacgcaagtttcaggaattaggtgaagcctatcaagttctaagtgatccggtaaaaaaggagtcttacgacaagtatggaaaggaaggtcttccccaagataacatgattgatccaactgctgtctttgggatgctttttgggagtgaacattttgaagattatgtcggtcaacttgcactagcatccgttgcttcggtagagattgaggaggaatcaactacacctgaggcaaggacaagggttcaagagaagataaaggacgtgcaaactgaaagagagcaaaaacttactcagattctaaaggagcggctccagctgtatgttgatgggaaccaagacgagtttggtgactgggcaaatgcagaagctcagcgtttgtctcaagctgctttcggtgaggctatgcttcacactatcggccatatttatgttcgacaagcagcaagagagcttggaaaaagcaaactgtatatgggtgtaccattcatagctgagtgggtaagggataagggccaccatgtaaaatcgcaggttaatgctgctgcaggtgcaatttctctgatacagctac

SEQ ID NO: 41018 - protein, 235 aa, Panicum virgatum
  misc_feature: Ceres CLONE 2005991
  misc_feature (6)..(68): Pfam Name: DnaJ Pfam Description: DnaJ domain
MVKDSAYYDILEVSTDASVAQIKKAYYLKAKLVHPDKNPGNPDAARKFQELGEAYQVLSDPVKKESYDKYGKEGLPQDNMIDPTAVFGMLFGSEHFEDYVGQLALASVASVEIEEESTTPEARTRVQEKIKDVQTEREQKLTQILKERLQLYVDGNQDEFGDWANAEAQRLSQAAFGEAMLHTIGHIYVRQAARELGKSKLYMGVPFIAEWVRDKGHHVKSQVNAAAGAISLIQL

SEQ ID NO: 41019 - DNA, 640 bp, Panicum virgatum
  misc_feature: Ceres CLONE 2006009
  misc_feature: Encodes the peptide sequence at SEQ ID NO. 41020
ccagctgctgcctgatcttttatcccccacttgccgcttgctgcccggggactgggctgctgggggaaggtcgccgacgggatcgatggaagattcgtctacgtttacggaaggagaggtggccgaagaagcgaaggggcaggctccaggccaaggaagctctgaaggtagtcatggtactcttttgcaagatataagggagaaggaaacaagaaaaggaaaggcggctgttggatccactgagctgatgagggaggatctggttcagagtgctgttagttttctgaaacatccaaaagtagtaacctcttcagacggacagaggcgatctttccttgaaaataaaggactcactgtggatgaaatagatgaagcatttcggcgtttacaaagcccatcttcacattctttgagctcaaatacttgcacatctcaaggggtgtctgatcattcgtgcaagattagtcaggaaactaaagttggcacaaagtgtatggatggttcagatagggttgaacctgaaactgaacctgtggcccctgtggtgcctcgtcatccaaaatcttatatggagatcatggaaatgatacaaaggggtgagcggccagatgatatacaggatattaatgatgaccctcca

SEQ ID NO: 41020 - protein, 184 aa, Panicum virgatum
  misc_feature: Ceres CLONE 2006009
  misc_feature (55)..(126): Pfam Name: Pex14_N Pfam Description: Peroxisomal membrane anchor protein (Pex14p) conserved region
MEDSSTFTEGEVAEEAKGQAPGQGSSEGSHGTLLQDIREKETRKGKAAVGSTELMREDLVQSAVSFLKHPKVVTSSDGQRRSFLENKGLTVDEIDEAFRRLQSPSSHSLSSNTCTSQGVSDHSCKISQETKVGTKCMDGSDRVEPETEPVAPVVPRHPKSYMEIMEMIQRGERPDDIQDINDDP

SEQ ID NO: 41021 - DNA, 622 bp, Panicum virgatum
  misc_feature: Ceres CLONE 2006014
  misc_feature: Encodes the peptide sequence at SEQ ID NO. 41022
aaaaaaaaaaaaccgcacacaaatcctcttccaccgcttcgtcctcctccaaattccaactcctccgagcggtcgcggcgagcgaagctcccggttcggcgatgtcggggcgcggcaagggcggcaaggggctgggcaagggcggcgccaagcgtcaccgcaaggtgctccgcgacaacatccagggcatcaccaagccggccatccggaggctggccaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctttacggcttcggcggctagatcggttcagcttctggtggcgaaggcaaactacatgtggtggggtgtgtgttctggtttagtgtagtcagggctctctgtatcgatgctgtgtcgtggtggttgtagtctatctactctgtgagtagttgtttgcgtttctagtcctctgcagtaatatctagttgctgttatcaatggaaaaccttggctctcgcctcagtttcgtc

SEQ ID NO: 41022 - protein, 103 aa, Panicum virgatum; identical to SEQ ID NO: 12044
  misc_feature: Ceres CLONE 2006014
  misc_feature (25)..(94): Pfam Name: Histone Pfam Description: Core histone H2A/H2B/H3/H4

SEQ ID NO: 41023 - DNA, 695 bp, Panicum virgatum
  misc_feature: Ceres CLONE 2006033
  misc_feature: Encodes the peptide sequence at SEQ ID NO. 41024
acacaaggtagataagcctttccagatcatactaaaccaagcagccacttcacactagggtacttggatcacacaagaaagttcaggtcggaagaagatgcaggccgccgccgctacagccgtcgggttctctgctgcggcgcccgtgaagggcgggccggcggcgaggagcacggtggtcgctcgtgtcccagccacaaggaggagcgttcgcgccgccgtggccgcggcggagcccgccgaggtcgactacagctcgagcttctccgtgttccccatggaggcctgcgagctgctcggcggcgacgcccgcagcgcgcagatgtacccggaggctaagctcgccggctcggctgaggcggccggcaggagggaggaggaggtggagagggactacctgtcctacgacgagccgaagacggtgttccccggcgaggcgtgcgacgacctcggcggcgagttctgcgaggcgccgtaccaggccggcgtgtccagggagctggcggcctggcgcacgcctgatcgggtcgaagggtgattggaagctagcagatgatgcttacgcggtagatggggagctagcgtacgcgcacgtacagaataacagcagccaagcaaggccaaggacttgtcacgtgtgtaaatgtgcatgtctctttggtcgtgtcagctgcctgtctgtagaaactaaagag

SEQ ID NO: 41024 - protein, 146 aa, Panicum virgatum
  misc_feature: Ceres CLONE 2006033
  misc_feature (1)..(126): Pfam Name: Lir1 Pfam Description: Light regulated protein Lir1
MQAAAATAVGFSAAAPVKGGPAARSTVVARVPATRRSVRAAVAAAEPAEVDYSSSFSVFPMEACELLGGDARSAQMYPEAKLAGSAEAAGRREEEVERDYLSYDEPKTVFPGEACDDLGGEFCEAPYQAGVSRELAAWRTPDRVEG

SEQ ID NO: 41025 - DNA, 631 bp, Panicum virgatum
  misc_feature: Ceres CLONE 2006046
  misc_feature: Encodes the peptide sequence at SEQ ID NO. 41026
acatacgaccatacccagtggaaaatacgggatcccgtccgctctcccatagtcaagccgctgaggggccgatcagtagttgggtcggtgacgaccagcgaatcccggctgttgtatgtgagcttatcgcttatcatctgcgcctccccatctctcccctgctcctccacctccttgtgatccatccaaaccaggggtagccatgtcggactccgaggagcaccacttcgagtcgaaggccgacgctggggcgtccaagacctacccgcagcaggccggtaccatccgcaagaacggattcatcgtcatcaagggccgcccctgcaaggtggtggaggtttctacctcaaagactggtaagcacggtcatgctaaatgccactttgttgccatcgacatattcaatgggaaaaagcttgaagatattgtcccatcttcccataattgtgatgtgccacatgtgaaccgcactgagtatcagctgattgacatatctgaggatggatttgtgagccttcttacttctgatggcaacaccaaggatgatcttagacttccaactgatgagactctcctgggccagattaaggaaggatttgacagcgggaaggaccttgtggtgactgtccag

SEQ ID NO: 41026 - protein, 142 aa, Panicum virgatum
  misc_feature: Ceres CLONE 2006046
  misc_feature (86)..(142): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTIRKNGFIVIKGRPCKVVEVSTSKTGKHGHAKCHFVAIDIFNGKKLEDIVPSSHNCDVPHVNRTEYQLIDISEDGFVSLLTSDGNTKDDLRLPTDETLLGQIKEGFDSGKDLVVTV

SEQ ID NO: 41027 - DNA, 593 bp, Panicum virgatum
  misc_feature: Ceres CLONE 2006057
  misc_feature: Encodes the peptide sequence at SEQ ID NO. 41028
gaagttcttcagcaacccaacgacagtcaatacaccagactaacaggattgccgccgcagccaaaccgtcaaaatggccatcaagaagagcaagaaggacgccaactctatcaactccaagctcgcgcttgtgatgaagtctggaaaggtcaccctcggctacaagtctaccctcaagtccctccgctccggcaaggccaagctcatcatcattgctggcaacactcctcctctccgcaagtccgagctcgagtactacagcatgctgtccaaggcccccatccaccacttctccggcaacaacattgagctcggcactgcctgcggtaagctgttccgctgcggcaccatggccatcctcgacgctggtgactcggatatcctctctgaccaggctgcttaagcggatgtgccttcaaaatgaaaatgcattgaacggcgttcgggggcaccatgggtttatgaggataccagtcaatgtgatgcgatacgagacggtcacagggaaagcgcaacgctgccctggtcctgcgtccgtcctttatgtgactggacgtgcaggattatttagcctcaatgataaaatacagctc

SEQ ID NO: 41028 - protein, 109 aa, Panicum virgatum
  misc_feature: Ceres CLONE 2006057
  misc_feature (11)..(105): Pfam Name: Ribosomal_L7Ae Pfam Description: Ribosomal protein L7Ae/L30e/S12e/Gadd45 family
MAIKKSKKDANSINSKLALVMKSGKVTLGYKSTLKSLRSGKAKLIIIAGNTPPLRKSELEYYSMLSKAPIHHFSGNNIELGTACGKLFRCGTMAILDAGDSDILSDQAA

SEQ ID NO: 41029 - DNA, 873 bp, Panicum virgatum
  misc_feature: Ceres CLONE 2006071
  misc_feature: Encodes the peptide sequence at SEQ ID NO. 41030
agatgtaacggtagcgactcaaatgagttgtttccctttctccgctaccacattcgatcggcttcgaggcaagcagcatcacaacacaacgtcctctcctgccggcggaccggatccacccccgcgccatgtactcccggcggccgccgcatccgtcccaccggagtccacggcgatcacccgccgcctactgtctcctcctcaccctcgctctcctcttcgcgtccgccgccgccaaatcctctcgccgccccatctccgtgcgtctccctctcctctttccccgctgacgcctcttccagcccttcctgcatccgtctcatcgtgcttgcggaacttcctggtgcaggacaacgagatccggcagaagaaggaggcctgctacaccgacgtcgcgaacgggctgtggggatgggtgtgcaggtcctcgccaacggagaaggagaactgcgtgctgcgctgcctctccccggagtgctacgacctcatctacggcggcgacccgcttgaagaaggggagctggattatgtccgcggccaggaatacaagtactgcatgcacaaatcatcccttggagaaagcttggatggcgttaaggggtccttcagctattcgttaagttagcaagaataaaaggctcccatatgtccaagctgcacttctcagttctcctctatacggtggtgttcagccatatccagctatcaacgtctccaagcatgggcaatcgataagttcatcgatgaaatccaaatcgattaaatgtgaaaattttcctaaaccctccaagcactgctgttgtgcatcctgatgggaaaagaaacctctttgtaatacaatttctccagctacatggtttgttttttcttttc

SEQ ID NO: 41030 - protein, 207 aa, Panicum virgatum
  misc_feature: Ceres CLONE 2006071
  misc_feature: Useful for biocontainment applications
DVTVATQMSCFPFSATTFDRLRGKQHHNTTSSPAGGPDPPPRHVLPAAAASVPPESTAITRRLLSPPHPRSPLRVRRRQILSPPHLRASPSPLSPLTPLPALPASVSSCLRNFLVQDNEIRQKKEACYTDVANGLWGWVCRSSPTEKENCVLRCLSPECYDLIYGGDPLEEGELDYVRGQEYKYCMHKSSLGESLDGVKGSFSYSLS

SEQ ID NO: 41031 - DNA, 611 bp, Panicum virgatum
  misc_feature: Ceres CLONE 2006093
  misc_feature: Encodes the peptide sequence at SEQ ID NO. 41032
atccaccctcatcggaagctccccaactccaagcctccttccagcagcgaagaagcgaagagccagccggagagcggcgatcgagcagcgtcgcgacaccagccagtcggatacaagcgatcccatggcgcccagaaggtcaccgtcgccggccgggagcagcggcagcggcagcgccgtgtgcgcgccggcggcggcggcggcagggcagcagccgaggctccgaggcgtgctccggccgtggggccggtacgcggcggagatccgcgaccccgtacgcaaggcgcgcgtgtggctggggaccttcgacacgcccgaggacgccgcgcgcgcctacgacgacgccgcgcgccggctccgcgggccacgcgccgccaccaactacccggcccgggacccgaaggccgcggcggcggacgctccggcggcgagcgggagcgggagcgcggtgctgtacgaggacgcctcgtcctcgtcctcctgccgggactcgccgctggcagtgacggtggccgtcgcggcgcacccgtcgctggacctgggcctgggcctgggcgcttaccggccatggcggccacggcgtcgtcgcaccacatgtccttggacccggt

SEQ ID NO: 41032 - protein, 162 aa, Panicum virgatum
  misc_feature: Ceres CLONE 2006093
  misc_feature (31)..(81): Pfam Name: AP2 Pfam Description: AP2 domain
MAPRRSPSPAGSSGSGSAVCAPAAAAAGQQPRLRGVLRPWGRYAAEIRDPVRKARVWLGTFDTPEDAARAYDDAARRLRGPRAATNYPARDPKAAAADAPAASGSGSAVLYEDASSSSSCRDSPLAVTVAVAAHPSLDLGLGLGAYRPWRPRRRRTTCPWTR

SEQ ID NO: 41033 - DNA, 681 bp, Panicum virgatum
  misc_feature: Ceres CLONE 2006157
  misc_feature: Encodes the peptide sequence at SEQ ID NO. 41034
gctggtgtttgtgtagctgcatcagaagcttcagtgggcagagaggaaggaaggagaggagagagatggggaggaagctgggcctcgacagggtcctggactgcttctcgctttcgctgtgcgccaatgcctgcgcctgcgtgcactcggtggagaaggacgaggacgaggccgacgagcgcaaggccctggtgagcagccagctggaggagctggtcaagctcagggacttcgtcgacggagcggccaagacccttgctttccatctagagcccaagacagtggagctcaaggtgtccatgcactgctacggatgcgccaagaaagtccagaagcacatctccaagatggccggcgtgacgtcgttcgaggtggatttggagaggaagaaggtggtggtgatcggggatgtcacgccgtacgaggtgctggagagcgtctccaaggtgatgaagttcgtggagctgtgggtggcgcccaaccccaagccgcaggccgcggaggagaggcagtagacgttgctaggtgctttggtcgccgtcgatctctcatgcgtccacggtctcggcctcgtctccagttctccacctaccatgcgtagcaagcagaaagaacacggccgctgtgacagacccgtcgggttgaaacgtttaattaagcgtaactgccaatatttaaact

SEQ ID NO: 41034 - protein, 149 aa, Panicum virgatum
  misc_feature: Ceres CLONE 2006157
  misc_feature (74)..(142): Pfam Name: HMA Pfam Description: Heavy-metal-associated domain
MGRKLGLDRVLDCFSLSLCANACACVHSVEKDEDEADERKALVSSQLEELVKLRDFVDGAAKTLAFHLEPKTVELKVSMHCYGCAKKVQKHISKMAGVTSFEVDLERKKVVVIGDVTPYEVLESVSKVMKFVELWVAPNPKPQAAEERQ

SEQ ID NO: 41035 - DNA, 440 bp, Panicum virgatum
  misc_feature: Ceres CLONE 2006161
  misc_feature: Encodes the peptide sequence at SEQ ID NO. 41036
ttggacattggatttcatgtggagtacattagtccttcaggggagaaaactctaattcttccctaccgacggtatgaagctgaccaaggcaatttttgcactatttcagcgggatcatacaaacttgtatgggacaactcatattcatcattcttcaaaaagagcctccggtacaaggtggatgctgtgccaccggttgtcgagccggccatgcccaccgtagagcccttatgaggcctgccttaatattgatgcctgtcatgaattagacggtgcaggtgcatcagaagccccaaacggtcttgtaaccaatacttgtatcataatcgcagggttctggtgatccatacacgtagctcccagtctgagagcaatatgtactgcgtgcacatggttacggccagttggccagttttccactgatgaatgcctaattctac

SEQ ID NO: 41036 - protein, 77 aa, Panicum virgatum
  misc_feature: Ceres CLONE 2006161
  misc_feature (1)..(62): Pfam Name: EMP24_GP25L Pfam Description: emp24/gp25L/p24 family/GOLD
LDIGFHVEYISPSGEKTLILPYRRYEADQGNFCTISAGSYKLVWDNSYSSFFKKSLRYKVDAVPPVVEPAMPTVEPL

SEQ ID NO: 41037 - DNA, 504 bp, Panicum virgatum
  misc_feature: Ceres CLONE 2006164
  misc_feature: Encodes the peptide sequence at SEQ ID NO. 41038
cgagggcaccccggccaccaccaccgacttcgacctcgacagaggaaggccagccagccatggatgcttcggtcctcaacaacccgcggctcaaggcgctcatagaggaggagagaacgaaggccttgacaaacgagctcgtggcaaagctgactcatgtttgctgggacaaatgcgttactgggagcatcggaagcagcttcagcaggagtgaggcctcgtgcttgtccaactgcgcgaaacgcttcgcagaagtgaagatgatgaccatgcaacgcatcaccgagcggtagctcaagtcacatcggcgtttctctacaactaaaattcttgtatcctctggagtatccaaatgaagtacaagtgttctgctgtagcacgagttctgttatcctttttctggcatactattgttggtgaagttgatagaaaggcatgcccaatgtagtacaatgttctgttagtacttctctatgttttaagctggagtgaagcagagcctac

SEQ ID NO: 41038 - protein, 77 aa, Panicum virgatum
  misc_feature: Ceres CLONE 2006164
  misc_feature (12)..(77): Pfam Name: zf-Tim10_DDP Pfam Description: Tim10/DDP family zinc finger
MDASVLNNPRLKALIEEERTKALTNELVAKLTHVCWDKCVTGSIGSSFSRSEASCLSNCAKRFAEVKMMTMQRITER

SEQ ID NO: 41039 - DNA, 437 bp, Panicum virgatum
  misc_feature: Ceres CLONE 2006165
  misc_feature: Encodes the peptide sequence at SEQ ID NO. 41040
ggcgagtggcatccgatggcgcggaactggggcgccaactggcactccctggcgtacctcaacgggagggggctctcgttcagggtgaccatcacggatgggcaaaccctcgagttcaccaacgtggtgccgcctggatggacgttcggcgtcacatttgcaagcaacttgcagttcaaataagaactgcttcattgggatttaccgcgattattgatgatctgagggccggaatcagatccatataataagttgctctcatgttgttcactacttgcacatgagatgacattggaagcgtgctctgtgtgtgtgtgtacacacaacaattgcagagttctattctagtaactctgtttttttttattgtatatgtatatatttatgaaattctaatgtatatataaagatgtctgtatatacacttattgtgagtc

SEQ ID NO: 41040 - protein, 60 aa, Panicum virgatum
  misc_feature: Ceres CLONE 2006165
  misc_feature (1)..(44): Pfam Name: Pollen_allerg_1 Pfam Description: Pollen allergen
  misc_feature: Useful for making plants with altered carbohydrate content
  misc_feature: Useful for making plants with altered cell wall content and/or composition
  misc_feature: Useful for making plants with altered lignin content
GEWHPMARNWGANWHSLAYLNGRGLSFRVTITDGQTLEFTNVVPPGWTFGVTFASNLQFK

SEQ ID NO: 41041 - DNA, 205 bp, Panicum virgatum
  misc_feature: Ceres CLONE 2006173
  misc_feature: Encodes the peptide sequence at SEQ ID NO. 41042
gacaccattacagtacgcactccggctgacgcgccccgcactctctcacaaagctcaagcctttcgctcgctcgctcgctcgcggctacatctacaatggcgcgactccagctcgcggccctggccatggccatgctcttcgccgcggcggcggcgcaggccccggccgccaccacgacgccggcgccaagggcgtccccaccgc

SEQ ID NO: 41042 - protein, 36 aa, Panicum virgatum
  misc_feature: Ceres CLONE 2006173
  misc_feature: Useful for making plants with altered carbohydrate content
MARLQLAALAMAMLFAAAAAQAPAATTTPAPRASPP

SEQ ID NO: 41043 - DNA, 574 bp, Panicum virgatum
  misc_feature: Ceres CLONE 2006176
  misc_feature: Encodes the peptide sequence at SEQ ID NO. 41044
ccaccactcctccccttccaaccccagcacccggcggcggcggcgagcggcggagatgacgacgagcctgaagaagaaccggaagaagcgcggccacgtgtccgcggggcacggccgcataggcaagcaccggaagcacccgggaggccgcgggaacgccggtggcatgcaccaccaccgcatcctcttcgacaagtaccacccgggctacttcggcaaggtgggcatgcgctacttccacaagctccgcaacaggttctcctgcccgtcggtcaacgtcgagcggctctggtcgatggtgcccgccgacaaggccgcggaggcggcggccggcgcggacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttacatcttgtttcgtctatctgtgctaagagaacttatgaatttgttgcggattctgagttttgagaa

SEQ ID NO: 41044 - protein, 147 aa, Panicum virgatum; identical to SEQ ID NO: 13747
  misc_feature: Ceres CLONE 2006176
  misc_feature (109)..(141): Pfam Name: L15 Pfam Description: Ribosomal protein L15

SEQ ID NO: 41045 - DNA, 902 bp, Panicum virgatum
  misc_feature: Ceres CLONE 2006182
  misc_feature: Encodes the peptide sequence at SEQ ID NO. 41046
gatctgattctcgctttcgtttcgccttttcctggccggcccggccggccccgtatttctccttctctgtctccgatccccggccggccggtaggataggctgctgggaaggtagattgtattggcagcgcgatgaaggtcagctcgggctttgagagcgcgagcgcgagcagcgccggcggctctgctggctcgggctccggcagcagctccggctggggctcgggctccttcaacctccggaacctatccaaggtcatcctgccgccgctcggcgggccctccggccacagccagctccatgccggctccgacaagtgggtcatctcgccgctcgactccagatacaggtgctgggagacgttcatggtggtcctggtggcgtactcggcgtgggtgtacccgttcgaggtggcgttcatgaacgcgtcccccaagggcggcctggaggtggcggacatcgtcgtcgacctcttcttcgccgtcgacatcgtgctcaccttcttcgtcgcctacatcgaccccaggacccagctgctcgtccgcgacaggaagaagattgccctcaggtaccagtaccacgcccttgctctagcttgcctcgcgcatcgcagcttcgcatgcagcagctattgagcttttgtcgatcgggcgcatgccaattgtgagaggaaaaaaaaacaaaaagtttacgagccgtctacgatgacgagaggcgtctcggactctaggatggacgatcatgcagcttcgacctcttgcatcggcatcgtcggccccgcctttctcttacttttaggtgcaccgagccatcgacccgtcggaaaatggcaagggtggtcggttgtttctgggtgctgttggagattcattagatgagccgtccaatttccattctgatc

SEQ ID NO: 41046 - protein, 167 aa, Panicum virgatum
  misc_feature: Ceres CLONE 2006182
  misc_feature: The sequence is a functional homolog of SEQ ID NO 1838 in the 10/374,780 US patent application
MKVSSGFESASASSAGGSAGSGSGSSSGWGSGSFNLRNLSKVILPPLGGPSGHSQLHAGSDKWVISPLDSRYRCWETFMVVLVAYSAWVYPFEVAFMNASPKGGLEVADIVVDLFFAVDIVLTFFVAYIDPRTQLLVRDRKKIALRYQYHALALACLAHRSFACSSY

SEQ ID NO: 41047 - DNA, 614 bp, Panicum virgatum
  misc_feature: Ceres CLONE 2006200
  misc_feature: Encodes the peptide sequence at SEQ ID NO. 41048
actcgaccgcaatcacagctcaacaacaaccacagcacgctacagctagaggtaaacagagcggagcagagtacgcaaccacgggcgacagtgcgcgatggctcgccggctgctcggtgcttgcggcgtgctcctcgccgccgtcctgctcgcggccgtggcgcccgcgcgtgctgacgagcggagcggcatacggcagcggggcggcgagtaccgcgggaggaaggttggggcgaggacggaggtgcgggacgtggagcgcgacggggaggtgcaggagctcggccggttctccgtcgccgagtacaaccggcggcgcgtcggcggcgaaaggctcgagttcggaagggtggtcgcggcgcagcggcaggtggtgtcggggctcaagtactacctccgcgtcgccgccgcggcggagaacgccggcggcgagcgcgtgttcgacgccgtcgtcgtcgtcaagccctggctcgagtcgcgcaccctgctcaggttcgcgccggccgccccgaaataagtgtagcggcaccctttgagtgctatgtccgtccgtgacttttggccggtctgctttctcgcagactttggtgagcgaataaaagttctgtttttgt

SEQ ID NO: 41048 - protein, 139 aa, Panicum virgatum
  misc_feature: Ceres CLONE 2006200
  misc_feature (45)..(137): Pfam Name: Cystatin Pfam Description: Cystatin domain
MARRLLGACGVLLAAVLLAAVAPARADERSGIRQRGGEYRGRKVGARTEVRDVERDGEVQELGRFSVAEYNRRRVGGERLEFGRVVAAQRQVVSGLKYYLRVAAAAENAGGERVFDAVVVVKPWLESRTLLRFAPAAPK

SEQ ID NO: 41049 - DNA, 655 bp, Panicum virgatum
  misc_feature: Ceres CLONE 2006244
  misc_feature: Encodes the peptide sequence at SEQ ID NO. 41050
cttctaacctcgcagtcatccccgagaaggagccgccgccgccgcgcagcgcaaaccctagcagtcttcgccgccgtcactcctcctcggggcgcaaccatggtggccacaaagaagacgaagaagtccacggacaatatcaacaacaagcttcagcttgtgatgaagagcggcaagtacacgctcggctacaagaccgtcctcaggactcttaggaactccaagtcgaagcttgtgatcattgctaacaactgccctccccttcggaagtctgaaattgagtactatgcaatgctggctaaggtcactgttcaccatttccatggaaacaatgttgacctgggtacagcctgtggaaaatacttccgtgtctgctgtcttagcattattgatccaggtgattcggatatcatcaagactacatcgggtgaccagtaaggaagagatgccagtaccccttggcattggtgttctgagcttttctagtgtagtagtggatctttcaggacttgtcctttcaccttatattgtgttaagcactatttgcctgcccgtaatctgagtttttgggaacagtcttgcattgaaaattttgttcctggaattgacactatcaatggagctgtggcctatggttgtcctcacttcagagttc

SEQ ID NO: 41050 - protein, 112 aa, Panicum virgatum
  misc_feature: Ceres CLONE 2006244
  misc_feature (12)..(106): Pfam Name: Ribosomal_L7Ae Pfam Description: Ribosomal protein L7Ae/L30e/S12e/Gadd45 family
MVATKKTKKSTDNINNKLQLVMKSGKYTLGYKTVLRTLRNSKSKLVIIANNCPPLRKSEIEYYAMLAKVTVHHFHGNNVDLGTACGKYFRVCCLSIIDPGDSDIIKTTSGDQ

SEQ ID NO: 41051 - DNA, 622 bp, Panicum virgatum
  misc_feature: Ceres CLONE 2006249
  misc_feature: Encodes the peptide sequence at SEQ ID NO. 41052
atcgtcggcaccttcgtcctcgtctacaccgtcttctccgccaccgacgccaagcgcagcgcgcgcgactcgcacgtgcccatcctggcgccgcttcccatcggcttcgccgtcttcctcgtgcacctcgccaccatcccaatcaccggcaccggcatcaaccccgcgcgcagcctcggcgcggccatcatctacaacaggtcacacgcatggaacgaccattggatcttctgggtgggccccttcatcggcgctgctcttgcggccatctaccacgtggtcatcatcagggccatccccttcaagagccgcgactgatgatatatgctgctgcggcctgcggctagctgctgctgctgtggccagtgtgtttcttgattgttgcattgcgccctcagctatatatatatatatatatatatatatatatatatatatatatatatatatatatatatatatatatatgcgcgcgtgatatgtgtgtattatatatatatactctctccatatatatataaaaaaacacgtgtgtgtgtgtgtgcacactagcacgtgtactacactatacatctccctcgtgacacagtgaaacatcttattttatactcctctctactct

SEQ ID NO: 41052 - protein, 105 aa, Panicum virgatum
  misc_feature: Ceres CLONE 2006249
  misc_feature (1)..(92): Pfam Name: MIP Pfam Description: Major intrinsic protein
  misc_feature: Useful for making plants with modulated water use efficiency
  misc_feature: Useful for making plants with modulated drought sensitivity
  misc_feature: Useful for making plants with modulated cold sensitivity
IVGTFVLVYTVFSATDAKRSARDSHVPILAPLPIGFAVFLVHLATIPITGTGINPARSLGAAIIYNRSHAWNDHWIFWVGPFIGAALAAIYHVVIIRAIPFKSRD

SEQ ID NO: 41053 - DNA, 619 bp, Panicum virgatum
  misc_feature: Ceres CLONE 2006254
  misc_feature: Encodes the peptide sequence at SEQ ID NO. 41054
gatactaaccgaccagtttcacgacagtcaagatgcagatcttcgtcaagaccctgacgggcaagaccatcacccttgaggtcgagtcctccgacaccatcgacaatgtcaagtccaagatccaggacaaggagggcattcccccggaccagcagcgcttgatcttcgccggcaagcagcttgaggacggccgcactctttccgactacaacatccagaaggagtcgactctccacttggtcctccgcctccgtggtggtatcatcgagccctccctcaaggcccttgcctccaagtacaactgcgacaagatgatctgccgcaagtgctacgcccgcctgcccccgagggctgtcaactgccgcaagaagaagtgcggtcacaccaaccagctccgccccaagaagaagctcaagtaaatcattcgcacaacggcgtctggcgagaacggggtcggtcgaggtggaacgaatgcgacgaatgcatgcgatggacagtcggctgaaaacactgttccttttgcacatggagttacatctgtgcttatcactcggctaaggaacttgatgatgggattggggcttgtagagtgaatacgattctacctttccttcttgcg

SEQ ID NO: 41054 - protein, 128 aa, Panicum virgatum
  misc_feature: Ceres CLONE 2006254
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase
  misc_feature: Useful for making plants with modulated cold sensitivity
  misc_feature: Useful for making plants with modulated flowering time
  misc_feature: Useful for making plants with modulated nitrogen use efficiency
MQIFVKTLTGKTITLEVESSDTIDNVKSKIQDKEGIPPDQQRLIFAGKQLEDGRTLSDYNIQKESTLHLVLRLRGGIIEPSLKALASKYNCDKMICRKCYARLPPRAVNCRKKKCGHTNQLRPKKKLK

SEQ ID NO: 41055 - DNA, 640 bp, Panicum virgatum
  misc_feature: Ceres CLONE 2006260
  misc_feature: Encodes the peptide sequence at SEQ ID NO. 41056
atcctcctcttcctctccctggctggttaattattcctcctttgcatgagagcaaaaatggatggcctcatccccttcgtcctcaaggctctgaagaagaagaagaagaaggccatgaagcactatcgctccctcttctccgaccacctggcgcacttcgacgtcacagaggccctgccccagggttccctcttcatgacgcctcagcaccccagggcgtcgagatggcttgatgatgaaggcgatggcaatggtgagccgtctgctgctgctgcagttccggcggccttggcgccatcagtggcgtgcgccaatagcagcagcacgccggcggctgctcagcatggagccgccgccgccgctcaccgctggccatgagcgggggctcaggtacggtgggagctgccaggagtttgggcttgcttgttcatggagatggttggttgcacagttggctggcaatccaatagacaagaaaggaagcaaagtgcgctgttttgttgcactaaatgtagatcaattgcgtgtctctagtttctggccttatctttaaccaatggtcgctgacctggactaatgttcatctggttgtatcttgaataagcatccttgaagcttaattcgaaagtatcatgttttg

SEQ ID NO: 41056 - protein, 106 aa, Panicum virgatum
  misc_feature: Ceres CLONE 2006260
  misc_feature: Useful for making plants with altered carbohydrate content
MDGLIPFVLKALKKKKKKAMKHYRSLFSDHLAHFDVTEALPQGSLFMTPQHPRASRWLDDEGDGNGEPSAAAAVPAALAPSVACANSSSTPAAAQHGAAAAAHRWP

SEQ ID NO: 41057 - DNA, 384 bp, Panicum virgatum
  misc_feature: Ceres CLONE 2006272
  misc_feature: Encodes the peptide sequence at SEQ ID NO. 41058
ggcggcggtggcattggtggaggaggcggcggcggcctcggtggagggggaggcgccgggggcggccttggtggcggtgccggaggaggcctcgggcacggcggcggcctgggacgcggcgttggtatgggcggaggcggaggcggcggcggcggcctcggcatcggaattggcgtcggcgtgggcgtcgggatgggcgcgggtgctggcggcggcgccggtgctggcgcgggcggcggcgggcgttgatgagccgtcgactgggaagaaggttgtgcatggctgcatgcctgcatgcaatgcggcctgcgtaacggacgccctctgcttcctttccttccaaacgctcgttacgacgtggttaaattaaattacagttgatct

SEQ ID NO: 41058 - protein, 82 aa, Panicum virgatum
  misc_feature: Ceres CLONE 2006272
  misc_feature: Useful for making plants with altered lignin content
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Useful for making plants with altered alkaloid content
  misc_feature: Useful for making plants with modulated nitrogen use efficiency
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Useful for making plants with altered terpenoid content
  misc_feature: Useful for making plants with modulated flowering time
  misc_feature: Useful for making plants with modulated phosphate use efficiency
  misc_feature: The sequence is a functional homolog of SEQ ID NO 124 in the 10/714,887 US patent application
  misc_feature: The sequence is a functional homolog of SEQ ID NO 124 in the 11/435,388 US patent application
  misc_feature: Useful for making plants with modulated biomass
  misc_feature: The sequence is a functional homolog of SEQ ID NO 644 in the 10/666,642 US patent application
  misc_feature: The sequence is a functional homolog of SEQ ID NO 1232 in the 10/666,642 US patent application
  misc_feature: Useful for making plants with modulated heat sensitivity
  misc_feature: Useful for making plants with modulated low light sensitivity
GGGGIGGGGGGGLGGGGGAGGGLGGGAGGGLGHGGGLGRGVGMGGGGGGGGGLGIGIGVGVGVGMGAGAGGGAGAGAGGGGR

SEQ ID NO: 41059 - DNA, 732 bp, Panicum virgatum
  misc_feature: Ceres CLONE 2006276
  misc_feature: Encodes the peptide sequence at SEQ ID NO. 41060
aagaagattggtccttaattaacccgtgatctcatccacctctagctagtagccccctccctggctccccaatccccatataaaaaaagtcccaccctccaaagcggctccaagccgccgtgatagcaatagagcccttttctcctcttctttccatcccaagtctcaacatcttcagttcatcaccaaacatcaacgcggccaccatatatatgggtcctcagcaagatcggcggcgttccatggcgaacggcacggcggcgaggaaggagacgaaggtggtgcacgtgcactaccgggagtgccagcgcaaccacgcggcggccatcggcgggtacgccgtggacgggtgccgggagttcatggcgtcgggcgcggagggcacggccgcggcgctcttgtgcgccgcctgcgggtgccaccgcagcttccacaggcgcgaggtggaggccgacatggactgctcctccaccacctccggctgaataatctcgatcgatctggtttgcagtacatgtgcgtgatcgagctagctgcagatggcctggtgaggtccgatcgatcatgggtggcaaaggcattgaaatgattggtaggtaggtgcatgcattatattcaaccgtatttggaatggacatgtatatttattttcttctctttttttttcttggtcttggatttgcagtgaaacttgtgtatgtgttgatcgttggtgtatggtgcttgtaactg

SEQ ID NO: 41060 - protein, 80 aa, Panicum virgatum
  misc_feature: Ceres CLONE 2006276
  misc_feature (13)..(72): Pfam Name: ZF-HD_dimer Pfam Description: ZF-HD protein dimerisation region
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
  misc_feature: The sequence is a functional homolog of SEQ ID NO 60 in the 10/714,887 US patent application
  misc_feature: The sequence is a functional homolog of SEQ ID NO 60 in the 11/435,388 US patent application
  misc_feature: The sequence is a functional homolog of SEQ ID NO 112 in the 10/714,887 US patent application
  misc_feature: The sequence is a functional homolog of SEQ ID NO 112 in the 11/435,388 US patent application
  misc_feature: The sequence is a functional homolog of SEQ ID NO 52 in the 10/714,887 US patent application
  misc_feature: The sequence is a functional homolog of SEQ ID NO 52 in the 11/435,388 US patent application
  misc_feature: The sequence is a functional homolog of SEQ ID NO 620 in the 10/666,642 US patent application
  misc_feature: The sequence is a functional homolog of SEQ ID NO 54 in the 10/714,887 US patent application
  misc_feature: The sequence is a functional homolog of SEQ ID NO 54 in the 11/435,388 US patent application
  misc_feature: The sequence is a functional homolog of SEQ ID NO 62 in the 10/714,887 US patent application
  misc_feature: The sequence is a functional homolog of SEQ ID NO 62 in the 11/435,388 US patent application
  misc_feature: The sequence is a functional homolog of SEQ ID NO 624 in the 10/666,642 US patent application
  misc_feature: The sequence is a functional homolog of SEQ ID NO 118 in the 10/714,887 US patent application
  misc_feature: The sequence is a functional homolog of SEQ ID NO 118 in the 11/435,388 US patent application
  misc_feature: The sequence is a functional homolog of SEQ ID NO 120 in the 10/714,887 US patent application
  misc_feature: The sequence is a functional homolog of SEQ ID NO 120 in the 11/435,388 US patent application
  misc_feature: The sequence is a functional homolog of SEQ ID NO 46 in the 10/714,887 US patent application
  misc_feature: The sequence is a functional homolog of SEQ ID NO 46 in the 11/435,388 US patent application
  misc_feature: The sequence is a functional homolog of SEQ ID NO 616 in the 10/666,642 US patent application
  misc_feature: The sequence is a functional homolog of SEQ ID NO 50 in the 10/714,887 US patent application
  misc_feature: The sequence is a functional homolog of SEQ ID NO 50 in the 11/435,388 US patent application
  misc_feature: The sequence is a functional homolog of SEQ ID NO 618 in the 10/666,642 US patent application
  misc_feature: The sequence is a functional homolog of SEQ ID NO 66 in the 10/714,887 US patent application
  misc_feature: The sequence is a functional homolog of SEQ ID NO 66 in the 11/435,388 US patent application
MANGTAARKETKVVHVHYRECQRNHAAAIGGYAVDGCREFMASGAEGTAAALLCAACGCHRSFHRREVEADMDCSSTTSG

SEQ ID NO: 41061 - DNA, 521 bp, Panicum virgatum
  misc_feature: Ceres CLONE 2006280
  misc_feature: Encodes the peptide sequence at SEQ ID NO. 41062
aaagcgagcgaccgaggaagccatagttagacgcctgtcgtcgccaatcttgagccacagaagcagaggttggggatcgaagaaggagaataagatgcaggactgggcgcccgtgttcgtctcgttagtgctcttcatcctgctctcgccggggctgatcttccagatgcccgccaagtcgcgcctcatcgccctgggcaacttccagaccagcgtcgcctccatcatcgtccacaccatcctcttcttcgccctggacgccatcttcctcgtcgccatcggcgtccagatccagctcggcaactaggcaggggcaaagctacctctgatgatccatggtcgaccaacaaccagatgatcatatcggtcgatcgttcgaggtgcacgcatggcttcgcctctagcgtcgttcctctgattaccggttcggtgtagtacgtgtaaatatggagcgtgcatagatttatgctgcctttggatcaactcaatttgctgctttaatttcaaggtcttatttgtgt

SEQ ID NO: 41062 - protein, 70 aa, Panicum virgatum
  misc_feature: Ceres CLONE 2006280
  misc_feature: Useful for making plants with altered cell wall content and/or composition
MQDWAPVFVSLVLFILLSPGLIFQMPAKSRLIALGNFQTSVASIIVHTILFFALDAIFLVAIGVQIQLGN

SEQ ID NO: 41063 - DNA, 588 bp, Panicum virgatum
  misc_feature: Ceres CLONE 2006282
  misc_feature: Encodes the peptide sequence at SEQ ID NO. 41064
aaccatcttcgtagcaactaacatttgcacagactcactgacagtctgacacgatggtcgccggcagcatcaccgagcaggtggcggtggccataccggccgagaagatgtggaaggcggcctttgcgaccagcgatgagtccgccttgtgcaaggtgttgggtggcttgatcgacgcagcgaaggtggagggtgacggcgggcctgggagccgcatcaccatgaagttcaacccagccgtgggctcaaatatggtgctcaagggccgcttggcgtcgcgcgacaacgcgacgcgcgtgattacttgggaccaggtggcagtagagggcggcgaggtggcaccagcgcagttcaagtctcaggcggtccagatgaaggtggagccggccggcgccggccgctgcgtgaccaaggtcgccgtggattacgagcgcctcgacggcacgccgctgtcgccggcggaccaggccaagctcatcaagggctatgtaggcatggtcaagaaggccgaggagaacatcgtcgcgcgccccggcgtgttcgcctgagctgatctcaagcacatattatccgcccacgccgttatat

SEQ ID NO: 41064 - protein, 164 aa, Panicum virgatum
  misc_feature: Ceres CLONE 2006282
  misc_feature (1)..(159): Pfam Name: Bet_v_I Pfam Description: Pathogenesis-related protein Bet v I family
MVAGSITEQVAVAIPAEKMWKAAFATSDESALCKVLGGLIDAAKVEGDGGPGSRITMKFNPAVGSNMVLKGRLASRDNATRVITWDQVAVEGGEVAPAQFKSQAVQMKVEPAGAGRCVTKVAVDYERLDGTPLSPADQAKLIKGYVGMVKKAEENIVARPGVFA

SEQ ID NO: 41065 - DNA, 703 bp, Panicum virgatum
  misc_feature: Ceres CLONE 2006287
  misc_feature: Encodes the peptide sequence at SEQ ID NO. 41066
actcgacccagcccactcaacacgtagcatatcaatggctgcctactcctcggtcgtcttcctcctcctcgccgccttcgtggccggtgctagcgcggccacgttcaccatcaccaacaggtgcagcttcacggtgtggccggcggcgacccccgtgggcgggggcgcgcagctcaacccgggtggggcctggaccatcaccgtgcccgccggcacccagtccggcagggtgtggggccgcacggggtgctccttcagcggcgggagggggcggtgcgcgaccggcgactgcggcggcgccttctcctgcaccctctccgggcagcctccgatgacgctggccgagttcaccatcggcggcgccatggactcgtacgacatctcggtgatcgacggcttcaacgtcggcatggccttctcctgcagcaccggcgtgggcctggtgtgccgggacgccggctgccccgacgcgtaccaccagcccccggacaggaagacccacacctgcgccgccaacagcaactaccaggtcaccttctgcccgtgatagatgaggcacaggcagcaacacctcctatagtcgaacaataaaccatgctcgctagctttgccatgcatgcacgatcgaagctaggcatgaacaaccccaaccatccaataatccaagggcgcacgcttgtgtacttatcttattataaacaat

SEQ ID NO: 41066 - protein, 170 aa, Panicum virgatum
  misc_feature: Ceres CLONE 2006287
  misc_feature (28)..(170): Pfam Name: Thaumatin Pfam Description: Thaumatin family
MAAYSSVVFLLLAAFVAGASAATFTITNRCSFTVWPAATPVGGGAQLNPGGAWTITVPAGTQSGRVWGRTGCSFSGGRGRCATGDCGGAFSCTLSGQPPMTLAEFTIGGAMDSYDISVIDGFNVGMAFSCSTGVGLVCRDAGCPDAYHQPPDRKTHTCAANSNYQVTFCP

SEQ ID NO: 41067 - DNA, 559 bp, Panicum virgatum
  misc_feature: Ceres CLONE 2006317
  misc_feature: Encodes the peptide sequence at SEQ ID NO. 41068
agcagcggaagaagaaggccgccgccgcctccaagagggagagggaaaaggaggcggaggcggaggcggatgaggtcaccgtggagctccgcacggtggggttcggcaaggaggtggtgctcaagcagcggcggcggatgcgccggaggaggcgcctcggcgaggaggagcgcgcggccatcctgctcatggccctctcctccggcgtcgtgtacgcctgacaccccgccgccgccacctcctagcagccaaggcaccaaaggcgatgagaggaagagagcggctgcagctgcagctgcagctgcagatttgcttaacatgcagcatgatcttagcccaagagagatgcgtctctctctaccccttttcccccttgatctatgctaagttttcccggctaagtagttgttggaaccaaagcgagttaataatcgtgtcgcgctctagactagtagctgttcttccttgttactgttgctgttcttgcctagttgcaatgttactggtagtagtgtggtagtatcttgtaaccttgcaatgtaaggagagcttattgatc

SEQ ID NO: 41068 - protein, 72 aa, Panicum virgatum
  misc_feature: Ceres CLONE 2006317
  misc_feature: The sequence is a functional homolog of SEQ ID NO 1054 in the 10/666,642 US patent application
  misc_feature: Useful for making plants with altered terpenoid content
QRKKKAAAASKREREKEAEAEADEVTVELRTVGFGKEVVLKQRRRMRRRRRLGEEERAAILLMALSSGVVYA

SEQ ID NO: 41069 - DNA, 841 bp, Panicum virgatum
  misc_feature: Ceres CLONE 2006333
  misc_feature: Encodes the peptide sequence at SEQ ID NO. 41070
gctgccattgccgggtcgagacctccgagacgaggttggccgccgcctgctcccggccgctccctctgcgtatctccatgggccaaggacagagtcagcccgcccctccggctgaggagcctactccgcccgccgcggagccgtcctcgccgtctcctgccccggcgtcctcctccctcgaggcgctcgccgcagaggctatgtcgtttgatgagggtgatactgaggagtcaattgatgagaaggtacaaaaagctctggagtgtccatgtgttgctgatttgaaaaatggtccttgtggaggcccatttgtcgatgcattttcctgcttccttaggagcaaagaagaagagaagggatcagattgtgtgaacccctttatcgcactacaggactgcatcaaagcaaatccagaggcattttctaaggagattttggaggaagaggagaatgatgaggaagcagagaattccagcctgaaagttagagccccagcatggtctagagaacccaaacccaaggcttgagattccatggcattaactgatgatacgaagattcatccagttcacagacttcacattatttctctgatatgttcttcagtagacagcagtagattgatttcagagctcaaagagccaaagaggcatccgaaatccatcccttgaaatacgcatactttgtgtggtaaaaatgccctgcagtatctttttttttatagaatatacacgttatttcgactgggaccaacaaacttgtaatctaaataactgggagttgggctttgaagtgccatgggaggagccatactagtactagcaagtaaaatttcgtgacg

SEQ ID NO: 41070 - protein, 149 aa, Panicum virgatum
  misc_feature: Ceres CLONE 2006333
  misc_feature (67)..(110): Pfam Name: CHCH Pfam Description: CHCH domain
MGQGQSQPAPPAEEPTPPAAEPSSPSPAPASSSLEALAAEAMSFDEGDTEESIDEKVQKALECPCVADLKNGPCGGPFVDAFSCFLRSKEEEKGSDCVNPFIALQDCIKANPEAFSKEILEEEENDEEAENSSLKVRAPAWSREPKPKA

SEQ ID NO: 41071 - DNA, 670 bp, Panicum virgatum
  misc_feature: Ceres CLONE 2006341
  misc_feature: Encodes the peptide sequence at SEQ ID NO. 41072
ggtggaggcagttgggacagagataaagtccaaagggctcttcgtgctgcttacaacaacccggaacgtgctgttgaatacctgtactctggtattccagtaacagctgaagttgctgttccagttggtgctctaggaggaaacacaactgatcaacctcttacaggggaagccaatctcgctggaattccaaacagtgctccattaaatctttttccacaggggggttccaatgctggaggtgggccacttgagtttcttagaaacaaccaacagtttcaagcacttagggaaatggtccaaacaaatccacaaatcttgcagcctatgctccaggaattgagcaagcagaatcctcaaattctaaggttgattcaggagaatcatgctgagttccttcagttaataaatgagccctttgaagatggcgagggggacttcttagaacaacctgagcaggatgaaatgcctcttgctatcaatgttacaccagaggagcaggaggccattggacggcttgaatccatggggtttgagagagcacgtgtcattgaggcattctttgcctgcgacaggaatgaggagctagctgcaaactatcttcttgagcatgctggtgaggaagattgagcgggaatagtttgcactcggtgagaactcggccatcctc

SEQ ID NO: 41072 - protein, 209 aa, Panicum virgatum
  misc_feature: Ceres CLONE 2006341
  misc_feature (84)..(142): Pfam Name: XPC-binding Pfam Description: XPC-binding domain
  misc_feature (165)..(201): Pfam Name: UBA Pfam Description: UBA/TS-N domain
GGGSWDRDKVQRALRAAYNNPERAVEYLYSGIPVTAEVAVPVGALGGNTTDQPLTGEANLAGIPNSAPLNLFPQGGSNAGGGPLEFLRNNQQFQALREMVQTNPQILQPMLQELSKQNPQILRLIQENHAEFLQLINEPFEDGEGDFLEQPEQDEMPLAINVTPEEQEAIGRLESMGFERARVIEAFFACDRNEELAANYLLEHAGEED

SEQ ID NO: 41073 - DNA, 764 bp, Panicum virgatum
  misc_feature: Ceres CLONE 2006371
  misc_feature: Encodes the peptide sequence at SEQ ID NO. 41074
atacaagcaattgattccgtcttttctgtttcttgatacccccaaaccgctcacaatggctcccaagatcgctatcgtctactactccatgtacggccatgtcaagacattggcagaggctgagctcaagggtatccgcgaggctggtggtgatgccaccctcttccaggtccccgagaccctgtcccaggacgtcctcgacaagatgtacgctcctcccaagcccaccgacatccccaccctgaacgaccccgccgagcttgaggctttcgacggtgtcctcttcggtatccccacccgttacggcaacttccccgcccagttcaagaccttctgggacaagaccggcaagcagtggcagcagggctccttctggggcaagtacgctggcatgttcatcagcaccggtaccctcggtggtggccaggagtccaccgctatcgccgccatgtcgactctcgtccaccacggcttcatctacgttcccctgggttacaagactgcctttgcccagctcgccaaccttgaggagatccacggtggctccccctggggtgccggaactttctctgccggcgatggcagccgccagcccaccgctcttgagctgagcattgccgttgagcagggcaaggctttctacgccgctgttgccaaggctcaccaatgactagatggcacctcatcgacgggggtcaagcaggaccaagcggttcctgcagcggcagcgtatagcacaacgcccaacacaactacaacaccag

SEQ ID NO: 41074 - protein, 204 aa, Panicum virgatum
  misc_feature: Ceres CLONE 2006371
  misc_feature (7)..(139): Pfam Name: Flavodoxin_1 Pfam Description: Flavodoxin
MAPKIAIVYYSMYGHVKTLAEAELKGIREAGGDATLFQVPETLSQDVLDKMYAPPKPTDIPTLNDPAELEAFDGVLFGIPTRYGNFPAQFKTFWDKTGKQWQQGSFWGKYAGMFISTGTLGGGQESTAIAAMSTLVHHGFIYVPLGYKTAFAQLANLEEIHGGSPWGAGTFSAGDGSRQPTALELSIAVEQGKAFYAAVAKAHQ

SEQ ID NO: 41075 - DNA, 653 bp, Panicum virgatum
  misc_feature: Ceres CLONE 2006377
  misc_feature: Encodes the peptide sequence at SEQ ID NO. 41076
gtcaccagcgcttgcaacaactcatccatccagcaccgtatcgtgccctcatcacattcacgcacaatggctcgcgctcagcaggtcgtggcgatcgccgtcgttgccgccgtcgtgctgctcgccgccgcggccacctccgaggccgccgtgacctgcgggcaggtgagctcggccatcggcccctgcatcgcctacgcccgcggcaccggctccggcccttcggcagcctgctgcagcggcgtgaggagcctcaactcggcggccaggagcaccgccgacaggcgcgccgcatgcaactgcctcaagtccgccgcaggcagggtgagcggcctcaacgccggcaacgccgccagcatcccgtccaagtgcggagtcagcatcccctacaccatcagcccatccgtcgactgctccaattggttggagcctgcatgctgccaagcacatccaccgatatatctagctatcgtctatatatgatcgatcgagttcttgctagctcgctgatgaataaaatctctccgccgtcgctcatcatgtgagagacacggccggatcggatgtgtcagtccctgctacgttttgtacgtgtctgctgcatgtacacctccatttccgttccagagtctgtaccttgtccactacctttt

SEQ ID NO: 41076 - protein, 138 aa, Panicum virgatum
  misc_feature: Ceres CLONE 2006377
  misc_feature (31)..(116): Pfam Name: Tryp_alpha_amyl Pfam Description: Protease inhibitor/seed storage/LTP family
MARAQQVVAIAVVAAVVLLAAAATSEAAVTCGQVSSAIGPCIAYARGTGSGPSAACCSGVRSLNSAARSTADRRAACNCLKSAAGRVSGLNAGNAASIPSKCGVSIPYTISPSVDCSNWLEPACCQAHPPIYLAIVYI

SEQ ID NO: 41077 - DNA, 523 bp, Panicum virgatum
  misc_feature: Ceres CLONE 2006395
  misc_feature: Encodes the peptide sequence at SEQ ID NO. 41078
atccgcaaacgcaagcttcacggcttcacgcacagcctctctccccgcagcttctccgccgggcttcacctgcgaacccgcctcgatcgatcagcgttccacgcggagcaggcagatggccgccacgatgaagctccggatcctcgccatcgccgtcgccgccgcgtcgtgcctggtcgcgaccgccgccgcggccgagggcccggcgcccgccccgacgtccggcgcgccttccatggccgcgccggccgttgccgccgcgtccctgaccgcgctcgtcttcggctacctcttctaagaagtgccgtggacggcgttgcctgtagtgccaaatcgttttcctgctcagagatttcttcttctcgttgctgtctttgctcttgttggtgtggatgatgggtatgtaattaagtgttcttttttttatatgaatcttgtaatctcagtacaagggcatagtaaatagagagagctgcagtttggttcttttttttacacaatggtgacaaaagccgaccggacc

SEQ ID NO: 41078 - protein, 60 aa, Panicum virgatum; identical to SEQ ID NO: 34461
  misc_feature: Ceres CLONE 2006395
  misc_feature: Useful for making plants with altered carbohydrate content
  misc_feature: Useful for making plants with altered cell wall content and/or composition

SEQ ID NO: 41079 - DNA, 510 bp, Panicum virgatum
  misc_feature: Ceres CLONE 2006404
  misc_feature: Encodes the peptide sequence at SEQ ID NO. 41080
acggcggctacccctttctgtctcaggctctcagcaagcaaggttagggtttctgctcaaaaaaaaaaagcaaggttagggtttggtggttggacggagaagcctgtagtagatccttcgttagggagtcgccatgagccggtcggggcagcctccggatcttaagaagtacatggacaagaagctccaaatcaagctgaacgcaaaccgtgttgtcattggcactctgcgtggatttgatcagttcatgaatctggtcgtggacaacacagtggaggtcaatggaaacgacaagaatgacattgggatggtggttatcagggggaatagtgttgtcatgatcgaaacccttgaaccggttgccaaagctcagtgaactgtcagcctgttttagtagttaataagctggtagtgttaaattgaaactgatgtatgccatggggcaccgatgtatcctgagttcctgaatcctgacccttattcatgtgcaagctttaagcacctttgtat

SEQ ID NO: 41080 - protein, 80 aa, Panicum virgatum; identical to SEQ ID NO: 10301
  misc_feature: Ceres CLONE 2006404
  misc_feature (8)..(72): Pfam Name: LSM Pfam Description: LSM domain

SEQ ID NO: 41081 - DNA, 573 bp, Panicum virgatum
  misc_feature: Ceres CLONE 2006425
  misc_feature: Encodes the peptide sequence at SEQ ID NO. 41082
taacagttttgctccttctctcaacctaaagtaccgaaaatggaagctgtacagacattcggccgtaagaaaaccgccactgctgttgctcactgcaagcgtggtcatggtctcatccgtatcaacggttcccccatcgaactcctcgaacccgagatcttgaagttcaaggtctacgaagttatccttctcttgggtgaggagcgtttcgccaacactgatatcagaattcgtgttaacggtggtggtcacacttctcaagtttatgctatccgtcaagctcttgctaaggctatcgtcgctttctaccaaaagttcgtcgatgaggctgccaagaaggaaatcaaggagatcctcgttcaatatgaccgtaccctcctcgttgctgatccccgtcgttgtgaacccaagaagttcggtggtcccggtgctcgtgcccgtttccaaaagtcttaccgttaaagaaattgtgtattctcttttttcaaagagtatattgttggcctcaagctacatttttttgacataatttggtagatttcttttattgttccaaataaaattaaagcatat

SEQ ID NO: 41082 - protein, 140 aa, Panicum virgatum
  misc_feature: Ceres CLONE 2006425
  misc_feature (8)..(140): Pfam Name: Ribosomal_S9 Pfam Description: Ribosomal protein S9/S16
MEAVQTFGRKKTATAVAHCKRGHGLIRINGSPIELLEPEILKFKVYEVILLLGEERFANTDIRIRVNGGGHTSQVYAIRQALAKAIVAFYQKFVDEAAKKEIKEILVQYDRTLLVADPRRCEPKKFGGPGARARFQKSYR

SEQ ID NO: 41083 - DNA, 738 bp, Panicum virgatum
  misc_feature: Ceres CLONE 2006428
  misc_feature: Encodes the peptide sequence at SEQ ID NO. 41084
gatcctccctccgacttcttttcttcaattgttcttaaattttattcctctctctctctcgtcttcctccaacatacacaaaaccaacaaaacccccccaaccacagaaatcatgtcgcagtatcctccccaaggtggctaccctccccagggttacccgcccccccagggctatgcgcctcagccctacccgccccagggctatcctccccaaggttatccgccgccccagcccatgcaatatcatgaggcgcccccggccaaggaggagaagagccacggctgcctctacacttgtatcgccgccatgtgctgctgctggctctgcggcgagacctgcgagtgctgcctggagtgtttggactgctgctgctaaaagagcaaatcaacccatgcagcctaacgacacatgaatcctgctttaatgcgcccgtccgagccgacaaaccgacaatggtctgtgagcaggggatctgagcttggcggtttcggaagggtaggcggactgacaactatcggggaggacggcggacatctggagcgggagggaaaggacggggcggtgttacgggattacaccggggaatgaggattgacttttttttttttttttttttgctactgcctaccaccgactcacgtctgccgaccgcgacgggttttcttttgggtttctcgatgctcgatttagttgtccgtttttttattaatacccgacagcccggcggtcttccttgc

SEQ ID NO: 41084 - protein, 87 aa, Panicum virgatum
  misc_feature: Ceres CLONE 2006428
  misc_feature: Useful for making plants with altered cell wall content and/or composition
  misc_feature: Useful for making plants with altered carbohydrate content
MSQYPPQGGYPPQGYPPPQGYAPQPYPPQGYPPQGYPPPQPMQYHEAPPAKEEKSHGCLYTCIAAMCCCWLCGETCECCLECLDCCC

SEQ ID NO: 41085 - DNA, 671 bp, Panicum virgatum
  misc_feature: Ceres CLONE 2006431
  misc_feature: Encodes the peptide sequence at SEQ ID NO. 41086
atctcctccctctgtttctttctttctccaacctttcccttctctcggactctctcctcccttgctcttccttccctgacagcgacgactgggcgagcggcggcgccatttatcacggtcttcgcccagccctttgccggcgacgagcatccaccagatattactctgaatgatggcaactctgaaagatgctgctgcaaggaagcctgtactggcaacaatccgtcttattgttccagctggtgctgcccgtcctgcacctccagttggtccagcgctgggtttctaccggctcaatttgatggctttctgcaaggatttcaatgccaggacccagaagtacaaggcagacactccaatgcaagtcaccttaactgcttacaaggatagcaccttcgagttcgtggtcaagtcacccccagtatcatggttcctcaagaaggctgcaggaatagaaacagccagcagtcgcccaggccacagcaatgtgtcatccctcactctccgccatgtgtatgagattgcaaaattgaagcaggctgaccccttctgcaagcacatgtcgcttgaggcgctgtgcaagtccatcattgacagctaactccatgggcattgagattgttaaagatctatgagaagcttagtcaggaagaattccgtgattaatcttc

SEQ ID NO: 41086 - protein, 142 aa, Panicum virgatum
  misc_feature: Ceres CLONE 2006431
  misc_feature (16)..(75): Pfam Name: Ribosomal_L11_N Pfam Description: Ribosomal protein L11, N-terminal domain
  misc_feature (80)..(142): Pfam Name: Ribosomal_L11 Pfam Description: Ribosomal protein L11, RNA binding domain
MATLKDAAARKPVLATIRLIVPAGAARPAPPVGPALGFYRLNLMAFCKDFNARTQKYKADTPMQVTLTAYKDSTFEFVVKSPPVSWFLKKAAGIETASSRPGHSNVSSLTLRHVYEIAKLKQADPFCKHMSLEALCKSIIDS

SEQ ID NO: 41087 - DNA, 722 bp, Panicum virgatum
  misc_feature: Ceres CLONE 2006437
  misc_feature: Encodes the peptide sequence at SEQ ID NO. 41088
acgctgctagctacgcatagcacagcagggacgacgagcgacctgcccggcggccgttcgccgccgccgtagcggaataaagagagcgcacgcacaccaaccgcctccgccgccgtctcctcccgtcgcccacgtagacgtccttatctgcgccgccgtgctccgctccgcctccgcggccgctgcgacgtacgcccgatcgacgacgacacagctagtagcaatggcggcggcgtccaagggcttcctcctgctcgctctcctcgcggcggccgccgtgctcgccaccgccgcggcggagcaacgaacccatgacagaaaggagaagatggcgaacggcgccgccggcgtggagcactggcacggcggtggcggcggccacggcggcgggtcaggtgatgagcacagccacggctgcgagtacggctgctgccgccgcgtataccacggcggctgcaagaagtgctgcccgcctcccggcggccggccggaggtggggaactagcaagacctcgtcctacgctgagcaggatcggagatcgatgcccggcgaggtgttcttcaagttcatactcgttacgtacccaacacgggtgtagcttagtattagcttggttgtgcgtggtagcatccttacgagtgaataacgtgcgacgtgcacgtacggataggcccgtacgtgtatggacgtacgcacacatgtacgtcttcctctcctttct

SEQ ID NO: 41088 - protein, 93 aa, Panicum virgatum
  misc_feature: Ceres CLONE 2006437
  misc_feature (1)..(78): Pfam Name: GRP Pfam Description: Glycine rich protein family
MAAASKGFLLLALLAAAAVLATAAAEQRTHDRKEKMANGAAGVEHWHGGGGGHGGGSGDEHSHGCEYGCCRRVYHGGCKKCCPPPGGRPEVGN

SEQ ID NO: 41089 - DNA, 724 bp, Panicum virgatum
  misc_feature: Ceres CLONE 2006440
  misc_feature: Encodes the peptide sequence at SEQ ID NO. 41090
tggaacacttaacaagtggcacttggatgacaaaattggtgcttatttcgactatggtaaccatactgaaaaggtccgactgagatggtatgatgtccaagacaaggatactctgagacgagagctcttgcgagaaacattacaaccccctcagctgcaattagtaccccatattggttatgtcagcctcttcccattcatgatgggagctattccacctgaatcatgggttcttgagaaacagcttgatctaatatccaatacctctatattgtggacagattatggtcttcggtcactttctagaacaagttcaatatatatgaagcgcaatacggagcatgatcccccatattggagaggtgccatttggataaacatgaactacatgattctttcagcactacatcattattcacatgaggatggcccatacaagggcagggcaggagaattatatgacaagctaagatcaaatcttatccggaatatcgtgaaaaattaccatgaaactggtttcttctgggaaaactttgaccaaaagaacaaaggaaagggaaagggtgcacggtcatttactggatggacttcacttcttgttttgatcatggcagagtcctacccgacgttgcataggtgagatatacatggctaacaaccacagaagaagataaccgtggcaattcgaatggaggggctggcaactggccattgttttagctcg

SEQ ID NO: 41090 - protein, 212 aa, Panicum virgatum
  misc_feature: Ceres CLONE 2006440
  misc_feature (1)..(207): Pfam Name: Glyco_hydro_63 Pfam Description: Mannosyl oligosaccharide glucosidase
  misc_feature: SWISSPROT Homolog: EC 3.2.1.106 Mannosyl-oligosaccharide glucosidase
GTLNKWHLDDKIGAYFDYGNHTEKVRLRWYDVQDKDTLRRELLRETLQPPQLQLVPHIGYVSLFPFMMGAIPPESWVLEKQLDLISNTSILWTDYGLRSLSRTSSIYMKRNTEHDPPYWRGAIWINMNYMILSALHHYSHEDGPYKGRAGELYDKLRSNLIRNIVKNYHETGFFWENFDQKNKGKGKGARSFTGWTSLLVLIMAESYPTLHR

SEQ ID NO: 41091 - DNA, 709 bp, Panicum virgatum
  misc_feature: Ceres CLONE 2006441
  misc_feature: Encodes the peptide sequence at SEQ ID NO. 41092
gataatgttgtaggaagtgccaagtccttcttaaaggctagaggcctgaaaggtgctgatgttttatatgatcctgttggggggaagcttactcaagatagcctgaaacttctcaattggggtgcgcacattctggtcattggatttgccagtggtgatgtaccagttattcgagcgaatattgctcttgttaagaactggacaattcatggtctgtactggggaagctacttaactcatgagccacgagtgcttattgactccctcaatgaactcttgttatggctctcaaagggtctgataacagttcaaatttcacaccgctacaggcttgctgaggcccatctcgcttttgctgccctaagagataggaaggcagttggcaaggtcatgattgtaatgggctcgtcagcaaaatcaaggctctgatatccttccgaaatgcttctgtacaacatgagacatctattgtgcatctcttatatgaattgtaagacacaggattatctgagactgtagtagtttccctgtccaaaatgtttgtgaacaaaatcgacaaaagcaatcctagaaataaacagtttatctgcagatacatctgatgggaaatacctatatgatgccagtgttgtgagtagtggcaggtaaaatgaatacaatctgaataatcagcatctaggttacagctggagaggaaagtacacatttt

SEQ ID NO: 41092 - protein, 142 aa, Panicum virgatum
  misc_feature: Ceres CLONE 2006441
  misc_feature: SWISSPROT Homolog: EC 1.6.5.5 NADPH:quinone reductase
DNVVGSAKSFLKARGLKGADVLYDPVGGKLTQDSLKLLNWGAHILVIGFASGDVPVIRANIALVKNWTIHGLYWGSYLTHEPRVLIDSLNELLLWLSKGLITVQISHRYRLAEAHLAFAALRDRKAVGKVMIVMGSSAKSRL

SEQ ID NO: 41093 - DNA, 677 bp, Panicum virgatum
  misc_feature: Ceres CLONE 2006463
  misc_feature: Encodes the peptide sequence at SEQ ID NO. 41094
aacaacacatcaactcaagaaaagtcgatcgacccccgtgcgatacagagctaggctttgcgcacgtcgacgtagccaagctttttgagtccacgaggagaggcggcaggtcaagcgggcaagaagctttggatcggaggtcagcagcggggcgcatggccatggaggtccagggctccaggcggcaccaggacgccggcgtgaaggtcaagttcatcgaaacgcagttcatcagctccgacgccgccagcttcaaggccgtcgtgcagcgcctcaccggcaagtcccccgccgactcgtcgaggccggcccaggcgttactggcgccgcagccgcagaggccgcgcccgtgccggccggccttcgctggggcggggcagcaccatcaggccgccgggtggccggagcagcaccaagctggcgcctacctggtcgcgccggcaccgaagcaggcgccgctcgcggcggcgccgagcctggaggagatgcaagagctctgcgacttcgccgacctgttctacaccaccagcggcgccacgggcgcgcggcgcgacattgccggcatcgccttcccttactgaatttgtttttccgagcaccaatgcttgtagtttgcctttgcaaattcgcagtgtgttgagcacattaatggtcgtcgaggagctagatgcgacgag

SEQ ID NO: 41094 - protein, 141 aa, Panicum virgatum
  misc_feature: Ceres CLONE 2006463
  misc_feature (19)..(49): Pfam Name: VQ Pfam Description: VQ motif
MAMEVQGSRRHQDAGVKVKFIETQFISSDAASFKAVVQRLTGKSPADSSRPAQALLAPQPQRPRPCRPAFAGAGQHHQAAGWPEQHQAGAYLVAPAPKQAPLAAAPSLEEMQELCDFADLFYTTSGATGARRDIAGIAFPY

SEQ ID NO: 41095 - DNA, 640 bp, Panicum virgatum
  misc_feature: Ceres CLONE 2006467
  misc_feature: Encodes the peptide sequence at SEQ ID NO. 41096
aaatattaaatctttgattaatacaaacacacaagatgcctcactcttacggatacaaagccagaactagatccaagttctccaaggccttcagaagacacggttccgtcagaatctccaacgtcctcacctcctacagagttggtgactacgtcgatatcgtcgccgatggtgccatccacaagggtatgccccacaacctctatcacggaaagaccggtagagttttcaacgtcaatcaaagatcagtcggtgtcatcgtcaacaagcaacacagacaaagaatcatccccaagagaatccacgtcagatgtgaccacgtcagaatctccacctccagagaaggattcttgaagagatgcaaagaaaacgacaagttgaagactgaagccaacaaatctaacaagagaatctccaccaagagacaacccgtcgctcccagagaagctcactccgtcaagggtaacgtcagattccaacaccctcaagctttcagagaattctggtaagaattttgctcaagagttattggtgcggacatatggagatctataaagtacatagaagctttatgtttgtatagtgatcattgcattgcttatatatcatccccaaaccaaaaaacttaatacccctagtc

SEQ ID NO: 41096 - protein, 157 aa, Panicum virgatum
  misc_feature: Ceres CLONE 2006467
  misc_feature (2)..(100): Pfam Name: Ribosomal_L21e Pfam Description: Ribosomal protein L21e
  misc_feature: Useful for making plants with modulated flowering time
MPHSYGYKARTRSKFSKAFRRHGSVRISNVLTSYRVGDYVDIVADGAIHKGMPHNLYHGKTGRVFNVNQRSVGVIVNKQHRQRIIPKRIHVRCDHVRISTSREGFLKRCKENDKLKTEANKSNKRISTKRQPVAPREAHSVKGNVRFQHPQAFREFW

SEQ ID NO: 41097 - DNA, 568 bp, Panicum virgatum
  misc_feature: Ceres CLONE 2006482
  misc_feature: Encodes the peptide sequence at SEQ ID NO. 41098
ggtccatgaattccgtgttggagacaagtcgcatcccctctcagatcaaatttacatgaagcttgaggaattgggcatggaaatgaaggctatgggttataaacctactactgaggtggtgatgtttgacattgaagacgaagagaaggagcatacgctagtgcatcacagcgaaaagatagccattgcatttagccttcttactactaagccaggcgagaccataagggtcaccaaaaacctccgggtttgcagtgactgtcacactgccatcaaactcatctcgaggataaccaatcgtgaaattattgttcgagataataatcgatttcattgcttcagagatggtcattgctcttgtaatgactactggtagtatacagacaacttcctgatgcagttttgagcagcagggaaagttgaaagcatcattgtcattttgatgtaaaactgtagtcaggctagagttgtaattggagcataggagaggtagactataaggcaggctaacactgcaatgttatattttttcctccccgttctattgttttctcctgagaggaatcga

SEQ ID NO: 41098 - protein, 124 aa, Panicum virgatum
  misc_feature: Ceres CLONE 2006482
  misc_feature: Useful for making plants with altered cell wall content and/or composition
VHEFRVGDKSHPLSDQIYMKLEELGMEMKAMGYKPTTEVVMFDIEDEEKEHTLVHHSEKIAIAFSLLTTKPGETIRVTKNLRVCSDCHTAIKLISRITNREIIVRDNNRFHCFRDGHCSCNDYW

SEQ ID NO: 41099 - DNA, 593 bp, Panicum virgatum
  misc_feature: Ceres CLONE 2006484
  misc_feature: Encodes the peptide sequence at SEQ ID NO. 41100
atcgcacattatctagtatctgctcctgacaaagcctcgtcatagtttgtgagtttgtggtgtgtaccgtctccgatggcgactgagaggctgaagggtacggtgaagtcgttcgacgagccggatgggttcgggatagttaactccgttcacgatggcgccaaggactacgtggtgcgccgctcggacatcaagacggagggctttggcatagtctctgcgggccagcgcgtggagttcacgccggggaccggggacgacggcaagcacattgcccttgatgtcaccgtcctcgatggcgcaccggccggtaccggcggcagtgaagctccagagagtgcaagtaagcagtgatggactgatggtactggttgtctgtgatgtcatctacacgctatgctcttactattgtagtattactgtgtgatggtgtatgttcggtcttatgtcatgttacatatgtacgtatgtcacaggagatggtatgatcttgtgctgtttgaataagaatctcattacgagactttagtcatttaaggaacatgtctacgtactgtctacctaagtatatatagtatcgtccatttagacgg

SEQ ID NO: 41100 - protein, 92 aa, Panicum virgatum
  misc_feature: Ceres CLONE 2006484
  misc_feature (5)..(73): Pfam Name: CSD Pfam Description: 'Cold-shock' DNA-binding domain
MATERLKGTVKSFDEPDGFGIVNSVHDGAKDYVVRRSDIKTEGFGIVSAGQRVEFTPGTGDDGKHIALDVTVLDGAPAGTGGSEAPESASKQ

SEQ ID NO: 41101 - DNA, 672 bp, Panicum virgatum
  misc_feature: Ceres CLONE 2006500
  misc_feature: Encodes the peptide sequence at SEQ ID NO. 41102
agcactccccgccgccacctccgctcaggcttcctcgaggcgaaaccctagcgcccgacctcctctccgctccaccccactcagccatggcggcggtggacgtggcgtacgcgccgccgatgaagtccggcaaggcggggttcgaggggacgctggagccgcagcacaggatccgcatcaccctctcctccaggaacgtcaagaacctcgagaaagtctgcggcgatctggtgaagggtgccaagggtaagcagctgaggttgaagggacctgtccggatgcccaccaaggtgctccacatcaccaccaggaagtctccctgtggcgaaggcaccaacacctgggatcgttttgagatgaggattcacaagagggtgattgatctcgtcagcacaccagatgtggtcaagcagatcacctcaatcaccatcgagcctggtgtggaggtcgaggtgacaatcagcgacgtgtaatgtggtagcccagcatcgtatcatttcaaaatgattggaaatgcaactgaacaggatgttttgagagtttctagtgtgagaaaactcattgtagcagaggaattccctcctaatcgttagtttagtcacatcagaattgatgagcccatcgagcttttgtggcatgctagtctgtcagtgggtggtatggcatgagtgg

SEQ ID NO: 41102 - protein, 128 aa, Panicum virgatum
  misc_feature: Ceres CLONE 2006500
  misc_feature (28)..(123): Pfam Name: Ribosomal_S10 Pfam Description: Ribosomal protein S10p/S20e
  misc_feature: Useful for making plants with modulated phosphate use efficiency
  misc_feature: Useful for making plants with modulated biomass
  misc_feature: Useful for making plants with modulated flowering time
MAAVDVAYAPPMKSGKAGFEGTLEPQHRIRITLSSRNVKNLEKVCGDLVKGAKGKQLRLKGPVRMPTKVLHITTRKSPCGEGTNTWDRFEMRIHKRVIDLVSTPDVVKQITSITIEPGVEVEVTISDV

SEQ ID NO: 41103 - DNA, 454 bp, Panicum virgatum
  misc_feature: Ceres CLONE 2006522
  misc_feature: Encodes the peptide sequence at SEQ ID NO. 41104
gaaacggagaaagacatgaacgatcaactcccgttcttctaagtcttaaaaatgaaaaaattaaatattttgcaagtggtggagcaagtgttattgctttaactgaaggtggaagtttgtatagttggggattagggataagtggaagattgggaactggagatgaagaaaattctccacttcctcaaagaattgaattttttgatagattaaacctcaaagtcactaaaattagaggcaaaggaggacatgtccttgcccaaacagaggatggggggttgtttagttggggtttagggacacatggaaggttgggacattttgatgaacataatcaagtgattccaaaacagatcgaattttttagaaatagaaaagttatcagttttgcagcaggaatggatcacagtgttgttgttgttgaagaagaataaatttttttctgaatttttct

SEQ ID NO: 41104 - protein, 143 aa, Panicum virgatum
  misc_feature: Ceres CLONE 2006522
  misc_feature (90)..(139): Pfam Name: RCC1 Pfam Description: Regulator of chromosome condensation (RCC1)
  misc_feature: SWISSPROT Homolog: EC 2.7.11.1 Non-specific serine/threonine protein kinase
NGERHERSTPVLLSLKNEKIKYFASGGASVIALTEGGSLYSWGLGISGRLGTGDEENSPLPQRIEFFDRLNLKVTKIRGKGGHVLAQTEDGGLFSWGLGTHGRLGHFDEHNQVIPKQIEFFRNRKVISFAAGMDHSVVVVEEE

SEQ ID NO: 41105 - DNA, 601 bp, Panicum virgatum
  misc_feature: Ceres CLONE 2006533
  misc_feature: Encodes the peptide sequence at SEQ ID NO. 41106
gatccctgcccgcagttaacagtagctgtgagcatcgccaccgccccccacctcaccctcatcaatggcggcgagaagcctcctggcggcggcgttcctggcgctggcggtgccggcggtgctgtgccaggcgcccggcccggcggcgcccaagggcccgccgaacgtgacggcgatcctggagaagggtgggcagtacgcgaccttcatccggctgatgaaggcgacgcagcaggacacgcagctcaacagccagctcaacaactccttcggcagcggctacacggtgttcgcgcccaccgacaacgccttcaacagcctcaagcccggcacgctcaacaagctgtcgcagcaggagcaggtgtcgctggtgcagtaccacatcctcccgcagttctactcgctcgactccttcgagaccgccagcaaccccgtccgcacgcaggcgtccggctccgacgtgcatgtgcatgagtagcgttcttgttgcgatttcattttcttcttctcttgatcttggatttgttcgttgcttcacctggtttggagaaaccgggccatgtgatcccgatccctgaatgttaatgatgctcagttactg

SEQ ID NO: 41106 - protein, 137 aa, Panicum virgatum
  misc_feature: Ceres CLONE 2006533
  misc_feature (44)..(136): Pfam Name: Fasciclin Pfam Description: Fasciclin domain
  misc_feature: Useful for making plants with altered carbohydrate content
  misc_feature: Useful for making plants with altered cell wall content and/or composition
MAARSLLAAAFLALAVPAVLCQAPGPAAPKGPPNVTAILEKGGQYATFIRLMKATQQDTQLNSQLNNSFGSGYTVFAPTDNAFNSLKPGTLNKLSQQEQVSLVQYHILPQFYSLDSFETASNPVRTQASGSDVHVHE

SEQ ID NO: 41107 - DNA, 503 bp, Panicum virgatum
  misc_feature: Ceres CLONE 2006548
  misc_feature: Encodes the peptide sequence at SEQ ID NO. 41108
atccacgtccaacctccttcttctcaatgggtcgcgtcagaacaaagacagttaaaaaagcagcacgtttggttgttgaaagatattatccaaaattgactcttgattttcaagtcaacaagaaaatctgtggagaagtcgcagttattccttcaaagcgtcttcgtaatcaaatcgctgggtttgtaactcatctcatgaaacgaattgctcgaggtccagtcagaggaatctcattagtattgcaagaagaagaaagagaacgaagagataactacgttccagctgaaaccatcttggcttcaatggtccgcaagaccgaaattgatgacactaccaaagaaatgctcgaggctatgtgcgattttggaaaactcaccgctgctggaattcaaacagctggttcagcacctgttcaacaaggatttagagataatcgatttccacctcgaagaactgaccgaaaataaattggaaataaataaaggaggttgatcaacttt

SEQ ID NO: 41108 - protein, 147 aa, Panicum virgatum
  misc_feature: Ceres CLONE 2006548
  misc_feature (1)..(125): Pfam Name: Ribosomal_S17e Pfam Description: Ribosomal S17
MGRVRTKTVKKAARLVVERYYPKLTLDFQVNKKICGEVAVIPSKRLRNQIAGFVTHLMKRIARGPVRGISLVLQEEERERRDNYVPAETILASMVRKTEIDDTTKEMLEAMCDFGKLTAAGIQTAGSAPVQQGFRDNRFPPRRTDRK

SEQ ID NO: 41109 - DNA, 1148 bp, Panicum virgatum
  misc_feature: Ceres CLONE 2006554
  misc_feature: Encodes the peptide sequence at SEQ ID NO. 41110
atcactgacgaacgacctgcgaacaagccgtgactggcccccatcatccggcacctgcccccttcaattcagtttgccgtcttaatattcaagtttaattttacccttcaatttccgccaagatgtccatctgggatgccctcaccggacgcaagtcctccccctcgcagacctcgtcatcgagcgcacccgccgcgccgtccgccccagagcaccacactcctaccaataccttccagccgacgactaccttcgaccctactaccgcccaaggcgtagaatccttccttggcagctcctcctttgccgacccctcacaactacaccccctcgccggcctcaacaaagatacgctagactacctctccctcgaagactctgcgctctcggatttgcccggctcccaatcggcactgccgtcacgtggcttcacagatgacctctgctatggaacaggcacaacatacctcgccggcctctcgctaggaggcgcatggggcttgcaggaggggttgaggaagtcggccggcgagtcgccaaaactccggttgaactcggtgctcaactcgatcacacggagagggccgttcctgggcaactcggcgggcgtggtggcagtctgctacaactgcatcaactcatacattgggtacctgagggggaagaacgatgccgccaacacgattgtggctggcgcccttagtggcatgttgtttaagagtacaagggggcttcggccgatggcaatttctggtggtatcgtggcttcggtggccggcgcatgggcggtcgtgaggaggactatcttcgttaaccaggaagattcccatccccaggctcttgcaaccctctgaacaagcaactggatcttcaatgatctccgatgatcttgcatacgacacaatctgtggcttgattttgccaccacattccatcttttaatctacagacaacagcgtacttccacaaagctgttttgtgtgtaaatgtccctttaagggctgacgtgtacgaaactgggccagggggtgaagggctggtatgcatagcgcagggtatctctcctcccatggaaattgtatattagtggcttatggtcatagagcgctcggttgagcgcatagcatgcagtggacctcgatcattcg

SEQ ID NO: 41110 - protein, 243 aa, Panicum virgatum
  misc_feature: Ceres CLONE 2006554
  misc_feature (97)..(228): Pfam Name: Tim17 Pfam Description: Tim17/Tim22/Tim23 family
MSIWDALTGRKSSPSQTSSSSAPAAPSAPEHHTPTNTFQPTTTFDPTTAQGVESFLGSSSFADPSQLHPLAGLNKDTLDYLSLEDSALSDLPGSQSALPSRGFTDDLCYGTGTTYLAGLSLGGAWGLQEGLRKSAGESPKLRLNSVLNSITRRGPFLGNSAGVVAVCYNCINSYIGYLRGKNDAANTIVAGALSGMLFKSTRGLRPMAISGGIVASVAGAWAVVRRTIFVNQEDSHPQALATL

SEQ ID NO: 41111 - DNA, 549 bp, Panicum virgatum
  misc_feature: Ceres CLONE 2006560
  misc_feature: Encodes the peptide sequence at SEQ ID NO. 41112
agtcagcgctagctctcctcccgttccgccttcccgagctgcactgcgccgccgcgtcctctccacctcctccggcgagaatcgctcacctccggcgaggtccctccgttccgggtctgcgaggaagtgccggcgagctcccttccacccctccggcgagctcccgttccgaagcggaatgggcctgtggacattgctggagggttttctacttctcgcaaatgcattggcaatactgaacgaagatcgttttcttgctcccaggggatggagcatgtctgaagtgtcaggaaatgggcaaacaaagtcattgaagggccagatcgtgggccttatctacgccacacaatttctgagggtgcccttgatagcccttaatgttcttatcattgttgtgaagttggtgtcaggctgagtctcactgtctggttttgtctgttggttggatcgatatcagtagcattatgtaaaagttaaatatactcaaagttgctggagacatgttcatgtagcctccaatgtgcatttatgttattgttctggtaaagc

SEQ ID NO: 41112 - protein, 78 aa, Panicum virgatum; identical to SEQ ID NO: 33647
  misc_feature: Ceres CLONE 2006560
  misc_feature (3)..(78): Pfam Name: Yos1 Pfam Description: Yos1-like

SEQ ID NO: 41113 - DNA, 613 bp, Panicum virgatum
  misc_feature: Ceres CLONE 2006569
  misc_feature: Encodes the peptide sequence at SEQ ID NO. 41114
gacatcgttgaagtaagcttttatcccaatggtacgtgatggtaacttgttggttaatggagtagtccaggacgaagaatttgtgctggagccggccaactatgaaatggatccactgactgtccctgaaggctatgtatttgtactgggggacaacagaaacaacagctttgactcacataactggggaccgcttccagtgaatagcattctagggagatctgtgcttcgttactggccaccgtcaaaaataacagatacaatatatgagcatgatatggcgcaattcgcagtcgccacgtcctgagatatgcattggcagtaccacatgaaaatctagtcccatttttccttttatttttccggctgagctttactgacaagtgacaagctgagccgtttattggatgtcgccttgccgcagatgcccattggcagcttggctgacagataagttttggcagatgctctttcgaaggcaacaattcctgtactatgtagcctaagaagggaacccctgtatacatgttatgtttctaaaggcagatgaatgagcttcatggctgccagtaggcttagcatcagatggcaagttctgttatgtttttgagac

SEQ ID NO: 41114 - protein, 92 aa, Panicum virgatum
  misc_feature: Ceres CLONE 2006569
  misc_feature: SWISSPROT Homolog: EC 3.4.21.89 Signal peptidase I
MVRDGNLLVNGVVQDEEFVLEPANYEMDPLTVPEGYVFVLGDNRNNSFDSHNWGPLPVNSILGRSVLRYWPPSKITDTIYEHDMAQFAVATS

SEQ ID NO: 41115 - DNA, 712 bp, Panicum virgatum
  misc_feature: Ceres CLONE 2006573
  misc_feature: Encodes the peptide sequence at SEQ ID NO. 41116
gacagcgcccgcgccgcctccctctcgccagcggcggctgcctctccaagcccccaggcagaccaccatttgttgattcctccattcttcagcctgcactccggttcgcagtttcacttgtcaagtccgtattcaaggggggagatagtctcttccgctgaggggagccgagatgaagccagtggtggggatcgtagtgtcaaacaagatgcagaagtcggtggtggtggcggtggaccgcctcttccaccacaaggtgtacaaccggtacgtcaagcgcacctccaagttcatggcgcatgacgaggccgaggcctgcaacatcggcgaccgggttaggctggatccttccaggcccttgagcagacataagcactgggttgttgctgaaattcttcgcagagctaagatgtatgttccgccatctgcaacagcgtccagtgaaaatgataccaaggctcaacagtctggtcttgctaccaaatgatccgcctttagttcctttgaggcaaagacacagttgccaatttttttttctgtgtgtttgttaacttgtgcaatgtgcatgtaatgtttaattcatagaagaaataacatggcatccatcatttttgctggacttggtttgctctgtcgcgccctttgtttaacggcgcccatcatttgtgctctcttgctagctgccctccaagtttatatgagagcttgagag

SEQ ID NO: 41116 - protein, 104 aa, Panicum virgatum
  misc_feature: Ceres CLONE 2006573
  misc_feature (6)..(74): Pfam Name: Ribosomal_S17 Pfam Description: Ribosomal protein S17
MKPVVGIVVSNKMQKSVVVAVDRLFHHKVYNRYVKRTSKFMAHDEAEACNIGDRVRLDPSRPLSRHKHWVVAEILRRAKMYVPPSATASSENDTKAQQSGLATK

SEQ ID NO: 41117 - DNA, 467 bp, Panicum virgatum
  misc_feature: Ceres CLONE 2006582
  misc_feature: Encodes the peptide sequence at SEQ ID NO. 41118
accattacagtacgcactccggctgacgcgccccgcactctctcacaaagctcaagcctttcgctcgctcgctcgctcgcggctacatctacaatggcgcgattccagctcgcggccctggccatggccatgctcttcgccgcggcggcggcgcaggccccagccgccacaccgacgccggcgcccagggtgtcccccccgccggcgactcctccggggaggccggcaccggcgtctgcgcccgcgcacgcccccgccgttcctccgcccgggcccggcagggagcagactccggcacatcatgaccagcgcgacgcgcctagcggagcgtgtaacggcacgcccgcggaggctaggtcgcggccggcgaccacgcccggggcctccgccccgagcaccagcacggggctgtggacacgctgggggagagcggggacccgcgggacgtgatcagcggcgccgccgac

SEQ ID NO: 41118 - protein, 118 aa, Panicum virgatum
  misc_feature: Ceres CLONE 2006582
  misc_feature: Useful for making plants with altered carbohydrate content
MARFQLAALAMAMLFAAAAAQAPAATPTPAPRVSPPPATPPGRPAPASAPAHAPAVPPPGPGREQTPAHHDQRDAPSGACNGTPAEARSRPATTPGASAPSTSTGLWTRWGRAGTRGT

SEQ ID NO: 41119 - DNA, 599 bp, Panicum virgatum
  misc_feature: Ceres CLONE 2006593
  misc_feature: Encodes the peptide sequence at SEQ ID NO. 41120
cacgacccaccacactctccagcacccggcggagcaagcggccagcgagatcgagatccagaggcagcagccatggccaccgtcagcgccgccgcggcgaccaccgtcgttgcccgcgccgccctagggctgccgcagctgagggcgaggagcgagagggtgcggtgcagctactccagggacgccaagagcgcggcggccgccgtgagcgccaggggcgccggcgcgtcgctgctggccgcggcaggcgcggtgaccgcgtcggcggggccggcgctggcgctcgtggacgagaggatgtcgacggagggcaccgggctgagcctggggctcagcaacaacctgctggggtggatcctcctgggggtcttcggcctcatctggtcgctctacaccgtctacacctccgacctcgacgaggacgaggagtccggcggcctctcgctctagatcatgtccatcatccgctcctgttactactgctccggatgtaaacatggcggtggtcatcggtgtaatgtcagacttggctatttaatttgtatctaagcttcgcttttgcgttggatcaaagtgatgacccatggagattacgcgcg

SEQ ID NO: 41120 - protein, 125 aa, Panicum virgatum
  misc_feature: Ceres CLONE 2006593
  misc_feature (1)..(125): Pfam Name: PsbW Pfam Description: Photosystem II reaction centre W protein, PsbW
MATVSAAAATTVVARAALGLPQLRARSERVRCSYSRDAKSAAAAVSARGAGASLLAAAGAVTASAGPALALVDERMSTEGTGLSLGLSNNLLGWILLGVFGLIWSLYTVYTSDLDEDEESGGLSL

SEQ ID NO: 41121 - DNA, 658 bp, Panicum virgatum
  misc_feature: Ceres CLONE 2006597
  misc_feature: Encodes the peptide sequence at SEQ ID NO. 41122
aaaaccagtgcgctgttctttcttgttcccctaaactgatctccccgtctccgtacgctccgcatctcgacctcaccggcggcgggaacacgatggtcgcgttgctgggccggctgatcggggtggcggcggcggtcgccgcgttcatcgccctcgcggcgttcggatccgcctcgccctcgcccaagtccttcgtgaaatccaccgtcgccgcccacgacgtcgtcatcttctccaagtcatactgcccgtattgtaggaaagcaaaggccatatttaaggagtttcagttaaagaaagagccctatgttgtggagcttgatcatcgagaggatggttcggagattcaggatgccttatctgagatagttggcaggcgtactgttcctcaagtttttgtcaatggaaagcatttggggggctctgatgatactgttgaggcttacgaaagtggaaagttggcaaaactcttgaatatcggagtcaaggacgatctttaagaaacatgttagcatcacaagtttatctcttgttttgagttatgaggctgtattatgcgactctgaattggcattatacgaaatatgtaactgaatattgtggcataattcataacatctgaaccctacttttgatatttcctcccttatctcgtatt

SEQ ID NO: 41122 - protein, 135 aa, Panicum virgatum
  misc_feature: Ceres CLONE 2006597
  misc_feature (44)..(108): Pfam Name: Glutaredoxin Pfam Description: Glutaredoxin
  misc_feature: SWISSPROT Homolog: EC 1.11.1.15 Peroxiredoxin
MVALLGRLIGVAAAVAAFIALAAFGSASPSPKSFVKSTVAAHDVVIFSKSYCPYCRKAKAIFKEFQLKKEPYVVELDHREDGSEIQDALSEIVGRRTVPQVFVNGKHLGGSDDTVEAYESGKLAKLLNIGVKDDL

SEQ ID NO: 41123 - DNA, 787 bp, Panicum virgatum
  misc_feature: Ceres CLONE 2006604
  misc_feature: Encodes the peptide sequence at SEQ ID NO. 41124
aacacacgaaaaaggaacacacattactcttcgaggacgtaaccgacagtctatcaacaatcataaacgtcaagatgtcggacgtagaagagaacaacgccccggaggttcaggaggaggttgaggtttcggccgatgccggcaagggccagatgtcggttctggatgcgctcaagggcgtcctgaagctgtctctgatgcacgacggtctcgcccgcggtctccgcgaggcgtccaaggccctcgaccggaggcaggcgcacatgtgcgtgctcaacgagtcgtgcgaggaggaggcctacaagaagctcgtcatcgccctctgctccgagcacaagatcccgcttatcaaggtgcctgacggcaagcagctcggcgagtgggctggtctctgcgttctcgaccgtgagggtaacgcccgcaaggtcgtcaactgctcttgcgtcgtcgtcaaggactggggtgaggagtcgcaggagcgctccatcctcctcaactacttctcgtctgaggcttaagcgaaccaagcacgggcgagggtagtggcatttcgcgaggaaagaaggagaatggggatatcatagagggatttggagaagggttcacctctcgggccacggtccgatgacatcttcctcgggtgtgctctggttctcaccggctggctaaaaggatggcgggacatctgggagccccttcacgcggctacccttcgcatacggcatgggaaactgagcaagacaaaataaaaaagaagcctcacaactggccattccggttgtcaccc

SEQ ID NO: 41124 - protein, 147 aa, Panicum virgatum
  misc_feature: Ceres CLONE 2006604
  misc_feature (31)..(126): Pfam Name: Ribosomal_L7Ae Pfam Description: Ribosomal protein L7Ae/L30e/S12e/Gadd45 family
MSDVEENNAPEVQEEVEVSADAGKGQMSVLDALKGVLKLSLMHDGLARGLREASKALDRRQAHMCVLNESCEEEAYKKLVIALCSEHKIPLIKVPDGKQLGEWAGLCVLDREGNARKVVNCSCVVVKDWGEESQERSILLNYFSSEA

SEQ ID NO: 41125 - DNA, 716 bp, Panicum virgatum
  misc_feature: Ceres CLONE 2006614
  misc_feature: Encodes the peptide sequence at SEQ ID NO. 41126
ggttgcttgcaccaattagggatggaaaaccatgtcgacgaggtaataaggatcggatgatcctctctcactcacctctcgccggccgggtgggcctatatatcaggcacaccccaccacctcccccaggcgcagatcgatcgagcaccccaaacttgcacacaatcaccatcagttctagtagacaagacatgtaataattaagttcaaatcccctcggcgatcgagctcgagtgactcattccaatttccacaaacactgccgatccatctctgtaattgactccgatatttgtgcgcgcagatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacgggggctgaatgataaacgtaccgcctgcatgctggatcaaagctgctagctagcgcctacacccttgatgttccttcctgattgcccttactggtttagcttttagctagtacactagaaaagggaagatctagagatcaaataattgaagctcatcaaatagtatggggaatggagctagctgctgtctag

SEQ ID NO: 41126 - protein, 72 aa, Panicum virgatum
  misc_feature: Ceres CLONE 2006614
  misc_feature (12)..(70): Pfam Name: potato_inhibit Pfam Description: Potato inhibitor I family
MSSVDATGGEKKTSWPEVVGLPAEEAKKIILKDMPDADVVVLPAGSPVTMDWRSNRVRVFVDTVAQTPTGAE

SEQ ID NO: 41127 - DNA, 547 bp, Panicum virgatum
  misc_feature: Ceres CLONE 2006627
  misc_feature: Encodes the peptide sequence at SEQ ID NO. 41128
gaacaaacgctaaaaaagtaacagtttctgtactttattgagcgctcagcatgggtcgcatgtatggtcccggcaagggcatctccggatcgtcccttccttaccgccgcaccccgccggcgtggctgaagctgacgtcgcgcgacttggtgaagacgatcgtcgacctggcgaagaagggtatggcgccgtccatgatcggtctgacgctgcgtgactcgatgggtgttgctcaggtcaaggcggtgacgggccgcaagatcgtgcgcatcctgaaggctcacggccgtggtgcggagctgccggaagacatgttctgcctgatcactcgcgccgtcgcgatgcgcaagcaccttgatcgccaccgcaccgacatcgacacgaagttccgtctgattctggtcgagtcgcgcatccaccgcctggcgcgctactacaagagcgtgcgcaagctgccgcccacgttcaagtacgaggccgccaacgccgcttctctggttgcccagtaagctgacagctctgccgttgccctctctttactgttcag

SEQ ID NO: 41128 - protein, 152 aa, Panicum virgatum
  misc_feature: Ceres CLONE 2006627
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
  misc_feature: Useful for making plants with modulated nitrogen use efficiency
MGRMYGPGKGISGSSLPYRRTPPAWLKLTSRDLVKTIVDLAKKGMAPSMIGLTLRDSMGVAQVKAVTGRKIVRILKAHGRGAELPEDMFCLITRAVAMRKHLDRHRTDIDTKFRLILVESRIHRLARYYKSVRKLPPTFKYEAANAASLVAQ

SEQ ID NO: 41129 - DNA, 593 bp, Panicum virgatum
  misc_feature: Ceres CLONE 2006648
  misc_feature: Encodes the peptide sequence at SEQ ID NO. 41130
ctttctttaccttctgtggtgtctgggaagcaggcgtcaccatgggtcgtttgcacagtaagggcaagggcatcagctcctctgccctcccctacaagcgtagcgcccccagctggtgcaagaccacctcaaccgaggtcactgactccatctgcaagctggctcgtaagggtatgaccccttcccagattggcgttgttctgagggactcgaatggcattccacaggtcacctcagtcactggctccaagatcttgcgcatcctgaagaccaacggcctggcccctgagatcccagaggacctgtatcatcttatcaagaaggcagtgtccatccgtaagcacttggagcgcagccgcaaggacgttgacggcaagttcaggttgattctggtggagtcccgtatccaccgcctggcacgctactacaagcgcgtcaagaagctgcccccaaactggaagtacgagtccgcgacagcttctaccctggtgtcgtaatcgcttaaatgacagcagtcagcgcattggttttgtcttgaggtgccaacctgtgaatgctgggtcagcaaccatgatgtaaatcaatgagtattc

SEQ ID NO: 41130 - protein, 151 aa, Panicum virgatum
  misc_feature: Ceres CLONE 2006648
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
  misc_feature: Useful for making plants with modulated nitrogen use efficiency
MGRLHSKGKGISSSALPYKRSAPSWCKTTSTEVTDSICKLARKGMTPSQIGVVLRDSNGIPQVTSVTGSKILRILKTNGLAPEIPEDLYHLIKKAVSIRKHLERSRKDVDGKFRLILVESRIHRLARYYKRVKKLPPNWKYESATASTLVS

SEQ ID NO: 41131 - DNA, 664 bp, Panicum virgatum
  misc_feature: Ceres CLONE 2006649
  misc_feature: Encodes the peptide sequence at SEQ ID NO. 41132
tatgcactaagaacaggcaagcctttttgggttgtatccgaagacatggaaagggatgtttttatgtcagcagacgaagccaaagcttatggacttgtcgatattgtaggggatgaaatgattgacgagcactgcgatactgatccagtgtggtttccagaaatgtttaaggattggtagtggctggatttcttgtaaatttatttcaaacctaaattcgggttttatgctattttatagaaaatagaaatacttcatgatgatgaatcatcaggttaagatcaatctaaaccaatccattttttctatatacatacgacatgccaacggttaaacaacttattaaaatgcaagacagccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttct

SEQ ID NO: 41132 - protein, 59 aa, Panicum virgatum
  misc_feature: Ceres CLONE 2006649
  misc_feature: SWISSPROT Homolog: EC 3.4.21.92 Endopeptidase Clp
YALRTGKPFWVVSEDMERDVFMSADEAKAYGLVDIVGDEMIDEHCDTDPVWFPEMFKDW

SEQ ID NO: 41133 - DNA, 696 bp, Panicum virgatum
  misc_feature: Ceres CLONE 2006673
  misc_feature: Encodes the peptide sequence at SEQ ID NO. 41134
gcgccatcctcctcttcgttacgtttgatctctagcttcaccgcgaaccagctgcgacgtacgcccgatcgacgacgacacagctagtagcaatggcggcggcgtccaagggcttcctcctgctcgctctcctcgcggcggccgccgtgctcgccaccgccgcggcggagcaacgaacccatgacagaaaggagaagatggcgaacggcgccgccggcgtggagcactggcacggcggtggcggcggccacggcggcgggtcaggtgatgagcacagccacggctgcgagtacggctgctgccgccgcgtataccacggcggctgcaagaagtgctgcccgcctcccggcggccggccggaggtggggaactagcaagacctcgtcctacgctgagcaggatcggagatcgatgcccggcgaggtgttcttcaagttcatactcgttacgtacccaacacgggtgtagcttagtattagcttggttgtgcgtggtagcatccttacgagtgaataacgtgcgacgtgcacgtacggataggcccgtacgtgtatggacgtacgcacacatgtacgtcttcctctccttcctgcctcctgctgctgcggaataactgtgtgtgtgttgtgctgtacctgtactggtactgcggtagcaagagctcatgttggtgcgcttgaaatctcaatgaaactg

SEQ ID NO: 41134 - protein, 93 aa, Panicum virgatum; identical to SEQ ID NO: 41088
  misc_feature: Ceres CLONE 2006673
  misc_feature (1)..(78): Pfam Name: GRP Pfam Description: Glycine rich protein family

SEQ ID NO: 41135 - DNA, 695 bp, Panicum virgatum
  misc_feature: Ceres CLONE 2006705
  misc_feature: Encodes the peptide sequence at SEQ ID NO. 41136
acgctccccacacccacccaatcccgcgacgcacgagagcaaaaaagctagcgctgagctcaggatccatggccgccaccgccgtcgcggcgtctctgtccgtggcccgtggcctcgggaagcctctggtctgcgccggcggcagcagcgcgtcgtcgctccgcctctcgccacgcaggtcggcggccgtcgtcagggcgtccgcgcagcagcagcagcagcagccggccaaggagtgggcggcggcagcggccgtggcagcggcgctggtgctgcccgaggtcgcggaggccgcgtcgccggggatctcgccgtcgctcaagaacttcctcctcagcatcgtctccggcggggtcgtgctcttcgccatcgtcggcgctgtcgtcgccgtctccaacttcgaccccgtcaagcggggctgagcagagctccactgccatggaccatgatcgggcgctttgtcgcttgggctgggtctgggtgtacctacgttctgagtgagactgagggcgagtcgatcgatctcttctcagtgtgattccgaatgaacagtgcttaatgctaaaacctcttgccgtgtaaatctatctcatttcatgctcgcgtaatcccgtatgatctgacagcagcttcagccgcctatactattgatggtctagtatatgacgaatcaacagcgtgtttgcgttgctcgg

SEQ ID NO: 41136 - protein, 117 aa, Panicum virgatum
  misc_feature: Ceres CLONE 2006705
  misc_feature: Useful for making plants with modulated nitrogen use efficiency
MAATAVAASLSVARGLGKPLVCAGGSSASSLRLSPRRSAAVVRASAQQQQQQPAKEWAAAAAVAAALVLPEVAEAASPGISPSLKNFLLSIVSGGVVLFAIVGAVVAVSNFDPVKRG

SEQ ID NO: 41137 - DNA, 501 bp, Panicum virgatum
  misc_feature: Ceres CLONE 2006706
  misc_feature: Encodes the peptide sequence at SEQ ID NO. 41138
atcataaaaaatgggtcgcgttagaactaagactgtcaagaaggcttctcgtgttgtcattgaaaagtactatcctcgtcttactcttgacttccaagttaacaagaagatcctcgatgaagtctccatcatccaatccaagcgtctccgtaacaagattgctggtttcactactcacttgatgaagcgtatttctcgtggtcccgttcgtggtatttctttcaagttgcaagaagaagaacgtgaacgtcgtgataactacgtccccgaattctctgctttggatacctccaacattgaggtcgatcctgagactgaggctttgctcaaggctatcaactttgagaacctccccggtgttaaggttactgctcccgttgctgctttcgctcctcgcaacaacaaccgtggtcctcgtggtccccgtaaggctgctgaggcccaggcttaaattcctgtctagttgcttatttaaataaaaattgcagttaataaaacatc

SEQ ID NO: 41138 - protein, 146 aa, Panicum virgatum
  misc_feature: Ceres CLONE 2006706
  misc_feature (1)..(122): Pfam Name: Ribosomal_S17e Pfam Description: Ribosomal S17
MGRVRTKTVKKASRVVIEKYYPRLTLDFQVNKKILDEVSIIQSKRLRNKIAGFTTHLMKRISRGPVRGISFKLQEEERERRDNYVPEFSALDTSNIEVDPETEALLKAINFENLPGVKVTAPVAAFAPRNNNRGPRGPRKAAEAQA

SEQ ID NO: 41139 - DNA, 696 bp, Panicum virgatum
  misc_feature: Ceres CLONE 2006741
  misc_feature: Encodes the peptide sequence at SEQ ID NO. 41140
acaggcacttagcactaatcgatttatttctgctttaatttgtgcgtgtggtccgcagagcaaaatggcagggaaggcctcggtcgcgctgttcctggccgtcaacctggtcgtgttcgccatggccagcgccggctgcggtggcgactgccccacgccgtcgaccccgtcgaccccgtcgactcctaccccgacgtcggcctccaaaggcaagtgcccccgcgacgcgctgaagctgggcgtgtgcgccaacgtgctgggcctcatcaaggccaaggtcggcgtgccgcccgcggagccctgctgcccgctgttggaggggctcgtcgacctagaggccgccgtgtgcctctgcaccgccatcaagggcaacatcctcggcatcaacctgaacctgcccatcgatctcagcctcatcctcaactactgcggcaagaccgtgcccactggcttcaagtgcctctaagctaccagacgcataggcatatatgcatccatcgtggtttggtttgctatgtgtgtgctatatataaatgctggctatcggaagcttgaatgcattgtggagaggcaaaggacgtgcgcacacatgcgttcgatttgcttctgttgttccgttgtcttatttattctcgcatgtccctctccgagctatgtgggttattgttcatttgcatttgcaactggattgtatgg

SEQ ID NO: 41140 - protein, 133 aa, Panicum virgatum
  misc_feature: Ceres CLONE 2006741
  misc_feature (51)..(132): Pfam Name: Tryp_alpha_amyl Pfam Description: Protease inhibitor/seed storage/LTP family
  misc_feature: Useful for making plants with modulated oxidative stress sensitivity
  misc_feature: Useful for making plants with modulated biomass
  misc_feature: Useful for making plants with modulated flowering time
  misc_feature: Useful for making plants with modulated salt sensitivity
MAGKASVALFLAVNLVVFAMASAGCGGDCPTPSTPSTPSTPTPTSASKGKCPRDALKLGVCANVLGLIKAKVGVPPAEPCCPLLEGLVDLEAAVCLCTAIKGNILGINLNLPIDLSLILNYCGKTVPTGFKCL

SEQ ID NO: 41141 - DNA, 201 bp, Panicum virgatum
  misc_feature: Ceres CLONE 2006743
  misc_feature: Encodes the peptide sequence at SEQ ID NO. 41142
gagaagcaaaaccatggcgtcgtccaaagcgctcctagggcttgcgctcctgctcactgctgccttccttgtcgcctcagctaataacaagcacacccagccaaaggaggaggagaacaagcaggcccgcgtgcaggactaccacggcggcggccaccccggcggaggctggcgcgagggaggctaccctggccacagcgg

SEQ ID NO: 41142 - protein, 62 aa, Panicum virgatum
  misc_feature: Ceres CLONE 2006743
  misc_feature (1)..(61): Pfam Name: GRP Pfam Description: Glycine rich protein family
MASSKALLGLALLLTAAFLVASANNKHTQPKEEENKQARVQDYHGGGHPGGGWREGGYPGHS

SEQ ID NO: 41143 - DNA, 731 bp, Panicum virgatum
  misc_feature: Ceres CLONE 2006745
  misc_feature: Encodes the peptide sequence at SEQ ID NO. 41144
acaaatcccccgcaacctcccaacgcatcctctcattcaaaccctcgttcctccagcaccaagagaatccgagcggcctcgatggcgcccaaggcggagaagaagccggcggccaagaagcccgcagaggaggagcccgcggagaaggcggctccggcggagaaggcccccgctggcaagaagcccaaggcggagaagcggctcccggcgggcaagtctgccggcaaggagggcggcgacaagaaggggaagaagaaggccaagaagagcgtggagacgtacaagatctacatcttcaaggtcctcaagcaggtgcaccccgacatcggcatctcctccaaggccatgtccatcatgaactccttcatcaacgacatcttcgagaagctcgccgcggaggccgccaagctcgcccgctacaacaagaagcccaccatcacctcccgcgagatccagacctcggtgcgcctcgtcctccccggggagctcgccaagcacgccgtgtcagagggcaccaaggctatggcagcggcgacggtggtggcggcggccaaggtggtggctctggctatggctccggatccggctctgggtatggctctggtggtggacacaactaagctcagattcagaggcaactacagagtatatagctacaaatgtatcatcagtggtgcgtttgtctcatgttatacagaaaactgctttatttgagtgtgtaacactaaaag

SEQ ID NO: 41144 - protein, 210 aa, Panicum virgatum
  misc_feature: Ceres CLONE 2006745
  misc_feature (61)..(131): Pfam Name: Histone Pfam Description: Core histone H2A/H2B/H3/H4
  misc_feature: Useful for biocontainment applications
  misc_feature: Useful for making plants with modulated flowering time
MAPKAEKKPAAKKPAEEEPAEKAAPAEKAPAGKKPKAEKRLPAGKSAGKEGGDKKGKKKAKKSVETYKIYIFKVLKQVHPDIGISSKAMSIMNSFINDIFEKLAAEAAKLARYNKKPTITSREIQTSVRLVLPGELAKHAVSEGTKAMAAATVVAAAKVVALAMAPDPALGMALVVDTTKLRFRGNYRVYSYKCIISGAFVSCYTENCFI

SEQ ID NO: 41145 - DNA, 533 bp, Panicum virgatum
  misc_feature: Ceres CLONE 2006753
  misc_feature: Encodes the peptide sequence at SEQ ID NO. 41146
gatcccgtccgctccgcctcctccgccgccgctgctcgccgtccgtccgtccgtcgatccgagaggaggcaggctgaggccaaccgcatcagggagaagtaccctgacagaatccccgtcattgttgagaaggccgagagaagcgatatccccgacattgacaagaaaaagtaccttgttcctgccgacctcacagttggacagtttgtctatgtggtacggaagcggatcaagctcagtgccgagaaagcaatcttcatcttcgtaaagaacaccctcccgccaacagccgctctgatgtctgccatctacgaggagaacaaggacgaggacgggtttctctacatgacctacagcggcgagaacaccttcgggctgttctaagcccagggcatcgtgaatggccctctggcctcgtcgcaaatgtctcctgtaaatacatatctgaagaacctgtgtacataatccggtccgcctttgtcgccagcagctcttaagctgtgctctgctgttaaaaaagtcctttgaagcgt

SEQ ID NO: 41146 - protein, 127 aa, Panicum virgatum
  misc_feature: Ceres CLONE 2006753
  misc_feature (22)..(125): Pfam Name: MAP1_LC3 Pfam Description: Microtubule associated protein 1A/1B, light chain 3
  misc_feature: Useful for making plants with modulated nitrogen use efficiency
DPVRSASSAAAARRPSVRRSERRQAEANRIREKYPDRIPVIVEKAERSDIPDIDKKKYLVPADLTVGQFVYVVRKRIKLSAEKAIFIFVKNTLPPTAALMSAIYEENKDEDGFLYMTYSGENTFGLF

SEQ ID NO: 41147 - DNA, 616 bp, Panicum virgatum
  misc_feature: Ceres CLONE 2006782
  misc_feature: Encodes the peptide sequence at SEQ ID NO. 41148
acgccgcagttccccgggaggaccgtcacgctcgagcaccagcccggagcgacttgctggggaattgcctacaaaataaaggaggaggataagcagacagctttggagtatctagaagtcagagagaagcagtatgatgagaagattcaccttgatttgtatacggattcatcacctaaagtaccagcggtagaacatgtgacagtatacttagccacaacgaataaggagagcaacaaaaactatcttggtcctgcacctctggaagaaatggccaggcaaatttaccttgcggaaggcccttctggacctaacaaagagtatgtattcaaacttgaggatgccttaaacaaactaggatttgtagacccacatgtccaagaactggcgaatgctgtgcgtgagtattcagatgccaagtccaagtaaaaaaatcacatttcccctttcttttgagggtagaagatttcggaagaaagtcaaaatttattcatgctcaaacatcgctatattcttgtaagctgctagttatatggctatcttgtgactatattcctgtgacatcccgcccgtccatgaatggcgtttgaaagcttactttagagattacagaagc

SEQ ID NO: 41148 - protein, 142 aa, Panicum virgatum
  misc_feature: Ceres CLONE 2006782
  misc_feature (1)..(136): Pfam Name: ChaC Pfam Description: ChaC-like protein
  misc_feature: Useful for making plants with modulated nitrogen use efficiency
TPQFPGRTVTLEHQPGATCWGIAYKIKEEDKQTALEYLEVREKQYDEKIHLDLYTDSSPKVPAVEHVTVYLATTNKESNKNYLGPAPLEEMARQIYLAEGPSGPNKEYVFKLEDALNKLGFVDPHVQELANAVREYSDAKSK

SEQ ID NO: 41149 - DNA, 633 bp, Panicum virgatum
  misc_feature: Ceres CLONE 2006792
  misc_feature: Encodes the peptide sequence at SEQ ID NO. 41150
tccaaggttaatatggaaattctttcagaggttttcccttactttgtccgtgtcaacaaacaattcgaaatacctcgactttttcagaacaggtccgagtcaaatagcaatgattcgaagcacttctttttccattacactatttcggaaacctaaggactcgatcgtatggatatggaaaatacaggatttccgatcctagcgggaaaaggagggaaacggatactcaatttaaagtgagtaaacagaattccatactcgatctcatagatccctatagaattctgtggaaagccgtattcgatgaaagttgtatgtacggcttggagggagatctttcctatctttcgagatccaccctacaatatggggtcaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggtt

SEQ ID NO: 41150 - protein, 60 aa, Panicum virgatum
  misc_feature: Ceres CLONE 2006792
  misc_feature (1)..(60): Pfam Name: Ribosomal_S7 Pfam Description: Ribosomal protein S7p/S5e
MSRRGTAEKRTAKSDPIFRNRLVNMVVNRIMKDGKKSLAYQILYRAVKKIQQKTETNPLL

SEQ ID NO: 41151 - DNA, 660 bp, Panicum virgatum
  misc_feature: Ceres CLONE 2006795
  misc_feature: Encodes the peptide sequence at SEQ ID NO. 41152
gcaaccaacagcaacccatcgttctcgctactagctcactctctactcgcccatcatcgatctagctgcttccttcttcttccctagcagaagagcaagaccatgtcgacggtgagccgtgcatccctcgaccagaagcttgccctcgccaagcgatgctcgcgagaggccaccctcgcaggggctaaggctgcagctgtagccaccatcgcctctgcaattcccacgattgcgagcgtgcggatgctgccatgggcgaaggccaacatcaaccccaccggccaggcactcatcatctccacagtcgccgggatggcctacttcatcgcggccgacaagaagatcctgtcgctggcgaggcgccactcgtacgaggacgcgcccgagcacctcaagaacacctccttccagggcgccggcaggccgcaccctgctttcttcaggccatgatccagctgcaccgctactgttggagttgatgaataaactactttgtcagcaacggcaaatcgttcgacgatgtgcgcagagacttggaccatttagtttgtatcagctgtgctccaaacactgtataatcaagcagtatatcgtcgtaaaaagtattgtacttttgtgtttctcgatcctgaactacgtttttttatccgtataatagat

SEQ ID NO: 41152 - protein, 115 aa, Panicum virgatum
  misc_feature: Ceres CLONE 2006795
  misc_feature (11)..(89): Pfam Name: ENOD93 Pfam Description: Early nodulin 93 ENOD93 protein
MSTVSRASLDQKLALAKRCSREATLAGAKAAAVATIASAIPTIASVRMLPWAKANINPTGQALIISTVAGMAYFIAADKKILSLARRHSYEDAPEHLKNTSFQGAGRPHPAFFRP

SEQ ID NO: 41153 - DNA, 523 bp, Panicum virgatum
  misc_feature: Ceres CLONE 2006797
  misc_feature: Encodes the peptide sequence at SEQ ID NO. 41154
gatctcgctcgggcaccagactctgaaaactgaaaggaaggacgcgaagaagcgggcagcagcggattcgtcaccgtcagtgagtgctaagacaagatggtggccaacggtgacgcacccgccagagggagtgcagcagctgctgcaagcctgcgcaggcgcagaaccacaagcggtgctggtggtggtggaggcggtgccagctcgatgctccagttctacaccgatgaggctgctggtgctaagatgtccccgaacactgttctgatcatgagcattgggttcattgccgttgttgctatgctgcatgtgtttgggaagctgtaccgcaccactaattagtttttgttaccatacccaagaaagcatagtctaccaagagaggaaccttgtagagcagtttaaatgggtagcaaatgaatatcagattctgaaaagattatgctgttatagaagttcatgcaacttgcaatgctaagctgttatggttaaatcatcgccagtcttgtttcgtcattgtcat

SEQ ID NO: 41154 - protein, 81 aa, Panicum virgatum
  misc_feature: Ceres CLONE 2006797
  misc_feature (32)..(77): Pfam Name: Sec61_beta Pfam Description: Sec61beta family
MVANGDAPARGSAAAAASLRRRRTTSGAGGGGGGASSMLQFYTDEAAGAKMSPNTVLIMSIGFIAVVAMLHVFGKLYRTTN

SEQ ID NO: 41155 - DNA, 622 bp, Panicum virgatum
  misc_feature: Ceres CLONE 2006810
  misc_feature: Encodes the peptide sequence at SEQ ID NO. 41156
atctctcctctccggtttgctttgtagaggcagaagcgaacccgagtgagagggaggcggcggaggtaaggcaccagccagcaccaccatgtcgtcggccgcggcaggagagggggagacggtgcgggcgtcgcacatcctcgtcaagcacgagggctcccgccgcaaggcctcctggaaggaccccgaaggccgcgtcatctccgcgaccacccgcgccgacgccgccgcgcgcctcctcgacctccgcaaccagatcctcgccggccaggccaacttcgccgacctcgccgcgcgccactccgactgctcctccgcgcgccgcggcggagacctcggtacctttgggaggagtcagatgcagaaaccctttgaggacgccacctttgcactcaaggttggtgagctcagcgaccttgtggacacagacagtggggttcacatcatcttgcggactgcctgaggagaggcagactctgtcggctttcagttagtgcaaatggctatcaattagggcttgtatttttccccccgttctggcagcctaagtgcgtgacattctggatttctggacaaaagataaagcatgtatcttaacacgtttgccacagcattggagttt

SEQ ID NO: 41156 - protein, 124 aa, Panicum virgatum
  misc_feature: Ceres CLONE 2006810
  misc_feature (16)..(124): Pfam Name: Rotamase Pfam Description: PPIC-type PPIASE domain
  misc_feature: SWISSPROT Homolog: EC 5.2.1.8 Peptidylprolyl isomerase
MSSAAAGEGETVRASHILVKHEGSRRKASWKDPEGRVISATTRADAAARLLDLRNQILAGQANFADLAARHSDCSSARRGGDLGTFGRSQMQKPFEDATFALKVGELSDLVDTDSGVHIILRTA

SEQ ID NO: 41157 - DNA, 670 bp, Panicum virgatum
  misc_feature: Ceres CLONE 2006813
  misc_feature: Encodes the peptide sequence at SEQ ID NO. 41158
atcgtcctagctcccagaactcctcctcagtcctcactaccagcgctgccctctgctcactcgccgtccattcctcttccctctcgagcaagctcgtcagcatgtcgacggtgtcccttgaccagaagcttgccctcgccaagcgctgctcgagagaagccaccctcgctggagccaaggcagcagctgtagccaccgtcgcctccgcgatccccaccctggcgagcgtgcggatgctgccgtggaccaaggccaacatcaaccccaccggccaggccctcatcatctccacagtcgccggcatggcctacttcatcgcggcggacaagaagatactctcgctggcgaggcggcactcgttcgagaacgcccccgagcacctcaggaacacctcctaccagggcaccggccgtccccacccggccttctccaggccctgatcggctcgcaagcacattaaagacccgtgctgccctgcgctctagcctcatctagatatgtataccgtgtgtgtatgcttgctgcaataataagcaggccggcaggtagctgcctgctctaagcttattagcatgggaagcttctgcagtgtggcgtagtctttgaatatatgcgtccatgccgtgtactattactctgtcgcggtaatgaaatactactagttcttgtc

SEQ ID NO: 41158 - protein, 112 aa, Panicum virgatum
  misc_feature: Ceres CLONE 2006813
  misc_feature (8)..(86): Pfam Name: ENOD93 Pfam Description: Early nodulin 93 ENOD93 protein
MSTVSLDQKLALAKRCSREATLAGAKAAAVATVASAIPTLASVRMLPWTKANINPTGQALIISTVAGMAYFIAADKKILSLARRHSFENAPEHLRNTSYQGTGRPHPAFSRP

SEQ ID NO: 41159 - DNA, 697 bp, Panicum virgatum
  misc_feature: Ceres CLONE 2006818
  misc_feature: Encodes the peptide sequence at SEQ ID NO. 41160
ggtgagtcgtcgtgtcgccggcatccatggcggcggtggtgcgcggcgtcctgaggggcatcaaggagaagggcctcgccaacttcctccgcgacgcccgcgaggaaggatacctgaattgcattctggatgggaaccttttgcaaacaaaaattcacaatattggcgcaacacttgtaggggttgacaagtttggaaacaagtactatgagaaactgcaagacactcagcatggaaggcataggtgggtggaatatgcagagaaagatcgttacaatgcatcccaagtgcctcctgaatggcatggatggctgcatcacatcacagataacactggcgatcagctgctggcccggaagactgctcggtaccttgtggagcacaagcagaactactccggtgagggcgaggagctgatctaccactccaaggggcatgcccttaacccggggcagagggactggacgaggtaccagccctgggagccaaagaaagagcaagcctagtaaaatgtcgtgtctgatcggggaggaccaccctgtgttgtgttttcctgctttcttgccttgggccaggtgttgctgagctgaataatcaatcaatcagcgagtgactcgttcggcctcgggtccttggagcgatcctgaataatgttgtactggacgacaatactgtataattcgatcatctttgtttg

SEQ ID NO: 41160 - protein, 159 aa, Panicum virgatum; identical to SEQ ID NO: 14481
  misc_feature: Ceres CLONE 2006818
  misc_feature (48)..(154): Pfam Name: NDUFA12 Pfam Description: NADH ubiquinone oxidoreductase subunit NDUFA12

SEQ ID NO: 41161 - DNA, 546 bp, Panicum virgatum
  misc_feature: Ceres CLONE 2006825
  misc_feature: Encodes the peptide sequence at SEQ ID NO. 41162
ctctgcggctctgcctgctcggatccacctccacctctctccagcgacctctccctctcgcgcccgccgccgccgccgccgtcgccgcgatgggcctcttcgacgcgctctaccgcgtggtgatgcgccgcaacgccgtatacgtcaccttcgtcgtcgccggcgccttcgccggcgagagggcggtggattacggagtccacaagctctgggagatgaacaacgtcgggaaaaggtatgaagatataccagttctggggcaaaggccagctgaagaatgagagcattggagctcagactacccaggatgtcgctttccatgaaattagattccatttaagcaatggtttatcattcctttttgacataataacaaccaatgtaaaatccaaactctttccgggagttgctacccgttcaattactcagcaggctgttggagtttcctgatgcatggttagaacctgttatctagccaggcatcggcatgtttggcatgtttggtcgaaaacttgaaatgccatgaatgagaaatgttttgttggc

SEQ ID NO: 41162 - protein, 63 aa, Panicum virgatum; identical to SEQ ID NO: 13073
  misc_feature: Ceres CLONE 2006825
  misc_feature (4)..(58): Pfam Name: UCR_UQCRX_QCR9 Pfam Description: Ubiquinol-cytochrome C reductase, UQCRX/QCR9 like

SEQ ID NO: 41163 - DNA, 679 bp, Panicum virgatum
  misc_feature: Ceres CLONE 2006845
  misc_feature: Encodes the peptide sequence at SEQ ID NO. 41164
aacccatcatccatcgccctcacctctcttctctcagtttgcagtgccactcgtcaccggcagcagagctgcttcgtttcctagcgatttaccagccaatctcgcgcttctttgcttaccacacagcatcaacgatgtcgactgtgagccgtgcgtcccttgaccagaagctcgccctcgccaagcgctgctcgcgagaagcgacccttgcaggagctaaggcggcagccgtggccaccatcgcctccgccatcccaacgctggcgagcgtgcggatgctgccgtgggctaaggccaacatcaaccccaccggccaggccctcatcatctccacagttgctgggatggcatacttcatcgccgctgacaagaagattctgtcactggcgagaaggcactcgttcgaggaagctcccgaccacctcaagaacacctcctaccagggtgccggccgcccacacccggctttcttcaggccatgatgaggaatctggcgagatggccctcttggaagttgctgtactctgtgccgtcgatgtccgaataaattaaactactactattagctcgccaatatcatcgatgtaatggtatagtacttcaatgggccactgtaattagtttgtactactgctgctccaattgaaaaggaatgcaacttggtcttacggtactgacc

SEQ ID NO: 41164 - protein, 115 aa, Panicum virgatum
  misc_feature: Ceres CLONE 2006845
  misc_feature (11)..(89): Pfam Name: ENOD93 Pfam Description: Early nodulin 93 ENOD93 protein
MSTVSRASLDQKLALAKRCSREATLAGAKAAAVATIASAIPTLASVRMLPWAKANINPTGQALIISTVAGMAYFIAADKKILSLARRHSFEEAPDHLKNTSYQGAGRPHPAFFRP

SEQ ID NO: 41165 - DNA, 742 bp, Panicum virgatum
  misc_feature: Ceres CLONE 2006853
  misc_feature: Encodes the peptide sequence at SEQ ID NO. 41166
gcgcgcgtctcctctttacattcatcttctgatcagttctcgatcactggctgctgctagcagcctgctgccatagctgcaagacaggcagttccgatccctgtgtctcaagcaaattaattaaacaaaagcaagatcatcatcagttgttaagagactagaaaagcaaccgccaacagagaaagacagatgatggaggggggcatggacgctgcaaggatcatagggtacttgaaggggaagagcatcctcataaccggctctactggctttcttggaaagattcttgtggagaagatcctgcgggtgcagcctcatgtccacaagatgtacctcctggtacgagccatcgacgcgcaggccgccaaacaccgcgtccagcaagaggtgatcggtgcggagctgttcggtctcctgagagaaaagtacggcggcgaggggttcgactcgttgatcgaggacaagattgttcctttggccggagacatcacccgcgaggacctgggcctcgacgcacccacactgcgccacctggccaagaacatggacgtcatcgtcaacatcgctgcaaccaccaacttctacgaaaggtatgacgtgtccttggacgtgaacgtgatgggggtgaagcacctctgccagttcgccaagcagtgcgccaacctcaagatgctcatgcatgtctccacggcttttgtgcgtgcagcttttgtgtccggcgacagcgcggaggcgatcccgg

SEQ ID NO: 41166 - protein, 184 aa, Panicum virgatum
  misc_feature: Ceres CLONE 2006853
  misc_feature (22)..(183): Pfam Name: NAD_binding_4 Pfam Description: Male sterility protein
  misc_feature: SWISSPROT Homolog: EC 1.2.1.31 L-aminoadipate-semialdehyde dehydrogenase
MMEGGMDAARIIGYLKGKSILITGSTGFLGKILVEKILRVQPHVHKMYLLVRAIDAQAAKHRVQQEVIGAELFGLLREKYGGEGFDSLIEDKIVPLAGDITREDLGLDAPTLRHLAKNMDVIVNIAATTNFYERYDVSLDVNVMGVKHLCQFAKQCANLKMLMHVSTAFVRAAFVSGDSAEAIP

SEQ ID NO: 41167 - DNA, 475 bp, Panicum virgatum
  misc_feature: Ceres CLONE 2006854
  misc_feature: Encodes the peptide sequence at SEQ ID NO. 41168
gactctgtcactttgatctaatcatatagaacgatgtcctcctcgtccagcaagatccgagcgttcgagcttcagtccaagaacaagcaggacttgctcactctcttgaacgagctcaagactgagctcgcttctttgcgagtccagaagatcgccggtggatccgccagcaagttgaccaagatcaacactgtccgaaagtccatcgctcgagtcctcaccgtcatcaaccaaaagcagaggcaaaacctccgagagttctacaagaactccaagtacatccccctcgacctccgatacaagaagacccgagctatccgacgacgactcaccttcaaggagaagaccgccatcaccgagaagcaacacaagaaggacatccacttccccgcccgaaagttcgctcttaaggcataagatggttggcttgtctgggtagaggagtctggtgcaggatgcatcggtgtatcatgac

SEQ ID NO: 41168 - protein, 127 aa, Panicum virgatum
  misc_feature: Ceres CLONE 2006854
  misc_feature (10)..(68): Pfam Name: Ribosomal_L29 Pfam Description: Ribosomal L29 protein
MSSSSSKIRAFELQSKNKQDLLTLLNELKTELASLRVQKIAGGSASKLTKINTVRKSIARVLTVINQKQRQNLREFYKNSKYIPLDLRYKKTRAIRRRLTFKEKTAITEKQHKKDIHFPARKFALKA

SEQ ID NO: 41169 - DNA, 489 bp, Panicum virgatum
  misc_feature: Ceres CLONE 2006861
  misc_feature: Encodes the peptide sequence at SEQ ID NO. 41170
gacaaagaccgacaaaatgcctcaggaaatcggcgatatcaagaagttcatcgagatctgccggcggggagacgcctcctctgcccggatcaagaagaacaacaagagccagcagatcaagttcaaggtccgctgccagaggttcctctacaccttggtcctgaaggactcggagaaggccgagaagctcaagcagagcctgccgcccaacctccagatcaaggacgtccccaagaggaacaagcagaaggcgacatgagttaatggatcctgaagggggaatgctggtccggcactgagcgcgggcactggcacgatggaggcacatgcatttgccggttcggcttggactgaactcacaaacggcgtctcggaatggggaatctaggaggaactggtgctttgcttgctatgattagcctcgaaggggcgatgtagttggcgaggttgccagaaatgaatcgcattcatcggctaaggcccaaactc

SEQ ID NO: 41170 - protein, 80 aa, Panicum virgatum
  misc_feature: Ceres CLONE 2006861
  misc_feature (2)..(71): Pfam Name: Ribosomal_L38e Pfam Description: Ribosomal L38e protein family
MPQEIGDIKKFIEICRRGDASSARIKKNNKSQQIKFKVRCQRFLYTLVLKDSEKAEKLKQSLPPNLQIKDVPKRNKQKAT

SEQ ID NO: 41171 - DNA, 575 bp, Panicum virgatum
  misc_feature: Ceres CLONE 2006863
  misc_feature: Encodes the peptide sequence at SEQ ID NO. 41172
ctctttttttgcttctcgaattcagtgcatttaaatatcatggctggtatcactgtcaaggacgttaactctcacgccttcatcaaggcttatgctgcctacctcaagcgtactggtaagctcgaggtccccaagtgggtcgatcttgtcaagaccggtaccttcaaggaactcgctccctatgatcccgattggtactttgtccgtgctgcttccgttgctcgtcacatctacatccgcaagtctgtcggtgttggtgctttgaacaaggttcacggtggtactgtcaaccgtggttctcgtccctctcaccacgtcaacgcttccggttccgtcaaccgtaaggtcctccaatctttggagaagatcggtgtcttggagaaggataagaagggtggccgtaagatcactcaagatggtcaaagagatttggatcgtatcgccatgacccttgccgaagagtctgacgaggagtaaactctttaatttgttttctcgtataaaattttcttcttttttatctcagtttaactttttacaaaaagatgaagaaataaatcaaagacatttacatt

SEQ ID NO: 41172 - protein, 145 aa, Panicum virgatum
  misc_feature: Ceres CLONE 2006863
  misc_feature (4)..(143): Pfam Name: Ribosomal_S19e Pfam Description: Ribosomal protein S19e
MAGITVKDVNSHAFIKAYAAYLKRTGKLEVPKWVDLVKTGTFKELAPYDPDWYFVRAASVARHIYIRKSVGVGALNKVHGGTVNRGSRPSHHVNASGSVNRKVLQSLEKIGVLEKDKKGGRKITQDGQRDLDRIAMTLAEESDEE

SEQ ID NO: 41173 - DNA, 558 bp, Panicum virgatum
  misc_feature: Ceres CLONE 2006866
  misc_feature: Encodes the peptide sequence at SEQ ID NO. 41174
tactggactctgattaattaacccggtttctgttctgatcgagcagggaggagcagctacgcggatcgaaggcgtgccggacggcggctacgcggcctggatggcgcaggagcagctcttcggcgacagcgcggccggcggcggcggcggcggcgcgcgggccagccgggagcggtgggtgccgcagatgatgtacggcggcccggagctggccgtggccggcagcaagcgctccagaaccgccgcggccccggcggcgtactcttactggtgatcccatcgaaccggcggaggacccgcggcggccgactcgccgtcgccgtcgccgtgccgcccgtattaagcaccggctggtgcactagcgtactctactcccagttttaactgtaactgaagttgtttccgggctcatttaccgccacaacttttttttacgctcttccgggcgtcctcgatcggatgaggatgcctgtgagcgttcgtgcctttttgacggggtgctggagggagggaagcctcctcctgcacctctgtatctctcctgttttttgctcggtg

SEQ ID NO: 41174 - protein, 57 aa, Panicum virgatum
  misc_feature: Ceres CLONE 2006866
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
MAQEQLFGDSAAGGGGGGARASRERWVPQMMYGGPELAVAGSKRSRTAAAPAAYSYW

SEQ ID NO: 41175 - DNA, 662 bp, Panicum virgatum
  misc_feature: Ceres CLONE 2006871
  misc_feature: Encodes the peptide sequence at SEQ ID NO. 41176
attcttttttttttttggggacgacgccggcgctattcttgcgagccacgaaagaacgaaacagatccgctgtttttgttttgttcttcctccctccgccgatcggatcgatggcgtccgccgccgccgggtcgtggtcgaagcgttggatccggcccgaggtgtggccgctcttcttcgcgacgggcacggccgtcggcatctgcgggatgcagctcatccgcaacatcaccggcaaccccgaagtcagggttctcaaggagaagagggctgccggcgtgctggagaaccacgaggagggggagaggtactcgcagcacggcttcaggaagttgatcgacggcaggaagcccgagatcatggagtccatcaactcgtggatggcggacccaaagtagatcgatccatctccgtctccatatacaccggcctgcaggtctgctaccggccgacggctgattatttggtcggccgcaaccatttaattcttgattgctattgttaccgtaatggtcttctcgatcggtactttttttttatcaacataaacatgtatctttaacaagaacaaacatgacagcatcatgttgacagcctggctggctgttaacaggcatatccttacaagttttgaattcgaataacttacgtcggtgccgggt

SEQ ID NO: 41176 - protein, 95 aa, Panicum virgatum
  misc_feature: Ceres CLONE 2006871
  misc_feature (10)..(95): Pfam Name: B12D Pfam Description: B12D protein
MASAAAGSWSKRWIRPEVWPLFFATGTAVGICGMQLIRNITGNPEVRVLKEKRAAGVLENHEEGERYSQHGFRKLIDGRKPEIMESINSWMADPK

SEQ ID NO: 41177 - DNA, 691 bp, Panicum virgatum
  misc_feature: Ceres CLONE 2006888
  misc_feature: Encodes the peptide sequence at SEQ ID NO. 41178
gcacagcaccaaccgactaaactgccaccgcccgccactgcacctacaaagacacagaggccgccggccagcctgagcctgttgtcgttccccatggcgcggctcgtgtcgacgccggcggcggtcgcggtggtggtggcggtgctcctcgcggcgtcgccggcggcgctggccgtgcacgactacggcgacgcgctccacaagagcatcctcttcttcgagggccagcggtccgggcggctgccgcccgaccagcgcctccggtggcgccaggactcgggcatccacgacggcgccgaggccggcgtggacctgacgggcgggtactacgacgccggcgacaacgtcaagttcgggttcccgatggcgttcacggcgacgctcatgtcgtgggggctgatcgacttcgggcgcagcttcggcgcgcgcgaggaggcggcggcgcgggaggccgtccggtgggcgacggactacctgatgaaggcgacggcgacgcccggcacggtgtacgtgcaggtgggcgacgcgtcccgcgaccacgcgtgctgggagcggcccgaggacatggacaccccgcgcaccgtgtacaaggtggacgccgcgcacccggggtcggacgtggccgccgagaccgcggcggcgctcgccgcgggctccctggtgttccgcggcgccgacccggcgtacgcgg

SEQ ID NO: 41178 - protein, 199 aa, Panicum virgatum
  misc_feature: Ceres CLONE 2006888
  misc_feature (30)..(199): Pfam Name: Glyco_hydro_9 Pfam Description: Glycosyl hydrolase family 9
  misc_feature: SWISSPROT Homolog: EC 3.2.1.4 Cellulase
  misc_feature: Useful for making plants with altered carbohydrate content
  misc_feature: Useful for making plants with altered cell wall content and/or composition
  misc_feature: Useful for biocontainment applications
  misc_feature: Useful for making plants with modulated nitrogen use efficiency
  misc_feature: Useful for making plants with altered lignin content
MARLVSTPAAVAVVVAVLLAASPAALAVHDYGDALHKSILFFEGQRSGRLPPDQRLRWRQDSGIHDGAEAGVDLTGGYYDAGDNVKFGFPMAFTATLMSWGLIDFGRSFGAREEAAAREAVRWATDYLMKATATPGTVYVQVGDASRDHACWERPEDMDTPRTVYKVDAAHPGSDVAAETAAALAAGSLVFRGADPAYA

SEQ ID NO: 41179 - DNA, 1430 bp, Panicum virgatum
  misc_feature: Ceres CLONE 2006904
  misc_feature: Encodes the peptide sequence at SEQ ID NO. 41180
ggtaacacgacaagtcatcagcccggccggtcgcttgtgacgctaccgtccagtcgaccaggcgcgcgcggcgaggcacgcaagttcaccggcgggcggcggcggctggtcgccgtcagcccgtgaacgcacgccgggccgtgcttcccgatttctatggcggctaaaactggtagcgaaccggtgcaggtggagtcggagggcgagctcgaggcggcggccgtgctgacgccgccgctggcgctggagggcggcctcgcggcggagctccgcccggcgaacctcgcccagcggatgctcagcctcttccgcaacgtcagcccgggatccgacctctcgcacttccagctgccggcgacgttcaacctgcccaagtcgcagctccagatgtacggcgagggcgtgtactgcgccggcgaggacctcctcgggcggtgcgcccggggcaaggacagcctggagcgcctcacggcggtggtggcctggagcatctccacgacgcggccccccatcttcgggttcgcgccctacaacccggtgctcggggagacgcaccacgtgtcccgcggccccctcaacgtcctcctcgagcaggtctcccaccgcccgcccgtctcggcgctgcacgccaccgacgccgccggggacgtgcgcctcgtctggtgccagagccccgtccccaggttccacggcgccagcatcgaggccgcggtgcgcggccgccgggagctgcgcctcgcccgccacgccgagcgctacgagctcgactgccccaacctgctcatccggctcctcccggcgccgtccgtcgagtgggccggcgacgtccgcgtcgtctgcgccgattccgggctcgaggcccagctcagctactgccggacccgctccttcctcggcttcggcggcgacgccaggtgcgtcaggggcaggatcttccgctcggcgtcgcgggacgagacgatctacgaggtcgacgggtcctgggacaggaccgtctcgctcaaggacgtcgccaccggcgaggtctccgtgctgtacgacgcccagcgagccattggtaacctcaccacgccggtcgttcaagaccacaagggcgtggcgccgtcggaatccgccgtggtgtggggcgaggtcagcgacgccctcctgaaggaggactgggagaaagcccggcaggcgaagcggcgggtggaggacgaggcgaggaagctcgccaaggagaggaacgacaaaggggaggtctggacgcccaagcacttctccctgtcgcagaacaagaacggcgagtgggagtgctggcccttggaggagtcggtgccgccggctcccattgtcgtcccttcatgacagtagagagagtacctgacatgtaacaagagttatgcgatcaacctgaatttcatggaaatttgtcactagttcattgtctt

SEQ ID NO: 41180 - protein, 396 aa, Panicum virgatum
  misc_feature: Ceres CLONE 2006904
  misc_feature (9)..(394): Pfam Name: Oxysterol_BP Pfam Description: Oxysterol-binding protein
MAAKTGSEPVQVESEGELEAAAVLTPPLALEGGLAAELRPANLAQRMLSLFRNVSPGSDLSHFQLPATFNLPKSQLQMYGEGVYCAGEDLLGRCARGKDSLERLTAVVAWSISTTRPPIFGFAPYNPVLGETHHVSRGPLNVLLEQVSHRPPVSALHATDAAGDVRLVWCQSPVPRFHGASIEAAVRGRRELRLARHAERYELDCPNLLIRLLPAPSVEWAGDVRVVCADSGLEAQLSYCRTRSFLGFGGDARCVRGRIFRSASRDETIYEVDGSWDRTVSLKDVATGEVSVLYDAQRAIGNLTTPVVQDHKGVAPSESAVVWGEVSDALLKEDWEKARQAKRRVEDEARKLAKERNDKGEVWTPKHFSLSQNKNGEWECWPLEESVPPAPIVVPS

SEQ ID NO: 41181 - DNA, 797 bp, Panicum virgatum
  misc_feature: Ceres CLONE 2006910
  misc_feature: Encodes the peptide sequence at SEQ ID NO. 41182
actttcttcctctccaccctccggccggccggccatgtcctaactcctagccagccacaagcctcacacaggcacccacattgctcaccaccgcagcaacagagcagcaaagaggcgagccatgatcacggcggtggacctgtaccacgtcctcacggccgtggtgccgctgtacgtggccatgacgctcgcctacggctccgtccgctggtggcgcatcttcaccccggaccagtgctccggcatcaaccgcttcgtcgcgctcttcgccgtcccgctcctctccttccacttcatctccaccaacaacccctacgccatgaacctccgcttcctcgccgccgacacgctccagaagctcgtcgtcctcgcgctcctcgccctcgcctcccgctgctggtccctcctcaccctcgactgggccatcacgctcttctccctctccacgctccccaacacgctcgtcatgggcatcccgctgctccggggcatgtacggccccgacgccgccggcacgctcatggtccaggtcgtcgtcctccagtgcatcatctggtacacgctcatgctgttcctcttcgagtaccgcgccgcgcgcgccctcgtcgtcgaccacttccccgacggcgccgccgcctctatcgtctccttccgcgtcgactctgacgtcatctcgctcgcgaagggcgacctggaggccgacgcccaggtcggcggcgacggccgcctgctggtcaccgtgcgcgagtccaccagctcgcgctccgaggccgccggctcccactcccactcgcatt

SEQ ID NO: 41182 - protein, 225 aa, Panicum virgatum
  misc_feature: Ceres CLONE 2006910
  misc_feature (9)..(224): Pfam Name: Mem_trans Pfam Description: Membrane transport protein
MITAVDLYHVLTAVVPLYVAMTLAYGSVRWWRIFTPDQCSGINRFVALFAVPLLSFHFISTNNPYAMNLRFLAADTLQKLVVLALLALASRCWSLLTLDWAITLFSLSTLPNTLVMGIPLLRGMYGPDAAGTLMVQVVVLQCIIWYTLMLFLFEYRAARALVVDHFPDGAAASIVSFRVDSDVISLAKGDLEADAQVGGDGRLLVTVRESTSSRSEAAGSHSHSH

SEQ ID NO: 41183 - DNA, 478 bp, Panicum virgatum
  misc_feature: Ceres CLONE 2006916
  misc_feature: Encodes the peptide sequence at SEQ ID NO. 41184
ttttcactttctgtcaagggtatgacccactctgcaacgatgaccccggctctgaggctgtggctagcatttctggctattggatcctgcatcgctgctgaccacatcgacttgtggccgatgccccacatggtgtcccatggaactcagaacctctgcctcaagaaagatatcacaacgtcaatggtgggaagcccctactctgaccatcactcagccctgaaggaccccttccagaggatggttgatttgatcacactaaaccacgtccgccatggaatgaaccccagttctttggttctcacctgtattaatatagttgtccataccactgaagatgagctccacttcggggccgacgagtcctataacttaacagttccaactgcaggagatccactgcatgcacaaattgaggctcaaaccgtttttggagcacttcatggcttacatacatttgggcagctgtgttactttg

SEQ ID NO: 41184 - protein, 146 aa, Panicum virgatum
  misc_feature: Ceres CLONE 2006916
  misc_feature (37)..(145): Pfam Name: Glyco_hydro_20b Pfam Description: Glycosyl hydrolase family 20, domain 2
  misc_feature: SWISSPROT Homolog: EC 3.2.1.52 Beta-N-acetylhexosaminidase
  misc_feature: Useful for making plants with altered carbohydrate content
MTPALRLWLAFLAIGSCIAADHIDLWPMPHMVSHGTQNLCLKKDITTSMVGSPYSDHHSALKDPFQRMVDLITLNHVRHGMNPSSLVLTCINIVVHTTEDELHFGADESYNLTVPTAGDPLHAQIEAQTVFGALHGLHTFGQLCYF

SEQ ID NO: 41185 - DNA, 1112 bp, Panicum virgatum
  misc_feature: Ceres CLONE 2006928
  misc_feature: Encodes the peptide sequence at SEQ ID NO. 41186
gacccagttccccacttttttctggcgaaccctgcacgcttccgccaccgcgtcggcgaccgcgatcccactagacccgacccccgacctcctcggcgtcgtgtatgcgcgtacgccggccgtgatcggatcggcgaaaggcaaagcccatggcggagccgacccttctcgcgccggccgcgccggactccttcggggacttctctttcgccgaatttcaggcgcctgttgatggcgccaatttcgccttcgaggacttcgatctggaggatctcgacctcgacgtggacttcgacctcgacctcttcgcctcggatgggccgctctcgcagccgccgccgctcgcgacctcatcttcctcggccgggtctccggaggggggatcgtcctcttccggcgccggcggggacggcgggttgaggaacgaggagccctcggaatcgtcttcgaggagcgcgatcggtacagatggcagcggtaaggggaaggcggaggacgacgaggcgaagcggcgcgcgcggctggtgcgcaaccgcgagagcgcgcacctgtcgcggcagaggaagaaacagtatgtggaagagctggagggtaaggtgaaggccatgcaggccaccatcgccgacctctccgccaggatttcctgcgtcaccgccgagaacgccgttctcaagcagcagttgggtggtgccgccggaaccgccccgccgccgccgccgctgccgatgtaccccgcggtgtaccctttgccgatgccgtggatgcatccagcgtacgccatgcgtggatcgcaggtaccactcgtgccaattcctcgcctgaaaccccagcagcctgcgcctgctacagcagagccaccggccaagaaggctaggaagaccaagaaggttgcaagtgttagcctcctggggttgctgtgcctcgtgatgctttgtgggtgtctgattcctgcagtaaatcggatgtatggcccatttgatggcggagaaggtgctgcatttggtccatctcatcatgggaaggtgctggctgttgaggggcctcgtgatactgtctcggatagtattgatcagaagccaccgcagagaacaagcgaggcacttccagcactg

SEQ ID NO: 41186 - protein, 320 aa, Panicum virgatum
  misc_feature: Ceres CLONE 2006928
  misc_feature (116)..(179): Pfam Name: bZIP_1 Pfam Description: bZIP transcription factor
MAEPTLLAPAAPDSFGDFSFAEFQAPVDGANFAFEDFDLEDLDLDVDFDLDLFASDGPLSQPPPLATSSSSAGSPEGGSSSSGAGGDGGLRNEEPSESSSRSAIGTDGSGKGKAEDDEAKRRARLVRNRESAHLSRQRKKQYVEELEGKVKAMQATIADLSARISCVTAENAVLKQQLGGAAGTAPPPPPLPMYPAVYPLPMPWMHPAYAMRGSQVPLVPIPRLKPQQPAPATAEPPAKKARKTKKVASVSLLGLLCLVMLCGCLIPAVNRMYGPFDGGEGAAFGPSHHGKVLAVEGPRDTVSDSIDQKPPQRTSEALPA

SEQ ID NO: 41187 - DNA, 1373 bp, Panicum virgatum
  misc_feature: Ceres CLONE 2006936
  misc_feature: Encodes the peptide sequence at SEQ ID NO. 41188
gccaggaaccggatcggaatggtcgtccctcccgccgccgcgccgcgccgcggatgcgatgccgccgccgccgcgcctgccgtcgctagcagccctagtcacccgccaccctcaccaactacccgcctccgcctccgcctccgcctcctatccctcagcctccacgctccctgcctaccgcgcgctcatccgcgacctcttctccgccggccgtctcgacgacgtcgacgccgccctcgactccgcgcgctcccgcctcgccccaggctccctccaaccgctctacgtgacctgcatccaagcctacgcccgcgccggccgcctccgtgccgccgtcgacaccttcgagcgcatggacctcttcggcagtccgcccgccaccccagcctacaacgccatcatggacgccctcgtcaacgccgcctaccacgaccaagctcacaaggtctacgtcaggatgctagccgccggcgttcctcccgacgcccgcacccacaccgtccgcctcaaatccttctgcctcaccggccgcccgcacgtcgcgctgcgcctgctgcgcaccttgccggagcgtgggtgtgactcccaacccgtcgcctactgcacggtcgtgcgggggttctatgccagcggccacggtcacgatgcacgtcgcctgttcgatgaaatgctcggcagggatgtcttccctgacgttgcctctttcaacaatgttttgcacgctctttgcctcaatggggatatcttcgagtctggggcacttctcgccaaggtcctcaagcgggggatgccggtaaacaagttcacctacaacatatggatccgcgggctctctgaaggcggcaggttgggagaggctgttgcgctcgtggaaaggatggactcccacattttgccagatgttgtcacctacaacacattgatacgtggcctttgtaagtactccaaggtctgggaagctgcacaatatcttcgtaggatgatcaaccggggctgcatcccagatgatttcacctacaacaccatcatcgatggctactgcaagaagggcatgctgcaggaagctactgagcttctgaaagacgctgtctttaaaggttttgtgccggaccgggtcacatactgctcgctgatcaatggactgtgtgctgagggtgatgttgagagggccctggagctctttagtgaggcacaagcaaaagatctgaagcctgaccttgtcgtctacaacacccttgtcaaggggctctgtcgtcagggtctgatcttgcatgccttgcagatcatgaatgagatggtcgaggatggctgccatcctgacatttggacatacaatattatcatcaacggactatgcaaaatggggaaatatt

SEQ ID NO: 41188 - protein, 438 aa, Panicum virgatum
  misc_feature: Ceres CLONE 2006936
  misc_feature (318)..(352): Pfam Name: PPR Pfam Description: PPR repeat
  misc_feature (388)..(422): Pfam Name: PPR Pfam Description: PPR repeat
  misc_feature (283)..(317): Pfam Name: PPR Pfam Description: PPR repeat
  misc_feature (353)..(387): Pfam Name: PPR Pfam Description: PPR repeat
  misc_feature (179)..(213): Pfam Name: PPR Pfam Description: PPR repeat
  misc_feature (109)..(143): Pfam Name: PPR Pfam Description: PPR repeat
  misc_feature (249)..(282): Pfam Name: PPR Pfam Description: PPR repeat
MPPPPRLPSLAALVTRHPHQLPASASASASYPSASTLPAYRALIRDLFSAGRLDDVDAALDSARSRLAPGSLQPLYVTCIQAYARAGRLRAAVDTFERMDLFGSPPATPAYNAIMDALVNAAYHDQAHKVYVRMLAAGVPPDARTHTVRLKSFCLTGRPHVALRLLRTLPERGCDSQPVAYCTVVRGFYASGHGHDARRLFDEMLGRDVFPDVASFNNVLHALCLNGDIFESGALLAKVLKRGMPVNKFTYNIWIRGLSEGGRLGEAVALVERMDSHILPDVVTYNTLIRGLCKYSKVWEAAQYLRRMINRGCIPDDFTYNTIIDGYCKKGMLQEATELLKDAVFKGFVPDRVTYCSLINGLCAEGDVERALELFSEAQAKDLKPDLVVYNTLVKGLCRQGLILHALQIMNEMVEDGCHPDIWTYNIIINGLCKMGKY

SEQ ID NO: 41189 - DNA, 257 bp, Panicum virgatum
  misc_feature: Ceres CLONE 2006936-R
cttatgtcatgccagcagaaaaaagaaagaatgctcaaaggaagagagcaccacatactgtcaaccatcacaactcacctaccaaacgtatgccttcaccaataaaatattggggtagacaaatgcaacatgctatgcaattgtttttgtgcattagtggtattcactgcatgatgcaactgatttagactactcagcttcctcaaccaatattgatgatactgatgatggaattgcctccaacaccccccccctcc

SEQ ID NO: 41190 - DNA, 733 bp, Panicum virgatum
  misc_feature: Ceres CLONE 2006957
  misc_feature: Encodes the peptide sequence at SEQ ID NO. 41191
gcttccgaggagagcgtagactacacaaaccacaccacctacttctaccatgggtaaggagaagactcacatcaacctcgtcgtgatcggccacgtcgatgccggcaagtcgaccaccaccggccacttgatctacaagtgcggcggtattgacaagcgtaccatcgagaagttcgaggctgaggccaaggagatgggcaagggctccttcaagtacgcctgggtgctcgacaagctgaaggccgagcgcgagcgtggtatcaccatcgacattgccctctggaagttcgagactgccaagtactacttcaccatcatcgatgcccccggtcaccgtgacttcatcaagaacatgatcactggtacctctcaggctgatgtggccatcctcgtgattgcctccggtgagggtgagttcgaggccggtatctcgaagaacggtcagacccgtgagcacgcccttcttgccttcaccctcggtgtgaagcagatgatcgtggtctgcaacaagatggacaacgtcaactggtccgaggatcgttacaacgagatccagcgtgaggtgtctggctacctgaagaaggtcggctacaacccccagaacattcccttcgtccccatctcgggcttccacggtgacaacatggtggacaagaccgacaagatgccctggtacaagggacccacgctccttgaggccctcgacgccatcaagccccccagcgccccatcg

SEQ ID NO: 41191 - protein, 227 aa, Panicum virgatum
  misc_feature: Ceres CLONE 2006957
  misc_feature (5)..(223): Pfam Name: GTP_EFTU Pfam Description: Elongation factor Tu GTP binding domain
  misc_feature: SWISSPROT Homolog: EC 2.7.7.4 Sulfate adenylyltransferase
MGKEKTHINLVVIGHVDAGKSTTTGHLIYKCGGIDKRTIEKFEAEAKEMGKGSFKYAWVLDKLKAERERGITIDIALWKFETAKYYFTIIDAPGHRDFIKNMITGTSQADVAILVIASGEGEFEAGISKNGQTREHALLAFTLGVKQMIVVCNKMDNVNWSEDRYNEIQREVSGYLKKVGYNPQNIPFVPISGFHGDNMVDKTDKMPWYKGPTLLEALDAIKPPSAP

SEQ ID NO: 41192 - DNA, 684 bp, Panicum virgatum
  misc_feature: Ceres CLONE 2006959
  misc_feature: Encodes the peptide sequence at SEQ ID NO. 41193
gagcgaattcaattctcatgggggaagcgtagagcaaagggtggtgttaagatggatacacggttttacgagtccttcacattggataatgtgaaatattcactgtatgactgtgtctacttgtttaagcatggtgatcctgaaccatacattggaaaaatagtgaagatttgggagcaaaatcaggctaagaaagtaaaaattctttggtttttctttcctgatgagattcagaaatatttaagaggctctgtgatggaaaatgagatttttcttgcttctggtgatggtattgggcttgcagatgtcaacccactggaagctgttgctggaaaatgcactgttatatgcatttcaaaggatgagagaaatcgccaaccttcccctcgggaacaagcaatggctgattatatcttctatagggtcttcaatgttgaaaactgcaccctttctgatcagttgcctgataaaattgctgggttgggagtcgaggttctgctgaatccaaaagatgagttagtcatatccagtcctaacgcactgaatccaaatgctgatgatggtctggctgctacagcccctcctccccattcagcagttaaagaggagaatgaaagtccagatgctgcagttccactttcccagccagcagctaaggaggtggatgcaaagtcgcctgccgca

SEQ ID NO: 41193 - protein, 227 aa, Panicum virgatum
  misc_feature: Ceres CLONE 2006959
  misc_feature (31)..(155): Pfam Name: BAH Pfam Description: BAH domain
ERIQFSWGKRRAKGGVKMDTRFYESFTLDNVKYSLYDCVYLFKHGDPEPYIGKIVKIWEQNQAKKVKILWFFFPDEIQKYLRGSVMENEIFLASGDGIGLADVNPLEAVAGKCTVICISKDERNRQPSPREQAMADYIFYRVFNVENCTLSDQLPDKIAGLGVEVLLNPKDELVISSPNALNPNADDGLAATAPPPHSAVKEENESPDAAVPLSQPAAKEVDAKSPA

SEQ ID NO: 41194 - DNA, 278 bp, Panicum virgatum
  misc_feature: Ceres CLONE 2006964
  misc_feature: Encodes the peptide sequence at SEQ ID NO. 41195
cacagtggtcctaggtgggaagctaaggatgcatgtctccgcgggtctccagtactctcacgccacggccgagatgtggcagagcgtgattgtgaattgcaaggagggcggcgcggatgtgatcatgacatatatcttttcgaatgggcatgatctttccaaaggacattatcacgttgagggaatgtttgattttgtcaagtttgcgaatctgggtgctgctgatggtctatttctttttctgcgtatcggcccataagcttgagctgagtggaatt

SEQ ID NO: 41195 - protein, 85 aa, Panicum virgatum
  misc_feature: Ceres CLONE 2006964
  misc_feature: SWISSPROT Homolog: EC 3.2.1.23 Beta-galactosidase
  misc_feature: Useful for making plants with altered carbohydrate content
  misc_feature: Useful for making plants with altered cell wall content and/or composition
TVVLGGKLRMHVSAGLQYSHATAEMWQSVIVNCKEGGADVIMTYIFSNGHDLSKGHYHVEGMFDFVKFANLGAADGLFLFLRIGP

SEQ ID NO: 41196 - DNA, 663 bp, Panicum virgatum
  misc_feature: Ceres CLONE 2006982
  misc_feature: Encodes the peptide sequence at SEQ ID NO. 41197
gcacggcttccacccctccggcacagcacgcaagtacagcacaccaccagtcgaccagcgatagcgatcgcgtcgcactcgcacgcccctccgcggcatccgcagatcagatccccgcggcgtccatggccgggaacttcgagctccagggtcggcacggcaagtcccgcgtccgcgtctcccgcgtctggcgccgccccgccgcggcggggggccacgtcatcgtcgagtggagcgtcgccgtcagcgtcgtctccgactgcctcccctcctacacctccagcgacaactccgccatcgtcgccaccgattccatcaagaacaccgtttatgtcaaggcgaaggagtgcacggaagtggtgtccatggaggaattcgccgtgattcttgggaggcatttcacctccttgtaccctcaggtctcagaggctacggtgaccatcgtggagcgcccatgggagcgtgtggttgtcgacggaaagcctcattcgcacggtgagcaagattatcggttatccacttatccttgctgtcgtgattcgagatgaggaagagccttgaacgtctggataatgaatgtggtgtttctaaaaaaaactcgacctgcggggggcaagctgcccccgcggcattaaattaagaagaagacctcacacacacaga

SEQ ID NO: 41197 - protein, 140 aa, Panicum virgatum
  misc_feature: Ceres CLONE 2006982
  misc_feature (8)..(135): Pfam Name: Uricase Pfam Description: Uricase
  misc_feature: SWISSPROT Homolog: EC 1.7.3.3 Urate oxidase
MAGNFELQGRHGKSRVRVSRVWRRPAAAGGHVIVEWSVAVSVVSDCLPSYTSSDNSAIVATDSIKNTVYVKAKECTEVVSMEEFAVILGRHFTSLYPQVSEATVTIVERPWERVVVDGKPHSHGEQDYRLSTYPCCRDSR

SEQ ID NO: 41198 - DNA, 1832 bp, Panicum virgatum
  misc_feature: Ceres CLONE 2006985
  misc_feature: Encodes the peptide sequence at SEQ ID NO. 41199
cgaagttctccgcgccgcgcccaggctgctcttcctcacctcctgccgtcctgcgcgctccgccggcgctggaaagcgcggatccaccccgactccgactggtttctctctagctttggtttcaggatctcttgtagtcttctagatgactcgagcttctactattgattttggaaggaagaagcagagcgaactccttgggtcaggaccactgcgtccagtaaacatcatcagaaataaattccctaccttcaagaatggttcaaatgggatcattattaaattggtggatagcccagaaataccaactcttaaggaggctgttgccaaggagacaacggatctgcttgataagcatcagcgcctttcagtccgtgagctcaccatgaaatttgagaagggttttaatacagcaaccttgttatctaatgaggtgaaatggagacatgcggctttattggagcgagacatccttttgaagaatctaaaaagtgtactggagtcgctaagaagtcgagtagcaggcaaaaatagggatgaaattgaggaatctctatctatggtggatattttagcagttcagctgtccaaaagagaagatgagttacttcagcagaaagccgaggtcacaaaaatagcagcctcattgaaactggcttctgaagatgcaaagagaattattgatgaagaaagagctaatgctcggttggagatagaaaatgctaaaggtgctgcacagagagttcgattagcgcttaaagagcaagaaaatgtatctcaaggaattgggaagcagggtgtggatgaactgaaggaggaagtccaagaagcaaggagagtgaaaatgctgcattgtccaagcaaggcaatggacattggaaacgagattcaagttctccgtgatcaacttgctgaaaaatcctcagattctgttcaccttttaaaagagttggagctgcaccgacgatttgaggaaaatgatacgtccttgtatgagttagagggtcttgaaaccttaggttcaatgttgcacatagttgttcgggacaatccatcagtagatttttcaaatgcttcagtccagtggtttcgcatacagcctgaaggaagcaataaagaaatcatttcaggtgccacaaagccagtgtatgctccagaacctcatgatgttggacggtacatccaagctgaaatcaaatttggtggtcaaatctcaatcacaaagactgctggtccagtagaccctgctgcaggattggccgattatgtggaggctcttatgaggaatcctgaaactgagtataatgttgttgttcttcaattgaatggagttgctcagccggcagattctcttcatgttctttgcattgggagactgcggatgagacttgctaaaggaacatcggtcgttgccagggaattctattcctcgtcgatgcagctgtgtggtgttagaggcggtggagatgccgccccgcaagcaatcttttggcaaccgacaaaggagctcagctttgtgctggccttcgagacaaccagggaacgcaactctgcactcatgctcgcccggagattcgccacggattgcaatatcatccttgctgggccaggagacaaaactcagtggtaacgagcagcccgctctaacagcttcccggaatgtacatccctgcacatgcagtagttagatttctgatctgatctctgagtagttgattctttgagtctttagccactagttgcattgtacttgctggctccagctaccagcgctgtgtattatttctgcaactgaactcgtagtaccataaatctgaacgtgttttcactgc

SEQ ID NO: 41199 - protein, 494 aa, Panicum virgatum
  misc_feature: Ceres CLONE 2006985
  misc_feature: Useful for making plants with altered alkaloid content
  misc_feature: Useful for making plants with altered terpenoid content
MTRASTIDFGRKKQSELLGSGPLRPVNIIRNKFPTFKNGSNGIIIKLVDSPEIPTLKEAVAKETTDLLDKHQRLSVRELTMKFEKGFNTATLLSNEVKWRHAALLERDILLKNLKSVLESLRSRVAGKNRDEIEESLSMVDILAVQLSKREDELLQQKAEVTKIAASLKLASEDAKRIIDEERANARLEIENAKGAAQRVRLALKEQENVSQGIGKQGVDELKEEVQEARRVKMLHCPSKAMDIGNEIQVLRDQLAEKSSDSVHLLKELELHRRFEENDTSLYELEGLETLGSMLHIVVRDNPSVDFSNASVQWFRIQPEGSNKEIISGATKPVYAPEPHDVGRYIQAEIKFGGQISITKTAGPVDPAAGLADYVEALMRNPETEYNVVVLQLNGVAQPADSLHVLCIGRLRMRLAKGTSVVAREFYSSSMQLCGVRGGGDAAPQAIFWQPTKELSFVLAFETTRERNSALMLARRFATDCNIILAGPGDKTQW

SEQ ID NO: 41200 - DNA, 473 bp, Panicum virgatum
  misc_feature: Ceres CLONE 2006996
  misc_feature: Encodes the peptide sequence at SEQ ID NO. 41201
attaattttccgcgctgcgcttgtacacatctatccagctgagctcatctggatggtgtacgtctcttttgctggtctcgttgatggccgtcaccgccgcggcggtgctcctccagtacctcccgctgatgcgcggcggcctccccaagggcagcttcggctggcccctcatcagcgagaccatcgaattcctccacacaaacccgtccaacacctccggcagcttccacaaggagcacatcgccaggaacgggactgtgttcaagatcgcacctcttcggatcgccagcgatggtctcctgcgactaggagatcatccacttcatgctgctcaacgaggagcgcctgtacgagtgtaactaccccggcgccatccgcaacatcctcgggcagtcctccacgatggtggtcaccggcgagcgccaccggctgatccagagcgtgttcctcgccctcgtcgcctccactgggct

SEQ ID NO: 41201 - protein, 91 aa, Panicum virgatum
  misc_feature: Ceres CLONE 2006996
  misc_feature: SWISSPROT Homolog: EC 1.14.13.77 Taxane 13-alpha-hydroxylase
MAVTAAAVLLQYLPLMRGGLPKGSFGWPLISETIEFLHTNPSNTSGSFHKEHIARNGTVFKIAPLRIASDGLLRLGDHPLHAAQRGAPVRV

SEQ ID NO: 41202 - DNA, 542 bp, Panicum virgatum
  misc_feature: Ceres CLONE 2006999
  misc_feature: Encodes the peptide sequence at SEQ ID NO. 41203
acattcttcagcctccgcagccaaccggcccccacgatgctccaccgcgcgctttccggctccggccacgaccgccggccggtcgtcctcgacgtgctcgtcgatacctacaagaagaccgggagggtccgggacggcgccgaggttgtcctgctgatgaaggatctcggcttggcgcccagccttcgctgctgcaacgcgctgcttaaggacctgctgcgcgcggacgccatggatctgctctggaaggtgcgcggcttcatggagggcgccggtcttcgccggatgtgtacacgtactccacattgatcgaggcgtattgcaaagtccgggacttagatgctgcgaagaaggtgcttgaggaaatgcgtgagacgggatgcagcctgaacacagtaacctacaacatattgattgatggtctgtgcagagccggagctgttgaagaggcgtttgggttcaagaaggagatggagatttatgggctggttccagatggatttacttatggtgcaatcattaatggtctgtgcaagcgtgtc

SEQ ID NO: 41203 - protein, 58 aa, Panicum virgatum
  misc_feature: Ceres CLONE 2006999
  misc_feature (11)..(45): Pfam Name: PPR Pfam Description: PPR repeat
MRETGCSLNTVTYNILIDGLCRAGAVEEAFGFKKEMEIYGLVPDGFTYGAIINGLCKR

SEQ ID NO: 41204 - DNA, 321 bp, Panicum virgatum
  misc_feature: Ceres CLONE 2007000
  misc_feature: Encodes the peptide sequence at SEQ ID NO. 41205
accgccgcatcgaggggcggcggcggtggccagaccaatctacagggagcacaggcctggcgcgcgctgggatgggcgcgcaagtgcgcggcgcccttctcctctgtctcctgctcctggcgggggcggtggctcgccccggcgacgcagcgccgcatgaacccaattgcccgttcgcaggcgccggcgcggagggaagagcggcggtgggggtcaactccaactcggggctggtagcgctgctggactcgcactacatcggaactagcagatctggaggataaggcgctgctcctgcaaacgctccaagacgcacgtggg

SEQ ID NO: 41205 - protein, 70 aa, Panicum virgatum
  misc_feature: Ceres CLONE 2007000
  misc_feature: Useful for making plants with altered carbohydrate content
MGAQVRGALLLCLLLLAGAVARPGDAAPHEPNCPFAGAGAEGRAAVGVNSNSGLVALLDSHYIGTSRSGG

SEQ ID NO: 41206 - DNA, 708 bp, Panicum virgatum
  misc_feature: Ceres CLONE 2007005
  misc_feature: Encodes the peptide sequence at SEQ ID NO. 41207
caggatcaaatagttgtgaagaaaaacgtgaagagcaagaaaaatgaacagcccaaagaagataaggactgctttgcaacaaaggctcaaaagggccatgtagtgccaaaaccacttcctagcttcaagggttttgtcatagaagaggaggaagggtctggaggttacgggactgtttacagggctcggaggaaaagagatatatttgctataaaatgtcctcacccaaatgctcatccacaccatgttaacaatgaactaaagatgttggagcgttttggaggcaaaaactgtgtgattaaatatgaatgctctttgaaaagtggtgacctagagtgctttgttctagaacatgttcagcatgaccgaccagagattttaaaaaaggacataggtttgcttgagttgcagtggtatgggtactgtctgttcagagctctcgcaagcttacatagagagtgggtagtgcatagagatgtcaaacctgggaacttcctcttctgtcgcaaagtgatgagggggtatcttattgacttcaacctggcaaatgatctccaccagaagttcttgaaaaactgtaaatctgagacaatttcatgtgggaaggataccacatctcaaactgtatcaaaattcaccccagtagttcatgccacggaagcagctgctgattcaaagcaacctcttcctttgaaagaggaaaagatc

SEQ ID NO: 41207 - protein, 235 aa, Panicum virgatum
  misc_feature: Ceres CLONE 2007005
  misc_feature (45)..(229): Pfam Name: Pkinase Pfam Description: Protein kinase domain
  misc_feature: SWISSPROT Homolog: EC 2.7.11.1 Non-specific serine/threonine protein kinase
QDQIVVKKNVKSKKNEQPKEDKDCFATKAQKGHVVPKPLPSFKGFVIEEEEGSGGYGTVYRARRKRDIFAIKCPHPNAHPHHVNNELKMLERFGGKNCVIKYECSLKSGDLECFVLEHVQHDRPEILKKDIGLLELQWYGYCLFRALASLHREWVVHRDVKPGNFLFCRKVMRGYLIDFNLANDLHQKFLKNCKSETISCGKDTTSQTVSKFTPVVHATEAAADSKQPLPLKEEK

SEQ ID NO: 41208 - DNA, 712 bp, Panicum virgatum
  misc_feature: Ceres CLONE 2007009
  misc_feature: Encodes the peptide sequence at SEQ ID NO. 41209
ttcttgctcatcaccccctcccccaagccaacagcggcgaaggccccagtcagagcagagagagagagagagagagagagagagagagagaggagccttcttcctcctccccggctgccggtggcgagagatcgacgagcgagcgagcgagcgagatggtgctgtcccacggcgtcggcggcggctccgatgagtcggtgcactcgacgttcgcgtcccgctacgtccgcgcctccctccccaggttccggatgccggagcagtcgatcccgaaggaggcggcgtaccagatcatcaacgacgagctgatgctggacgggaacccgcggctgaacctggcgtccttcgtcaccacgtggatggaacccgagtgcgacaagctcatccaggcctccgtcaacaagaactacgtcgacatggacgagtaccccgtcaccaccgagctccagaaccggtgcgtgaacatgatcgctcatctgttcaacgcccctctcggggactccgaaactgccgtcggagtcggcaccgtcggctcctccgaagccatcatgctcgccggactggcgttcaagaggcgttggcagaacaagatgaaggccgccggcaagccctgcgacaagcctaacatcgtcaccggcgccaacgtccaagtttgctgggagaagttcgcgcgctacttcgaggtggagctcaaagaggtgaagctgagcga

SEQ ID NO: 41209 - protein, 185 aa, Panicum virgatum
  misc_feature: Ceres CLONE 2007009
  misc_feature (34)..(185): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
  misc_feature: Useful for making plants with modulated nitrogen use efficiency
MVLSHGVGGGSDESVHSTFASRYVRASLPRFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLS

SEQ ID NO: 41210 - DNA, 693 bp, Panicum virgatum
  misc_feature: Ceres CLONE 2007010
  misc_feature: Encodes the peptide sequence at SEQ ID NO. 41211
actctccggggttcccagccaatggcggcctcctccccttcctccctcgccccgccggcggtgcccatggagctgcacgccggcaaccgcgtccgcctcgtcgccgcgctccgcggccacctctccgcctccgctcgcccgccacgcggcctcgtcctcctccagggcggggaggagcagacgcggtactgcaccgatcacctcgagctcttcaggcaggagagctactttgcctatctctttggagtgcgggagccagggttctacggcgcaatcgacattgcctctggacagtcaattttatttgctccaaggttgccagctgactacgctgtttggatgggtgaaataaaacccctgtcttacttcagggatacatacaaggtcgatatggtcttctatgttgatgagatcacacaggttgtgcaagatcgtttcggggatcatgggaagcctcttctattcctattatatggaaagaatactgactctgggaatttctcaaagcctactagttttgaggggatggagaagtttgatactgatttaagtacacttcatcctattttaactgaatgtcgtgtgatcaaatctgacctggagcttgccgtcatccaatatgctaatgatattagctctgaagctcacattgaggttatgagacaagcaagaccaggcatgaaggaatatcag

SEQ ID NO: 41211 - protein, 223 aa, Panicum virgatum
  misc_feature: Ceres CLONE 2007010
  misc_feature (14)..(158): Pfam Name: AMP_N Pfam Description: Aminopeptidase P, N-terminal domain
MAASSPSSLAPPAVPMELHAGNRVRLVAALRGHLSASARPPRGLVLLQGGEEQTRYCTDHLELFRQESYFAYLFGVREPGFYGAIDIASGQSILFAPRLPADYAVWMGEIKPLSYFRDTYKVDMVFYVDEITQVVQDRFGDHGKPLLFLLYGKNTDSGNFSKPTSFEGMEKFDTDLSTLHPILTECRVIKSDLELAVIQYANDISSEAHIEVMRQARPGMKEY

SEQ ID NO: 41212 - DNA, 1267 bp, Panicum virgatum
  misc_feature: Ceres CLONE 2007017
  misc_feature: Encodes the peptide sequence at SEQ ID NO. 41213
acgacccacttcctcgacccgaccggaccaaccaaaccctcccccgtcccctcacatcccaactcgttcgccggcggcggcaggagcaggagcaggagcagcagccatggcgccggtcgatccccactcctacaccgacggcgcgcacccggtggtgtcgcacgccgcgctcgccttctacctcgacttcgccgcctccaccatccacgcctctgcgctgctcaccctctccgcgccgcactccggcgacctcgtcctcgacacacgcgccctcgccgtccactccgccaccactgccgccgaaccgccggagcccatccccttctccctcgccgcggcccccgaccccgtcctcggctcggcgctgaccctcaccctgccccccgacaccacctccttccggctcaccttctccacctcccccgccgcctccgcgctgcagtggctggccccgccgcagaccgcctccgggcatcccttcgtcttctcgcagtgccagtccatccacgcccgctccatcttcccctgccacgacacccccgccgcgcgcatcaccttctcgcttctcctcaacgtcccctcgcagctctccgccgtcgccgccgcgcgccacgtcgcccgccgggacccgctgccatccgaccaccgcggtgcgtgcgacgacgagctgtggtgcgcacccggacgcatcgtcgaggagttccagatggagcagtccgtgccgccctacctcttcgcgttcgccgccggtgggatcgggttcagggacctcggcccgaggacgcgggtgtacgcggagggaggggacaaggtgctggacgaggcggcgagggagttcgccggggtggaggagatggtcaaggtaggggagtcgctgtttgggccgtatgaatgggagaggttcgatctgctcgtgctgcctccgagcttcccttatggaggcatggagaaccccaggatggtgttccttactccgactgtgatcaagggagacgctgcaggggctcaggttgtggcgcatgagcttgcgcatagctggactggcaatcttattactaacaagaccaatgaagatttctggctaaatgagggattcacaacatatgctgagaggaggattgttgaggtggtgcaaggggaggagcggggcacattaaacatgggaattggatggagggggttgaacagaatgatggagaggtttaaggataacatggagttccccaaattgaagccgaagatggcagggattgaccctgatggatgt

SEQ ID NO: 41213 - protein, 386 aa, Panicum virgatum
  misc_feature: Ceres CLONE 2007017
  misc_feature (16)..(381): Pfam Name: Peptidase_M1 Pfam Description: Peptidase family M1
  misc_feature: SWISSPROT Homolog: EC 3.3.2.6 Leukotriene-A(4) hydrolase
MAPVDPHSYTDGAHPVVSHAALAFYLDFAASTIHASALLTLSAPHSGDLVLDTRALAVHSATTAAEPPEPIPFSLAAAPDPVLGSALTLTLPPDTTSFRLTFSTSPAASALQWLAPPQTASGHPFVFSQCQSIHARSIFPCHDTPAARITFSLLLNVPSQLSAVAAARHVARRDPLPSDHRGACDDELWCAPGRIVEEFQMEQSVPPYLFAFAAGGIGFRDLGPRTRVYAEGGDKVLDEAAREFAGVEEMVKVGESLFGPYEWERFDLLVLPPSFPYGGMENPRMVFLTPTVIKGDAAGAQVVAHELAHSWTGNLITNKTNEDFWLNEGFTTYAERRIVEVVQGEERGTLNMGIGWRGLNRMMERFKDNMEFPKLKPKMAGIDPDG

SEQ ID NO: 41214 - DNA, 1805 bp, Panicum virgatum
  misc_feature: Ceres CLONE 2007022
  misc_feature: Encodes the peptide sequence at SEQ ID NO. 41215
aactaacgctaaaaaagtaacagtttctgtactttattgctaacccaccagtaccgccgtgtcagcggtctctgcctgaggttagtccgaccccgtgtttgtaaagccaaagcatattgcccccaccgggtgactccctccttgtttacacacaggcgccaaccagccattcacagcgaattccatcgtatgcgcgtgcgaagcccccagaacaccatgcgctcaccttccggatacgacgccgacaagaagaagttcttcaaccccattgcacgcaacacgaccaagatcgtgcttggtatcgtggtcgtcgggatcctgttattcctcatgcgatccgacatgaactggaacctgcccgtcggcgcccgcaaggccaactgtgcgctcttcgggaagcgctacggcttgatgctggatgcggggagcaccggcagccgcgtccacgccttcgagttcaactaccacgagaacggcgccgtcgagctcatcgacgagctgttcgagcaggtgaagccgggcctgtccgccttcgcgaacgacccgaagggcgccgcgcagtcgctgaagcctctgctcgacgcggcgatgaagaaggtgcccgcggccgccgcgccgtgcacgccgatcgagctcaaggcgacggccggcctgcgcctcgtcggtcaggagaagagcgaggcgattctcgcggcggtgctcgaactgttcaagcagtacccgttcagcgtcgcggggcccgacgcggccatcgtgatggacggcaaggacgagggcccgtacgcgtggatgactgtgaacttcctgctcgacacgatgaacacgcgcacgacggccaagaccgcggccatcttcgacatgggcggcgccagcacgcagatcgtattccgccccgacgacgatgccgtgatggccgccgtgaccgcggacaagacgtaccaggtgatcacggagggctacagcacgaaactctacacgcactcgcacctcggctacggcctgaagcaggcgaacaagctgatgatgaaggagtcgctcgctgagttcgacaaggtcttcccgtgcttcccgaagggcgtgtcggagaccgccgacggcgtcacggcggagaacgtcgcgggcgagcaaagcttcgagaagtgccagcgcctagccacgcgagtcctcttcaaggacaaggcgtgcagcagcctttcctgcagcttcaacggcgtcgatcagcccgtgctgtcgaagaccttcacgggcccgtactacgtcttctcgtatttctacgaccgcatggcggcgttcctcaacgcggacggcgtcagctccgtcggcgacctccgaaagatggccgagggcgtctgcgccggcgctgccgcgccgtacgcggagcacaacaagggaacgatgtgcatggacttgacgtatttgtacacactgctgcgcaccggctacgacctgcccgacgagacaacgctctacgtgaagaagaagatcaagggcatcgagacggcgtggtcgctgggcgctatgatggtggcgatgaaaccgaagcagtaaccttgctgcactgcgcagaatcggcagcggatggggcgcgtcgcttctcccttctcgccggccgatctgccgcacccctcacccaatacaatcaaagacatgcttcgagtcatcgtgaaaccttgtgcgatggaatgatgttcgtgtaaagctggcatggctataaacccccgctagaccttccgccaccacccttgctcccagcctcaacgccaagcgggcggtgacggttgatgctcgtgtgtaaatcacatctg

SEQ ID NO: 41215 - protein, 443 aa, Panicum virgatum
  misc_feature: Ceres CLONE 2007022
  misc_feature (61)..(443): Pfam Name: GDA1_CD39 Pfam Description: GDA1/CD39 (nucleoside phosphatase) family
  misc_feature: SWISSPROT Homolog: EC 3.6.1.42 Guanosine-diphosphatase
MRSPSGYDADKKKFFNPIARNTTKIVLGIVVVGILLFLMRSDMNWNLPVGARKANCALFGKRYGLMLDAGSTGSRVHAFEFNYHENGAVELIDELFEQVKPGLSAFANDPKGAAQSLKPLLDAAMKKVPAAAAPCTPIELKATAGLRLVGQEKSEAILAAVLELFKQYPFSVAGPDAAIVMDGKDEGPYAWMTVNFLLDTMNTRTTAKTAAIFDMGGASTQIVFRPDDDAVMAAVTADKTYQVITEGYSTKLYTHSHLGYGLKQANKLMMKESLAEFDKVFPCFPKGVSETADGVTAENVAGEQSFEKCQRLATRVLFKDKACSSLSCSFNGVDQPVLSKTFTGPYYVFSYFYDRMAAFLNADGVSSVGDLRKMAEGVCAGAAAPYAEHNKGTMCMDLTYLYTLLRTGYDLPDETTLYVKKKIKGIETAWSLGAMMVAMKPKQ

SEQ ID NO: 41216 - DNA, 1651 bp, Panicum virgatum
  misc_feature: Ceres CLONE 2007031
  misc_feature: Encodes the peptide sequence at SEQ ID NO. 41217
atcacagtgtccttcaacttgcattgatcttccttgacgctagccatcagctcgctctgctagcagctgccatgttttctcttcgtagttgtggtcggcaagtgtgccttgcctcctctactgcccctctgaatatagaccttcaccggtcggtgattgttggctcgtcgtggcagctgaacaaagacaaaggagaggaaccggggaggaggaggaggagccatccaccccacaagcgtcgtcgtgtcttccaccacccatgcggtagaggcgaggcggcggcgcagccgtgcgccgtggtgggtgaccgggtgacggtcctgaccatcgacggtggcggcatccggggcctcatcccgggcacggtgctcgccttcctcgaggcccggctgcaggaccgggacgggccggcggcgaggttggcggactacttcgactacatcgccgggacgagcaccggcgggctcatcacggcgatgctggccacgccggggaaggacgggcgcccgcgcttctccgccgacggtatcaaccccttctacctcaagcacggcccgcgcatcttccctcagaggtggagcagcctcgctgcttgcatcgccgcggcgaggggccccaagtacgacggcgagtacctccgggccttgatccgggagaagcttggcgagaagagggtgctcgacacgctcaccaatgtcgtcatccccaccttcgacgtcaagctgcagcagcctatcatcttctccacatacgacgccaaggtcacgccttcgaagaatgcgctgctatctgatgtctgcatcggcacgtcggcggctccaacctatctcccagcacactacttctgcaccaaagatgccaacagagaacagcgcgaatacaacctcatcgacggtggtgttgcggccaacaatccgacgatggttgccatgacgatgatcacggaagagatcatggccaggaaagaggacgcgcaccagtacctgaccaggacgatggaggagaactgcggccggttcctggtgctgtccatcggcaccggcctgaggtccgaggaggagcagtacaccgcggaggcctgctccaggtggggcatcctcgggtggctgcacaaggggggcatgaagcccatcattgacttcttcatggccgccagctccgacctcgtcgacatccacgtcgccgccaagttcaagctgttccgcagcgagagcaactacctccgcgtccaggacaacacgctcggcggcaccgccgcggcggtggacgtggcgacgccggagaacatggggaacctcgtcgggaccggcgagaacctgctgaggcagcaggtgtcgagggtcaacgtggacaccggcaagtacgaggtggtgccgggtgagaggaccaacgcgcaagctctcgacgacctggcgaagcagctctccgaggagaggaaggcgaggctccggcaagggaaggctgtgccaggccgtggcgtcggtgcggcgcggtagggaatgccgatggctcataaattagttattagtccatcttcttagcttaataatttatttctaaaatattttgatagggtgtgcgtttagatatcgcagaagatgacataggttttgtttgtataccagggttagagttaaatttgaatttttgg

SEQ ID NO: 41217 - protein, 474 aa, Panicum virgatum
  misc_feature: Ceres CLONE 2007031
  misc_feature (84)..(287): Pfam Name: Patatin Pfam Description: Patatin-like phospholipase
  misc_feature: SWISSPROT Homolog: EC 3.1.1.5 Lysophospholipase
  misc_feature: Useful for making plants with modulated heat sensitivity
MFSLRSCGRQVCLASSTAPLNIDLHRSVIVGSSWQLNKDKGEEPGRRRRSHPPHKRRRVFHHPCGRGEAAAQPCAVVGDRVTVLTIDGGGIRGLIPGTVLAFLEARLQDRDGPAARLADYFDYIAGTSTGGLITAMLATPGKDGRPRFSADGINPFYLKHGPRIFPQRWSSLAACIAAARGPKYDGEYLRALIREKLGEKRVLDTLTNVVIPTFDVKLQQPIIFSTYDAKVTPSKNALLSDVCIGTSAAPTYLPAHYFCTKDANREQREYNLIDGGVAANNPTMVAMTMITEEIMARKEDAHQYLTRTMEENCGRFLVLSIGTGLRSEEEQYTAEACSRWGILGWLHKGGMKPIIDFFMAASSDLVDIHVAAKFKLFRSESNYLRVQDNTLGGTAAAVDVATPENMGNLVGTGENLLRQQVSRVNVDTGKYEVVPGERTNAQALDDLAKQLSEERKARLRQGKAVPGRGVGAAR

SEQ ID NO: 41218 - DNA, 1395 bp, Panicum virgatum
  misc_feature: Ceres CLONE 2007035
  misc_feature: Encodes the peptide sequence at SEQ ID NO. 41219
gccagtcgcgagccgcagctccgcgtcgcgtcgcatcccccctccctcgtcgtcttcctcgcccccgccccgcgcccccagctagacacaccgtaccgccaggtgaacccgcgcgcctcccctctcccctcccgcgcccagatcccgaggccccgccccctcgatcgctcgcccccgccggcggatccggctcccgattcgcggggggcccgcggcaggtttttgctttatgctggttcatgtgtccacagacaatggactaattgctgacctgtctctgtgattcaccatgggaagcagtggagctgatacaccgtctaagacaagcaaggcgtctgcctcacaggaacaacagccacctgctacctcaggtgctgcaacaccggctgtttacccagattggtccagcttccaggcatatcctccaatcccaccacatgggttcttcccttcacctgtggcatcaagtccacagggtcatccttacatgtggggagctcaacctatgatcccaccatatggaacaccgccgccgccatatgtcatgtaccctcctggagtatatgctcacccgtctatgcccccgggtgcacatccattcactacttatgctatgacttctccaaatggctatgctgatgctactggaactactgcagcagctggtgatactgacaggaagccctctgaaggcaaagacaaaagtccaacaaaaagatccaaaggtagtttaggtagcttgaacatgcttactgggaagaatcctaccgaacatggtaagacctcaggagcatcagctaatggagccacttctcaaagtggggaaagcggtagtgaaagttcaagtgaagggagcgaaggaaattctcagaatgattcacatcacaaggaaagtggacaggaacaggatggagatgttcgaagttcccagaatggtgcatcacgctcaccatctgagggaaaattgaaccagactatggcaatcatgccaatgccatcaagtggctcagtacctggtccaactacaaacctcaatatagggatggattattgggccaacacagcaagctccgctcctgcaattcatggcaaagtgaccccgacaacagttacaggtgctgtggtcccagccgagcagtggatacaggatgaacgcgaactcaaaaggcaaagaaggaagcagtccaacagggagtcggcacgcagatctaggttgcgtaaacaggctgagtgtgaagagttagctcaacatgctgatgttttaaagcaggaaaatgcttcacttagagatgaagttaaccgtatcagaaaagagtacgaagagcttctatcaaagaataactcactaaaggaaaaaactcgaggcaaacagcacaaaactgatgaggcaggact

SEQ ID NO: 41219 - protein, 368 aa, Panicum virgatum
  misc_feature: Ceres CLONE 2007035
  misc_feature (1)..(197): Pfam Name: MFMR Pfam Description: G-box binding protein MFMR
  misc_feature (288)..(351): Pfam Name: bZIP_1 Pfam Description: bZIP transcription factor
  misc_feature: Useful for biocontainment applications
  misc_feature: Useful for making plants with altered alkaloid content
  misc_feature: Useful for making plants with altered lignin content
  misc_feature: Useful for making plants with altered terpenoid content
  misc_feature: The sequence is a functional homolog of SEQ ID NO 1477 in the 11/479,226 US patent application
  misc_feature: The sequence is a functional homolog of SEQ ID NO 708 in the 10/412,699 US patent application
MGSSGADTPSKTSKASASQEQQPPATSGAATPAVYPDWSSFQAYPPIPPHGFFPSPVASSPQGHPYMWGAQPMIPPYGTPPPPYVMYPPGVYAHPSMPPGAHPFTTYAMTSPNGYADATGTTAAAGDTDRKPSEGKDKSPTKRSKGSLGSLNMLTGKNPTEHGKTSGASANGATSQSGESGSESSSEGSEGNSQNDSHHKESGQEQDGDVRSSQNGASRSPSEGKLNQTMAIMPMPSSGSVPGPTTNLNIGMDYWANTASSAPAIHGKVTPTTVTGAVVPAEQWIQDERELKRQRRKQSNRESARRSRLRKQAECEELAQHADVLKQENASLRDEVNRIRKEYEELLSKNNSLKEKTRGKQHKTDEAG

SEQ ID NO: 41220 - DNA, 686 bp, Panicum virgatum
  misc_feature: Ceres CLONE 2007035-R
ggagatcgtagagaagatgtgctcaaggattggttttcagccaaaggtagctctggtgctacagaagttggagcagcatagcgagtgcaagtcgctgcttttactttccgtgctgctgttggccttatgactccgtttattccatggcacctgaatgattcccctgagtggcagagatcaggactagtgagctcgatgccgttgaaatagagcttctgatgcctgctgctggtcactgtgattgtgtctcctgagtggcgggtgggaactaccgttccatcgggaagccttatgagatcattgaacttcagaggcgccgcgatggaatgcctggacaagaactctagcacctggttttgggagattgatgccgtggacatcagcctgtcgctgggcatcaggaaggtggtgttgcgcggtatcttctcctgcaccatcctgacgagcatgacaaaggtgaagtagcgcgcctgctgcatctcctgcaccgtgttggcgatgtcactgctgactgtctgcggggaaggtatggctgcagtggtggtgctggaagcggacaccatttgagcgatgagcaggctcattgttgcaaggaaggtggatgccgtggtgtaaatgggtaagcaagtcatgactgttgagataactatttgctccctgattctcaagcgggttgctttattacc

SEQ ID NO: 41221 - DNA, 706 bp, Panicum virgatum
  misc_feature: Ceres CLONE 2007052-R
  misc_feature: Encodes the peptide sequence at SEQ ID NO. 41222
attaatcaatcacaggggcgcctccgttattgttggagcaatatctgcctgaatatgttcactttggactttttgaaccaagtggcaaacagccttgaaaaggacagtgtatatcatctagctgagaagaagattccttccatccatgggtatacaacgggcctgaagcttgaacagtttatattcgatgctttcacttactccccatccacagcactttttgaggtcttgcgggaagaggaatttgcaccagtaaagaatgccaacggcgcaacatatgacactcctgatagcgcgaaactcatgctgctccgtctccatagcagatgggttgttgctgcaggcggcttcttgacgcattctgtgcccttgtatatgacaggcgttgaagtttctccactttcctcctacgctggggagaacctggaagccatatgccgtgggcgaacattccatgcgccgagcgagatatcattttagatagggctgttcatgacagcaaaagccgaatgcaaaggattgatgtggatggccaggttgttgtacacttgtatgttttgtgtgttgtgtaacgtagcccttggatttcgaactcatcgcgagttttcccccgcatactttttgtagcgccagctcatggccagggacctgctgatcatagtccctgttcaaaacaggacgaccgtatacatttcacaggctgatc

SEQ ID NO: 41222 - protein, 159 aa, Panicum virgatum
  misc_feature: Ceres CLONE 2007052-R
  misc_feature: SWISSPROT Homolog: EC 2.7.7.23 UDP-N-acetylglucosamine diphosphorylase
INQSQGRLRYCWSNICLNMFTLDFLNQVANSLEKDSVYHLAEKKIPSIHGYTTGLKLEQFIFDAFTYSPSTALFEVLREEEFAPVKNANGATYDTPDSAKLMLLRLHSRWVVAAGGFLTHSVPLYMTGVEVSPLSSYAGENLEAICRGRTFHAPSEISF

SEQ ID NO: 41223 - DNA, 736 bp, Panicum virgatum
  misc_feature: Ceres CLONE 2007052
accggcgatccgagaacaatccgttgtccgagttggcatctttggccaaaccaccagtatcattgcccaatcacagatctccccccctctctctaatctctgtttgcctgtgtttagatccgcaaaaagatagtaaaaagagtcacatcggaacatcggatattgtagcatactatagcacttttcatttgtttgtggtaaatattgtactatcataggctaactaggctcaaaagattcgtctcgcaacgtacatcaaaactatacaattagttttttttatttacccacattcagtactctatgcatgaaacaataaatttgatgtaatagaagaacagtgaagtttggagaaaaagattttgtaactaaacacacagccctttctcgccttctccctctcatctcccactacctgctcccgctgctttgcttgtgcgctgcgaggggagagaggagacgagatgaaggaggagatggtggtgggcttgtcggcgccggggcccgtggggaggtggggcgccgcgccgccgcaggcgctgctggagaggatgaaggactacgaccaggaaggcgccttcgcgctctgggacgatctctcgcccgaggaccgggagctcctcgtccaggacatcgagagtatagatctttcaaggatcgatcggatcattcgacgctcacttggatcacaaggcatgccgcttccggccgtggagcccgtgccagaatctagtgt

SEQ ID NO: 41224 - DNA, 732 bp, Panicum virgatum
  misc_feature: Ceres CLONE 2007058
  misc_feature: Encodes the peptide sequence at SEQ ID NO. 41225
acacagctgccgccaccgccactcttcgctctcgcaaaagctagcgcgagtccatggcggcgtcggcggcgtctccgcgcaccgcagcgcctcctcctcggcgcctcctcgcgctctcgctgctgcttccgctgctcgtgctccccgccgccaccaatgcgcaccccgtgacgacgacgccggcgccggcggcgaaggcgaaggcacgggaggcgggcgtctcggcggggctggtctccacgctgcgcgagacgctggacgcgatcaggagcgtggcgggcatcatctcggcgttccccgtcggcggcatcctcggcggcggcgacatccgcctctcctccgccgttgccgactgcctcgacctcctcgacctctcctccgacgagctctcgtggtccatgtccgccacctcggcggcgaccgccggcgccgggggaggagcaggcggccgcctcggcaccggcgacgccagctccgacctccggtcctggctgagcggcgcgctcgggaaccaggacacctgcaaggagggcctggacgcgaccggctcggtcctcggctcgctcgtcgccacggggctccaggccgtcacgtcgctcctcgccgacggcctgggccaggtcgccgccgcgggcgaggacgccgccgccttgtacccgccgtcctcccgccgcggcctcctcggcggcgcccggcccccgcggggctgcgcgcgagggagcggcggctgct

SEQ ID NO: 41225 - protein, 226 aa, Panicum virgatum
  misc_feature: Ceres CLONE 2007058
  misc_feature (33)..(189): Pfam Name: PMEI Pfam Description: Plant invertase/pectin methylesterase inhibitor
  misc_feature: SWISSPROT Homolog: EC 3.1.1.11 Pectinesterase
  misc_feature: Useful for making plants with altered carbohydrate content
MAASAASPRTAAPPPRRLLALSLLLPLLVLPAATNAHPVTTTPAPAAKAKAREAGVSAGLVSTLRETLDAIRSVAGIISAFPVGGILGGGDIRLSSAVADCLDLLDLSSDELSWSMSATSAATAGAGGGAGGRLGTGDASSDLRSWLSGALGNQDTCKEGLDATGSVLGSLVATGLQAVTSLLADGLGQVAAAGEDAAALYPPSSRRGLLGGARPPRGCARGSGGC

SEQ ID NO: 41226 - DNA, 1216 bp, Panicum virgatum
  misc_feature: Ceres CLONE 2007068
  misc_feature: Encodes the peptide sequence at SEQ ID NO. 41227
ataggagatagagaggggtggacaagtttagctagctggaagagacgccatgggagaagaggagcgaagaaactgcaatggacggaaggaggggaggaagaagagcaagtatgctgtagcgtgctccattgttggctctatcatctccatcctaatgggctacgataccggtgtgatgagcggcgcgatgctgttcatcaaggacgacctcaagacgaacgacacgcaggttcaggtcctcggcggcatcctcaacatctgcgccatcgtcggctccctcaccgccggccgcgtctctgactgggccggacgccgccgcaccatctccttctcggcttgcatcttcttcgtgggttccgtcctcatgggcctggcccccaacttcgccacgctcctggtcggccgctgcgtcgcgggcgtcggcgtcggctacgcgctcatgatcgcacccgtctacgcggccgagatcgcctccgcggagtcccgcggcgcgctcagctcgctccccgacatctgcatcagcctccgcatcctcctcggttacgtggccaactacctgctcgccaagctgcctctggtctacggctggcgcgccatgctggggctcggcgcgctcccgagcgccgcgctcgcggtcggcgtgttcgcgatgcccgagtcgccgcggtggctcgtcatgcagggacgagccgaggaggcgctcgccgtgctccggcgcgagtgcgaaacggagaacgaggcgcaggtgcggctcgcggagatcaagagcgcggccgggctcgccgttgactccgccctgagcgtggccgcgccgaaaagcagcggggagggcgtgtggaaggagctgttcgtgcacccgacgccgcccgtgcggcgcatcctggtggcagccctgggcgtgcacttcttcaatcacctgacgggcatcgaggccgtgctgctgtacagcccgcgcatcttcaaggccgccggcatcgcgacccggaacgaggtcctcgcggcgaccgtcggcgtgggcgtgaccaagacggtgttcatcctggccgccatcctgctcgtggaccgcatcggccggcggcgcctctacctctccagcctggcgggcatcatcgcgtcgcttgcctgcctcgggctcgggctcaccgtcgtcgagcgctcggcgccgcaccacgcggcgcagtgggcggtggtgctggccatcgccacggtgttcacc

SEQ ID NO: 41227 - protein, 388 aa, Panicum virgatum
  misc_feature: Ceres CLONE 2007068
  misc_feature (25)..(388): Pfam Name: Sugar_tr Pfam Description: Sugar (and other) transporter
MGEEERRNCNGRKEGRKKSKYAVACSIVGSIISILMGYDTGVMSGAMLFIKDDLKTNDTQVQVLGGILNICAIVGSLTAGRVSDWAGRRRTISFSACIFFVGSVLMGLAPNFATLLVGRCVAGVGVGYALMIAPVYAAEIASAESRGALSSLPDICISLRILLGYVANYLLAKLPLVYGWRAMLGLGALPSAALAVGVFAMPESPRWLVMQGRAEEALAVLRRECETENEAQVRLAEIKSAAGLAVDSALSVAAPKSSGEGVWKELFVHPTPPVRRILVAALGVHFFNHLTGIEAVLLYSPRIFKAAGIATRNEVLAATVGVGVTKTVFILAAILLVDRIGRRRLYLSSLAGIIASLACLGLGLTVVERSAPHHAAQWAVVLAIATVF

SEQ ID NO: 41228 - DNA, 1420 bp, Panicum virgatum
  misc_feature: Ceres CLONE 2007071
  misc_feature: Encodes the peptide sequence at SEQ ID NO. 41229
acacaaacacacgcccacactccccagtgcttaagctaagcaccaaatcacacgcctcgtgtcgaccagcgaacaccagggcaggcacgaactgcgctagctagcaagcacacacgcacgcactacgcactgcagtgccatgccggaagcaccgacccccaagacaaccccgccggcctgcggcttcgcccccggtgcccaccgcgaggcgctcgagttcatcgagcatgtcacggcgaacgccgggcaggtgcagcgacgcgtcctcgccgagatactggcgcagaacgcgccggccgagtacctgcgccggcacggcgtctccgggaccgcgggcgacgccgtcgaagccttcctccgtctcgtcccgctcgtcacctacgagggcctccagccggacatactccgcattgccaacggcgatacctcgccgatcctctccggcaaacccatctccgagttcctcacaagctccggcacgtccggaggggagaggaagctgatgccgaccatcgccgacgagctggacaggaggtcgctgctgtatagcctgcagatggcggtgatgagccagtcggtgcccgggctcgacaagggcaagtccatgtacctgctgttcgtgaaggcggaggcgcgcacgccgggcgggctcgcggcccggccggtgctgacgagctactaccggagtcggcagttcctggagcggccgcatgacccctacaccgactacacgagccccaacgaggcgatcctgtgcgtggactcgtaccagagcatgtacgcgcagctgctgtgcggcctcgtccaccgcgccgacgtgctgcgcgtcggcgccgtgttcgcctcaggcttccttcgcgccatacgcttcctcgagaagcactggccgcgcctgtgccgcgacatccgcgcgggcgccctcgacccggagatcaccgaccgcgccgtgcgcgacgccgtcgggagggtgctgcgcgccgacccggcgctcgccgacgagatcgaggccgagtgcgggagggcgtcgtgggagggcatcatccggcggctgtggccccgcaccaagtacatcgacgtgatcgtgaccggcgccatgtcgcagtacatcccgacgctggagttctatggcggcggcctgccgctcgcgtgcaccatgtacgcctcctccgggtgctacttcggcctcaacctcaagcccatgtgcaagccgagcgacgtcgcctatacgctcatccccaccatgtgctacttcgagttccttcctctccgctgcagcaacgccaagcaggccgagccgagccaccgcgacctggtcggcctcgtcgatgtgaagcttgggcacgagtacgagctcgtggtcaccacttactccggtttgtgtcggtatcgcgtgggcgatgtgctgcgggtggcggggttc

SEQ ID NO: 41229 - protein, 426 aa, Panicum virgatum
  misc_feature: Ceres CLONE 2007071
  misc_feature (23)..(426): Pfam Name: GH3 Pfam Description: GH3 auxin-responsive promoter
  misc_feature: Useful for making plants with modulated biomass
  misc_feature: Useful for making plants with modulated light quality response
  misc_feature: Useful for making plants with modulated low light sensitivity
MPEAPTPKTTPPACGFAPGAHREALEFIEHVTANAGQVQRRVLAEILAQNAPAEYLRRHGVSGTAGDAVEAFLRLVPLVTYEGLQPDILRIANGDTSPILSGKPISEFLTSSGTSGGERKLMPTIADELDRRSLLYSLQMAVMSQSVPGLDKGKSMYLLFVKAEARTPGGLAARPVLTSYYRSRQFLERPHDPYTDYTSPNEAILCVDSYQSMYAQLLCGLVHRADVLRVGAVFASGFLRAIRFLEKHWPRLCRDIRAGALDPEITDRAVRDAVGRVLRADPALADEIEAECGRASWEGIIRRLWPRTKYIDVIVTGAMSQYIPTLEFYGGGLPLACTMYASSGCYFGLNLKPMCKPSDVAYTLIPTMCYFEFLPLRCSNAKQAEPSHRDLVGLVDVKLGHEYELVVTTYSGLCRYRVGDVLRVAG

SEQ ID NO: 41230 - DNA, 623 bp, Panicum virgatum
  misc_feature: Ceres CLONE 2007071-R
  misc_feature: Encodes the peptide sequence at SEQ ID NO. 41231
ggcagcacggccgtgccggcgtccgtgttcgaggactgctgcctggcggtggaggaggccctgaacagcgtgtaccggcagtgccgggcctgcgacaggtccatcggccccctcgagatacgcgtcgtctccgagggcaccttcgacaagctcatggactacgccatcagccgcggcgcgtccatcaaccagtacaaggcgccgcggtgcgtgcgccccggcccggtggtggagctgctcgacgcgagggtgcagggcaagtacttcagccccaagtgccccaagtggagccccgggaacaagctatggagcaacgccagggaggcctgaatcctgatgatcgatcgtggtacgatctgaattttcagaggcagggagaggatagctatatggaatgatgatgacttagggtatctgctatgatcatttgatttttggttccttttctctccatctttgtaatatgtctcgtgttccttcagctcgtgtattttgctatgcacttagtgcatgtcaattacatatactaaattatgtttactctgttagtagtataggggtcggaatggatttttatgctgtgtcaaattgaactatgaggattaatgtccagtatttttccc

SEQ ID NO: 41231 - protein, 109 aa, Panicum virgatum
  misc_feature: Ceres CLONE 2007071-R
  misc_feature: Useful for making plants with modulated biomass
  misc_feature: Useful for making plants with modulated light quality response
  misc_feature: Useful for making plants with modulated low light sensitivity
GSTAVPASVFEDCCLAVEEALNSVYRQCRACDRSIGPLEIRVVSEGTFDKLMDYAISRGASINQYKAPRCVRPGPVVELLDARVQGKYFSPKCPKWSPGNKLWSNAREA

SEQ ID NO: 41232 - DNA, 1408 bp, Panicum virgatum
  misc_feature: Ceres CLONE 2007084
  misc_feature: Encodes the peptide sequence at SEQ ID NO. 41233
tgacgccactcccctcccctcccctcccctgccccctcacttcaaattgattcggcgctagggaccagtaaggccaaggcagcatccagcaatagcagcagcagcgacatccccttgtcttcctcctccagtcctgggcctcatgaggacccaaagaagccaccttggcctcctcttcctcctgtcctctgcgctgctcgccgtctccttcgcgcaggagcgcaagaactatgtggttcatctcgagccgagagaggacggcagcaccgattcagtcgaggagtggcaccggtccttcctgccggagtccacgctggactcggcgagcgacgacggccccagaatcatacactcgtacagccacgtgctgaacgggttcgccgcccgcctcaccgacgcggaggcggagagtctcaggaacagggaggggtgcctgcgcctgtaccccgaggagttcttgccgcttgcaaccacccactcgccggggttcctcggcctccacctcggcaaggacggcttctggagccgctccgggttcggccggggcgtggtgattggggtcttggacaccgggatcctgcccagccacccgtccttcggcgacgccggcctgccgccgccgcccaagaagtggaagggcacctgcgagttcaggtcgatcgccgccgccggctgcaacaacaaggtcattggcgcgcgcgccttcgggagcgccgccatcaacaacaccgccccgcccgtcgacgacgcgggccacggcacgcacacggcgagcacggcggcgggcaacttcgtccagaacgccggcgtgcgcgggaacgcgcacggcacggcgtccgggatggcgccgcacgcgcacctcgccatatacaaggtgtgcgcccggagccgctgctccatcatggacatcatcgccggtctggacgccgccgtcaaggacggcgtggacgtgctctccttctccatcagcgcgaccgatggcgcgcagttcaactacgacctcatcgccgtcgccacgttcaaggccatggagcacggcatcttcgtcagcgccgccgccggcaatgacggccccgtcgccggcaccatccggaacggcgcgccgtggatgctgacggtggcggccggcaccatggaccgcgcgatccgcaccagcgtgaggctcggcaacgggcaggagttggacggcgagtccctgttccagccccggaacaacaccgccgggcgccagctcccgctcgtgttcccgggccgcaacggcgacccggacgcccgcgactgcagcacgctggtcgaggcggaggtgcgcggcaaggtgggtctctgcgagagccggtcgatcagcgagcacgtcgagcaggggcagatggtgtcggcttacggcggcgccggcatgatcctgatgaac

SEQ ID NO: 41233 - protein, 421 aa, Panicum virgatum
  misc_feature: Ceres CLONE 2007084
  misc_feature (28)..(109): Pfam Name: Subtilisin_N Pfam Description: Subtilisin N-terminal Region
  misc_feature (116)..(373): Pfam Name: Peptidase_S8 Pfam Description: Subtilase family
  misc_feature: SWISSPROT Homolog: EC 3.4.21.25 Cucumisin
MRTQRSHLGLLFLLSSALLAVSFAQERKNYVVHLEPREDGSTDSVEEWHRSFLPESTLDSASDDGPRIIHSYSHVLNGFAARLTDAEAESLRNREGCLRLYPEEFLPLATTHSPGFLGLHLGKDGFWSRSGFGRGVVIGVLDTGILPSHPSFGDAGLPPPPKKWKGTCEFRSIAAAGCNNKVIGARAFGSAAINNTAPPVDDAGHGTHTASTAAGNFVQNAGVRGNAHGTASGMAPHAHLAIYKVCARSRCSIMDIIAGLDAAVKDGVDVLSFSISATDGAQFNYDLIAVATFKAMEHGIFVSAAAGNDGPVAGTIRNGAPWMLTVAAGTMDRAIRTSVRLGNGQELDGESLFQPRNNTAGRQLPLVFPGRNGDPDARDCSTLVEAEVRGKVGLCESRSISEHVEQGQMVSAYGGAGMILM

SEQ ID NO: 41234 - DNA, 648 bp, Panicum virgatum
  misc_feature: Ceres CLONE 2007084-R
  misc_feature: Encodes the peptide sequence at SEQ ID NO. 41235
cgccgtggaccccgggctggtgtacgacctgggccccagcgagtacatcgcctacctctgcgggctggggctcggggacgacggcgtgaaggagatagtcgggcggcgcatcgcgtgcggcaagctcaaggccatcaccgaggcggagctcaactacccgtcgctggtggtgaagctgctgtcccagccgatcacggtccggcgcacggtgacgaacgtggggaaggcggactcggtgtacacggcggcggtggacatgcccaggggcgtgtccgtggtggtgcggcccccgatgctgcgcttctcgcgggcgaacgagaagcagagcttcagcgtgacggtgcggtggaacgggcagccggccgtgggcggggccgaggggaacctcaagtgggtgtccaaggagcatgtggtgaggagcccgatcgtgatcccgccggccaaggccgtcgcgtagtagtagtatgttgttgatggcggcgcaatcgtgtcagtcagaacaaggttacttatcagtggtagtgagtggtaggttatcataagattgagtgtgcccggtggtgtacgtatggcgaagggagtaggtgatttgttgttgttgttgtataggcagcaaggtaccgagggagatcatctgcgagtgttgtc

SEQ ID NO: 41235 - protein, 151 aa, Panicum virgatum
  misc_feature: Ceres CLONE 2007084-R
  misc_feature: SWISSPROT Homolog: EC 3.4.21.25 Cucumisin
AVDPGLVYDLGPSEYIAYLCGLGLGDDGVKEIVGRRIACGKLKAITEAELNYPSLVVKLLSQPITVRRTVTNVGKADSVYTAAVDMPRGVSVVVRPPMLRFSRANEKQSFSVTVRWNGQPAVGGAEGNLKWVSKEHVVRSPIVIPPAKAVA

SEQ ID NO: 41236 - DNA, 665 bp, Panicum virgatum
  misc_feature: Ceres CLONE 2007087
  misc_feature: Encodes the peptide sequence at SEQ ID NO. 41237
ctctctttccgcctccacccctcgcgagctcggcacacgcggcggcttccctcctccttcctcctcacccccggcggcggcggcgacggagatgcagatggcagcggcagaggcccccaccgacgccgcggccgcggctgccgcgccgcatcaccacccccacgcgcacgccgcggcggccgcggccccgccgcacccgcacgcgcacgcgccgcacccgcaccaccacatgccgcagccgcggtgggtggtcatcccgtacccgccgccgcaccaccccatggtggccgctcccccgcccccgccgccgcagttcgtcaagcacttcgcgccgctggcctcggtcaccccgccgccgccgcagtcggctggatccggcgggaatggggccgaggacaaccgaacgatctgggtcggcgacctccagtactggatggacgagaactacctccacagctgcttcggccccagcggcgaggtggtgacaattaaagttattcgcaatagacactcgggggtctccgagggttatggttttgtagagttctattctcacgcatcagcagaaaaggcactacagaatttttctggtcatgtaatgcctaatactgaccgggcttttaagttgaactgggcatcatatagtatgggagaaaaacgctccg

SEQ ID NO: 41237 - protein, 191 aa, Panicum virgatum
  misc_feature: Ceres CLONE 2007087
  misc_feature (106)..(177): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MQMAAAEAPTDAAAAAAAPHHHPHAHAAAAAAPPHPHAHAPHPHHHMPQPRWVVIPYPPPHHPMVAAPPPPPPQFVKHFAPLASVTPPPPQSAGSGGNGAEDNRTIWVGDLQYWMDENYLHSCFGPSGEVVTIKVIRNRHSGVSEGYGFVEFYSHASAEKALQNFSGHVMPNTDRAFKLNWASYSMGEKRS

SEQ ID NO: 41238 - DNA, 2021 bp, Panicum virgatum
  misc_feature: Ceres CLONE 2007090
  misc_feature: Encodes the peptide sequence at SEQ ID NO. 41239
cgcttctcctccgtctcgctcgcctcgtcacctctcccgcgcccaccccccacaaatctcactcacagttggtgcacgctcgcgtccaaaccaagcaaacccaaaaccctagcctgccgccgccgctgccggcggggctccctccggtcccgtccccggcctaccctagcctcgcagcaaccctaaccctacccgccttcgccgccgccgccgccggagcaggggggcaaaatgccgcgcgagatcatcacgatccaggtggggcaatgcgggaaccagatcgggatggagttctggaagcagctctgcctcgagcacggcatcggcaaggacggactcctcgaggacttcgccacccagggtggtgacaggaaggacgtcttcttttaccaggctgatgatcagcacttcatacccaggtctcttcttattgacctggagccaagagtgatcaatggaattcagaacagcgagtataggaatctgtacaaccatgagaacatatttgtcgctgagcacggtggtggtgctgggaacaactgggccagtgggtatcatcagggtgaacaagttgttgatgatatcatggacatggttgatagagaagcagatggaagtgacagccttgagggttttgtcctttgtcactctattgctggtggaactggttcaggtatgggttcttatctgttggagacattgaatgatcgatacagtaaaaagcttgtgcagacatatagtgtcttccccaatcagatggaaacaagtgatgttgtcgtccaaccttacaactcgcttttgactctgaagcggctgacactgaatgccgactgtgtggttgttcttgacaatacggctcttaataggattgccgtggagcgtcttcatctatcaaatcctacttttgcacagacaaactctttggtctccacagttatgtctgcaagcacaactactttgaggtaccctggatatatgaacaatgacctggttggtcttcttgcctccttgatccccacaccaaggtgtcattttctgatgacaggttacactccattgaccgttgaacggcaggttaacatgatacgcaaaacgacggtactagatgttatgagaagacttctacagacaaagaatataatggtgtcatcatatgctcggacaaaggaagccagccaggctaaatacatttccatacttaatatcattcaaggagaggtggaccctacacaggtccatgagagtctgcaaaggatacgtgaaaggaagcttgttaacttcatagattgggcccctgcaagcattcaggttgccttgtcaagaaaatccccatatgttcaaacaacacacagggtaagtggtttgatgttagcaaatcatactagtatacggcacttattcagcaaatgcctgggacaatatgagaagctaaggaaaaagcaagcctttcttgacaactaccggaagtttcctatgtttgcggacaatgatctctctgaattcgatgaatctcgagaaataatagagagtctagttgatgagtacaaggcttgcgaatcaccagattacattaaatggggaatggaggatactggagaggcaaatgtcgcggccgcactggattctaagttagtggtgtaaatatcaaggtcctgctggttacccaaagattcaactgtagctgtccagtagttatcagttcgatgctgcctgctcatctagatctcatcggggtgctaccagagcgggtcacgctcttgtttgcaatcttgaagtttgcttcctttttttttccttgtgtgtgtgtgtgtgtgtgtgtgtgtgtggctatgtacatgtcgaaacccacttcctctgatctgtgctgttccatggtcttgttctagctgcccatcattggtggcgatgcattccatgttctgttctataacgctgatagctaggttcatatagtttggagctcctgcccgtcctgtgacactatgcccctgtttgtttcaaagcaagattttatatagtcc

SEQ ID NO: 41239 - protein, 469 aa, Panicum virgatum
  misc_feature: Ceres CLONE 2007090
  misc_feature (46)..(247): Pfam Name: Tubulin Pfam Description: Tubulin/FtsZ family, GTPase domain
  misc_feature (249)..(395): Pfam Name: Tubulin_C Pfam Description: Tubulin/FtsZ family, C-terminal domain
MPREIITIQVGQCGNQIGMEFWKQLCLEHGIGKDGLLEDFATQGGDRKDVFFYQADDQHFIPRSLLIDLEPRVINGIQNSEYRNLYNHENIFVAEHGGGAGNNWASGYHQGEQVVDDIMDMVDREADGSDSLEGFVLCHSIAGGTGSGMGSYLLETLNDRYSKKLVQTYSVFPNQMETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVMRRLLQTKNIMVSSYARTKEASQAKYISILNIIQGEVDPTQVHESLQRIRERKLVNFIDWAPASIQVALSRKSPYVQTTHRVSGLMLANHTSIRHLFSKCLGQYEKLRKKQAFLDNYRKFPMFADNDLSEFDESREIIESLVDEYKACESPDYIKWGMEDTGEANVAAALDSKLVV

SEQ ID NO: 41240 - DNA, 602 bp, Panicum virgatum
  misc_feature: Ceres CLONE 2007092
  misc_feature: Encodes the peptide sequence at SEQ ID NO. 41241
ccaatctgttcccgatccgacccgagccggacggccatggcgattagggctggccgctccgccctcctcgccctcgccttcctcctcgccgcctccccctgtctccaagctcgagtggatcaactttaccatggaaaacaggtatctgactggaataggcaactcaactttgaatcacaaaatttctcctcaagtcaaatggatgaatctcatgtccttggaagaccagaagagataacacgcaggaaattaagggcgagaactggtgtaaggaagaaaatggaagtagtgcagcaggatgatgaagccctggtgaaacttgagaacacaggtatcgagcgctcgaaagctgttgattctgctggtctaggaaaatacagcatatggagacgtgaaaatgaaaatgagaaggcagattcaagggttcgtatgatgcgagatcaaatgatgatggctagaatatattctgtacttgccaaatccagggacaagcttgatctttatcaggaactacttgcaaggctcaaagaaagccagcgctcccttggggaagctactgctgatgctgaacttccgaaaagagcttcggaaaggatcaaacc

SEQ ID NO: 41241 - protein, 188 aa, Panicum virgatum
  misc_feature: Ceres CLONE 2007092
  misc_feature: Useful for making plants with altered cell wall content and/or composition
MAIRAGRSALLALAFLLAASPCLQARVDQLYHGKQVSDWNRQLNFESQNFSSSQMDESHVLGRPEEITRRKLRARTGVRKKMEVVQQDDEALVKLENTGIERSKAVDSAGLGKYSIWRRENENEKADSRVRMMRDQMMMARIYSVLAKSRDKLDLYQELLARLKESQRSLGEATADAELPKRASERIK

SEQ ID NO: 41242 - DNA, 1658 bp, Panicum virgatum
  misc_feature: Ceres CLONE 2007097
  misc_feature: Encodes the peptide sequence at SEQ ID NO. 41243
gcgctgacacgcatcattaattccagaggggaaacgcacgcggtctccatccagtagctggctgggtagcgggggcgcaggtgcaggcgggcgagcgagctcggccatggcgagcgcgatgaacggcggcggcggcggcggggcgctgaagcggatgggcccgctgcggctgcagtactacatcgtgatgggcgcggtggcggcggccgtggtgctggccacgctgcgctacatgccgggccccgccgccgccgccaccagcagcgtggtccggccggacgcctcctccgcggcggcggcccccggcgccgaggcggaggcggagagggagggggataagaggaagaagaagaagggggacggggtggtgctgttcaacttcggcgactccaacagcgacacgggcggcgtggcggcggtgatggggatccgcatcgcgccgccggagggccgggcctacttccaccaccccacggggaggctctccgacggccgcgtcatcctcgacttcatctgcgagagcctgggcacgcaccatctgagcccgttcatgaagccgctggactccaacttcaccaacggcgtgaacttcgccatcgcagggtccacggccatgccaggggtcaccactttctcgctggacgtgcaggtcgaccagttcatcttcttcaaggagagatgccttgatgccatcgagagaggtgagagtgccccggttgatgagatggggttccaaactgctttatacaccatggacatcgggcacaatgatatcaatggcgttctccacatgccctatgatgaaatgcttgccaatcttccccctgtaattactgaaatcaagaaagccattgagaggttgcataaaaatggggccaggaagttctggatacacgggacaggtgcgcttggttgcatgcctcagaagcttgctatgccgagggacaacgacagtggtctcgatgagcatggatgcatcgcaagcataaacaatgtttgcaagaagttcaattctttgctgagcgaagccttggatgagctgcgcttgacccttaaaaagtcggcaatcgtctttgttgatatgtttgctatcaagtatgatcttgttgccaaccacaagaaatacgggattgagaagccgttgatgacatgttgcggccatggaggccctccttacaactacgacccgaaggaaagctgcatgacttcggataaacacctgtgcaagcttggtgaaaagttcataagctgggatggtgttcacttcaccgatgctgcaaacggcattgtggcttccaaggtgctcagcggcgagtactccattcccagggtcaagctggccagcctcgtcagcactgcaaaatctgatgattaatggtgatatggcattctaattggccctccctttggtttctcacaagggcgatgaagatggaaccactaacaaaactgaccccaaaatttaattatttcgaggtttttaccttacagccatcgttgacaaagattttcttttccttttcttctcctttttgtataattggggcgaatgtatagcctacagttttaatacatggtcatcctggtgtctctgttccatgtatgacttcttctttttttcttctgaattttggatcaataaatagagatgaatattt

SEQ ID NO: 41243 - protein, 422 aa, Panicum virgatum
  misc_feature: Ceres CLONE 2007097
  misc_feature (89)..(399): Pfam Name: Lipase_GDSL Pfam Description: GDSL-like Lipase/Acylhydrolase
  misc_feature: SWISSPROT Homolog: EC 3.2.1.51 Alpha-L-fucosidase
MASAMNGGGGGGALKRMGPLRLQYYIVMGAVAAAVVLATLRYMPGPAAAATSSVVRPDASSAAAAPGAEAEAEREGDKRKKKKGDGVVLFNFGDSNSDTGGVAAVMGIRIAPPEGRAYFHHPTGRLSDGRVILDFICESLGTHHLSPFMKPLDSNFTNGVNFAIAGSTAMPGVTTFSLDVQVDQFIFFKERCLDAIERGESAPVDEMGFQTALYTMDIGHNDINGVLHMPYDEMLANLPPVITEIKKAIERLHKNGARKFWIHGTGALGCMPQKLAMPRDNDSGLDEHGCIASINNVCKKFNSLLSEALDELRLTLKKSAIVFVDMFAIKYDLVANHKKYGIEKPLMTCCGHGGPPYNYDPKESCMTSDKHLCKLGEKFISWDGVHFTDAANGIVASKVLSGEYSIPRVKLASLVSTAKSDD

SEQ ID NO: 41244 - DNA, 1342 bp, Panicum virgatum
  misc_feature: Ceres CLONE 2007098
  misc_feature: Encodes the peptide sequence at SEQ ID NO. 41245
ccaaccatctcccccgcccccccgccgcgcccatcccccggcgccgcctcctctcccgaagccacgctcccacccactagccgccgccgccccgactcccgcacccgccgcgggcgggggacactctgcgccgtccagcgagaatttgattcagtcggactccgctgtgatggcggggaaggcgccgatggagcggcaccagtcgatcgacgcgcagctgcggctgctggcgccaggcaaggtgtccgaggacgacaagctggtcgagtacgacgccctcctcgtcgaccgcttcctcgacatcctccaggacctgcacggcccgcacctccgcgaattcgtccaggagtgctacgagctctcagcggagtacgagaacgaccgcgacgaggcgcggctcggcgagctcgggagaaagctcaccagcctgccgccgggggactccatcgtcgtcgccagctccttctcgcacatgcttaacctcgccaacctcgccgaggaggtgcagatcgcgcaccgccgccggatcaagctcaagcgtggggacttcgccgacgaggcctcggcgcccaccgagtccgacatcgaggagacgctcaagcgcctcgtctcgcagctcggcaagtcgcgcgaggaggtcttcgacgcgctcaagaaccagactgtcgacctcgtcttcacggcgcaccccacgcagtccgtcaggaggtccctgcttcagaagcacggcaggatccggaattgcctgagacagctgtatgccaaggacatcactgctgacgacaagcaggagcttgatgaggctcttcagagggagattcaagctgctttcagaactgatgaaatccgcaggacccctcccacccctcaagatgaaatgcgtgctggaatgagttacttccatgaaactatatggaagggcgtacccaaattcttgcgccgtattgacactgctctgaaaaatattgggatcaatgagcgtctcccttacaacgctcccctcattcagttctcatcctggatgggtggtgaccgtgatggaaatccaagagttacaccagaggttacacgggatgtatgcttgttggcgagaatgatggctgctaacttgtacttctctcagatagaagatctaatgtttgagctctctatgtggcgctgcagtgatgaacttcggatccgtgcagatgaattacatcgctcgtcaaaaagagctgcaaagcattatatagaattctggaagcaagttcctccaaacgaaccatatcgtgtcatacttggtgatgtcagggataaattgtactatacacgtgagcgttctcgtcatttattgacaacagga

SEQ ID NO: 41245 - protein, 390 aa, Panicum virgatum
  misc_feature: Ceres CLONE 2007098
  misc_feature (12)..(390): Pfam Name: PEPcase Pfam Description: Phosphoenolpyruvate carboxylase
  misc_feature: SWISSPROT Homolog: EC 4.1.1.31 Phosphoenolpyruvate carboxylase
MAGKAPMERHQSIDAQLRLLAPGKVSEDDKLVEYDALLVDRFLDILQDLHGPHLREFVQECYELSAEYENDRDEARLGELGRKLTSLPPGDSIVVASSFSHMLNLANLAEEVQIAHRRRIKLKRGDFADEASAPTESDIEETLKRLVSQLGKSREEVFDALKNQTVDLVFTAHPTQSVRRSLLQKHGRIRNCLRQLYAKDITADDKQELDEALQREIQAAFRTDEIRRTPPTPQDEMRAGMSYFHETIWKGVPKFLRRIDTALKNIGINERLPYNAPLIQFSSWMGGDRDGNPRVTPEVTRDVCLLARMMAANLYFSQIEDLMFELSMWRCSDELRIRADELHRSSKRAAKHYIEFWKQVPPNEPYRVILGDVRDKLYYTRERSRHLLTT

SEQ ID NO: 41246 - DNA, 658 bp, Panicum virgatum
  misc_feature: Ceres CLONE 2007098-R
  misc_feature: Encodes the peptide sequence at SEQ ID NO. 41247
ccaagggagacccaggaatcgcagctgtgtacgacaaactgctagtggctgaagatctgcaatcctttggggagcagctgaggaagaactatgaggagacaaaagagctactccttcaggttgccggtcacaaggacgtcctcgaaggcgatccttacctgaagcagcgtctgcggctgcgtgagtcctacatcaccaccttgaacgtctgccaggcctacaccctgaagcgaattcgtgacccggccttccaagtgagcccccagccggctctgtccaaggagtttgttgacgagagcctgccagcgcagttggtgcagctgaaccccgagagcgagtacgctccgggcctggaggacacgctgatcctgaccatgaagggcatcgccgccggaatgcagaacaccggctaggccagactctcggtgtacaaataacccatctcacatgagatggtggacaatgtgtgtaagcctgtaggcagttagtttgccggcgctagtgggttactcatctggaggaacttttatgtcgcagacttttggttttgcttgatgtaaatgtcaaggtgagcttattggctgttgaagcctgatgcgtaataaattatggaacaatggtttacgttaatctctaataataaatgtgtatcttctag

SEQ ID NO: 41247 - protein, 136 aa, Panicum virgatum
  misc_feature: Ceres CLONE 2007098-R
  misc_feature: SWISSPROT Homolog: EC 4.1.1.31 Phosphoenolpyruvate carboxylase
KGDPGIAAVYDKLLVAEDLQSFGEQLRKNYEETKELLLQVAGHKDVLEGDPYLKQRLRLRESYITTLNVCQAYTLKRIRDPAFQVSPQPALSKEFVDESLPAQLVQLNPESEYAPGLEDTLILTMKGIAAGMQNTG

SEQ ID NO: 41248 - DNA, 1609 bp, Panicum virgatum
  misc_feature: Ceres CLONE 2007129
  misc_feature: Encodes the peptide sequence at SEQ ID NO. 41249
aatcccccacaaagaccctactctctccacgttccgggtccgcctggcacactcacttacagcgtcccacactcccctcagacctgcacgctacctctctactccaaggattcgggcacaacgaccacccacacatccacatacacacacagaacccccatgtcgcggtagtcccgagccctggcatgtcctcgcccgccctccgccatgatgcttcccccatggacacgcacatcctgatccgccatgcggacagccacgccgacatgcacagcacgaagccggcaccgctgtgtcccaccgacagcgacgccatcctgccctcgcgctccagcaaagatgcccacgcccacacctcctccgcgcccagcaccacgcgccgcgtcgaccgcaagagccccgaatacctaatcaaaagcggcatcgcgggcggcatcgcaggatgcgcagcaaaaaccgtcgtcgggccccttgaccgcgtgaagatcctcttccaaacccaaaacccgcagttcgcaaaatacaccggctcgtggacggggttcccaaaagccgtgcgcgacatctacgcctccgccggcaccgcggggctcttcaaaggccacagcgccactctcctccgcatcttcccctacgcggggatcaaattcctcgcatacgaacagatccgggcgcgcgtgatccactcggccgcacaggagacgccggggcggcgcttcgtgtccggcagcttagcagggatggtcagcgtcttcttcacctacccgctggaagtcatccgcgtgcggttggcattcgagacgcgcgcgggggagcgcagcaacctgagcgccattgtgcgcaagatctacagcgagacttccgcacccacgacccactccccaggcaacgcggtatccgcgtctgctgtgcatgcggtcgagaaactcaccccccagtccggcctcggcaacttcttccgcggcttcacccctaccctgctcggcatggtgccctacgcgggcgcctcgttcctcgcccacgactccctgggcgacgtcatgcgctggccactgctggccccctacacaacactccccaacaccgggcggcctgagacctcagactccagcgccaagcccgcgcagctgcggtactgggccgaactctcgaccggcggcatagcgggcttcgtctcacaaaccgtgtcctacccgctcgaagtcatccggcggcggatgcaggttggtggtgtcgttggcgacgggcacagactgggcattgcagaagtagcaaagcggatctatgcagagagggggtggagggggtatttcgtggggttgacgattgggtacgtcaaggttgtgccgatggtggcgacgagtttcttcgtgtacgaacgggccaagttttactttggtatataagtgctgtggcaatggggctgcgtgcgcatgggtgttttaggcgttttgtgtaagtgcacacacataagatgtgcgcgggattcttgcgtagggggcggaatagtggcgtgtatataaaacgacttcccgcatcagcatgtgcgttttgtggaaacggggaaactggtagatatcccttgaaatgtacatgtcccatcccatcc

SEQ ID NO: 41249 - protein, 394 aa, Panicum virgatum
  misc_feature: Ceres CLONE 2007129
  misc_feature (62)..(157): Pfam Name: Mito_carr Pfam Description: Mitochondrial carrier protein
  misc_feature (304)..(392): Pfam Name: Mito_carr Pfam Description: Mitochondrial carrier protein
  misc_feature (161)..(278): Pfam Name: Mito_carr Pfam Description: Mitochondrial carrier protein
MDTHILIRHADSHADMHSTKPAPLCPTDSDAILPSRSSKDAHAHTSSAPSTTRRVDRKSPEYLIKSGIAGGIAGCAAKTVVGPLDRVKILFQTQNPQFAKYTGSWTGFPKAVRDIYASAGTAGLFKGHSATLLRIFPYAGIKFLAYEQIRARVIHSAAQETPGRRFVSGSLAGMVSVFFTYPLEVIRVRLAFETRAGERSNLSAIVRKIYSETSAPTTHSPGNAVSASAVHAVEKLTPQSGLGNFFRGFTPTLLGMVPYAGASFLAHDSLGDVMRWPLLAPYTTLPNTGRPETSDSSAKPAQLRYWAELSTGGIAGFVSQTVSYPLEVIRRRMQVGGVVGDGHRLGIAEVAKRIYAERGWRGYFVGLTIGYVKVVPMVATSFFVYERAKFYFGI

SEQ ID NO: 41250 - DNA, 661 bp, Panicum virgatum
  misc_feature: Ceres CLONE 2007130
  misc_feature: Encodes the peptide sequence at SEQ ID NO. 41251
ggaaaggatcttttctttatctactggtactgtacgtgcacgtgtgtttgaccgttttctttttgacacaccattcacaaagaatggaaaaacacaaggtggcttagaagaccaatggaagagacgcacagtgcttcagactgagggttcatttcctgctttggtgaaccgcctgctagttaccaaatctgaatctctagagttctctcctgttgagaatgcgattggaatgatcgaaacaagaacagctgcattgagaaatgaactagaagaaccacggagttctgaaggcgatcaactaccaaggcttcaaagcttgcaaaggatactccaaggaagtgtggctgttcaggtcaacagtggagtgttaagtgtgtgcactgcattcttatccggtgagcctgcgaccaggctccgatcacaagaactgcagcagctcatcgctgcattgcttgaattcatggctgtctgcaagcgcgcaatcagagtgcatttcagattgataggcgaagaagaccaggaattccacacccaactcgtcaatggattccagtcactcactgctgagctgtctcactatatccctgctatactttcagagctatgatagtactgtagcaatctggaaattaggtagcatgtgaatggttgttcattcttt

SEQ ID NO: 41251 - protein, 201 aa, Panicum virgatum
  misc_feature: Ceres CLONE 2007130
  misc_feature (8)..(194): Pfam Name: Ded_cyto Pfam Description: Dedicator of cytokinesis
ERIFSLSTGTVRARVFDRFLFDTPFTKNGKTQGGLEDQWKRRTVLQTEGSFPALVNRLLVTKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 41252 - DNA, 1389 bp, Panicum virgatum
  misc_feature: Ceres CLONE 2007137
  misc_feature: Encodes the peptide sequence at SEQ ID NO. 41253
gatcgccaccgcccgagccgagaccaacaccaaccaccgagctcggagagcagagcagcctctctgctctctggttgctctcgcagccggtcagtcctcacacctcaccgctcactatctgaccgcgacgtccggcgccaagcaaggccgcctcgtccacctccgtccatgtgagtgagtggcagcacaacgctggctcccaggtctcgctcgcccggtggccggacttgcagaagaagaagcagcagcagctaaccgcagcggctgcagaatccggcgggcgacatgggtctgctgtctcaccgggtggagcggtcggagatcaagcccggcgaccacatctacacctggcgcgccggctacacctactcccaccacgggatctacgtcggcgggagcaaggtggtgcacttcacgcgcaagaaggaggcgggcaccgccggcctggactcggccatcgccgtgtcgagcctcctctcgcagggccccgacgagtgcccgaccttcccggactgcggcttccagcgccccgacagcggcgtcgtgctcacctgcctcgactgcttcctccgcggcggcgcgctgcaccgcttcgagtacggcgccccgcccgccgtgttcctcgccaagctccgcggcgggacctgcaccacggcgcgcgccgacggcgggcccgccgccgccgtgcgccgcgccatgcacctcctccagaacggcttcggcgactacgacgtgttcgagaacaactgcgaggacttcgcgctctactgcacgacgggcctcctccccggcgccggcgacgacggcatcgggcgcagcggccaggcggcctccgccgtcgccgtgccgctcgcggcgctcctctccacgccgttcaaggtgctcgccgccggcccgctcggcatggccgccgtcaccgccggcgtgtactgcgccggcaggtacatcaccgacatcggggtgcggaaggacgtcgtcaaggtggaggtggagaacctggcggcgcacctcggctggcgacgcgccaaggctgctgaggaggcggtcaagaaacagcagcatcagccgcagccgccgccgacgccggagaagaaggccagcagcaggctgctccctctgaaacggaaacgagagatttgcgtctgattttgcgtggatacaggcagattgggtcgttgcatagaaatcaataagtgcggtataggtatcgaagcgtcttgatcgagcgtgctttcatttgtttagttgagcgtcgtacgtgatcgatctttctttctcacgaaatggaagattagatagttgcagttttatagcttgcattatgtactacgtagtcaattgctagacttggtctctgtattatctgatatagctcaagagttcatcagt

SEQ ID NO: 41253 - protein, 286 aa, Panicum virgatum
  misc_feature: Ceres CLONE 2007137
  misc_feature (101)..(184): Pfam Name: NC Pfam Description: NC domain
MGLLSHRVERSEIKPGDHIYTWRAGYTYSHHGIYVGGSKVVHFTRKKEAGTAGLDSAIAVSSLLSQGPDECPTFPDCGFQRPDSGVVLTCLDCFLRGGALHRFEYGAPPAVFLAKLRGGTCTTARADGGPAAAVRRAMHLLQNGFGDYDVFENNCEDFALYCTTGLLPGAGDDGIGRSGQAASAVAVPLAALLSTPFKVLAAGPLGMAAVTAGVYCAGRYITDIGVRKDVVKVEVENLAAHLGWRRAKAAEEAVKKQQHQPQPPPTPEKKASSRLLPLKRKREICV

SEQ ID NO: 41254 - DNA, 1887 bp, Panicum virgatum
  misc_feature: Ceres CLONE 2007138
  misc_feature: Encodes the peptide sequence at SEQ ID NO. 41255
ggccagcattaaccagcagctcgcacacgcgccgcggccaactccgtgaggccgtccccccgcccgcccgcgccgcgcgagagagagaaccgcagaggagccgggcatgcagcgcctcgcctcctcctcctcccggaggctcctcggggccgcgctcgcccccgcccgggccaactccagcctctccgcggccgtcgccgcggcgcccgcgccggagaatgccgccgctgcgtccccgaagatgccggccttcgactacacgccgccgccctacgacggcccgcgggccgaggagatcttccggaagcgggccgagttcctcagcccgtccctcttccacttctacgaccgccccttgaacatagttgatggaaagatgcagtatttatttgatgaggatggtcgtcgttacctggatgcttttggtggcattgcaacagtttgctgtgggcactgccatcctgatgtggttgaagccatagtaaaccaggcaaagaggatccaacactccacagttctgtatctcaatcatgccattgtggattttgcagagtcattggcatccaaaatgcctggtgatttgaaggtagttttcttcacaaattcaggcacggaggcgaatgagctcgcactgatgattgcacgtctttacactggttgcaatgacattatctccctcaggaatggataccatgggaatgctgctggaacaatgggtgctactgctcaatccaattggaaattcaatgttgttcagacgggagtacaccatgcgcttaacccagacccctacagaggtgcttttggctctgatggggagaaatatgccagagatgttcaggaaatcattcaatttgggactacagggatagttgctggtttcatttcagaagccatacagggggttggtggaatagtggaattagcaccaggatacttgccagcagcatatgatatagtaaggaaagccggtggtctctgcattgctgacgaagttcaggcgggtgttgcacgaactggaagccacttctggggatttgaaggccacggtgttatcccagacatagttaccatggcaaagggtatcgggaatggcataccgataggagccgtcgtgacaacaccggagattgctcaggtgttgacccgtagaagctacttcaacacctttggtggtaaccccgtcagcactgcgggcgggcatgcagttctcaaagtgctggagaaggagaagctccaggagaatgcgtttgttgtaggctcctatctgaaggaacaacttaacaagctgaaagagaagcatgacatcatcggtgacgttagggggaaaggtttccttcttggagttgagttggtgacagaccgcgaaaagaaaacgccagccaaagctgagatctcacatgtcatgaaccacatgaaagatatgggggtgttggttgggaagggtggcttctacgggaacgtgttcaggattacaccgccgttgtgcttcactaaagaggactctgacttcttcatcgatgtgatggatatcgcgctctcgaaactgtgaggcaggctgcgcgaagatgatgccatgtacatctgttgatccgtaaataagaggagattcgcgagacagcacctcgttgtctcgtgatccgtgctcgccagcttcagcttcgtccaatctgctgttcctccttatccagtcgtttaacaactccttgtttgagatcaataataagttctttttctatgttatatgagccctgtatttctgttatccagaaacaaacccctgtggccctgtcactattaggagatgcagatatacggctttacatatgcagtgccaatgctttggctaaacataacgtgcaattcaaaagaaaaagatcgcgtatc

SEQ ID NO: 41255 - protein, 436 aa, Panicum virgatum
  misc_feature: Ceres CLONE 2007138
  misc_feature (40)..(373): Pfam Name: Aminotran_3 Pfam Description: Aminotransferase class-III
  misc_feature: SWISSPROT Homolog: EC 2.6.1.44 Alanine--glyoxylate transaminase
MPAFDYTPPPYDGPRAEEIFRKRAEFLSPSLFHFYDRPLNIVDGKMQYLFDEDGRRYLDAFGGIATVCCGHCHPDVVEAIVNQAKRIQHSTVLYLNHAIVDFAESLASKMPGDLKVVFFTNSGTEANELALMIARLYTGCNDIISLRNGYHGNAAGTMGATAQSNWKFNVVQTGVHHALNPDPYRGAFGSDGEKYARDVQEIIQFGTTGIVAGFISEAIQGVGGIVELAPGYLPAAYDIVRKAGGLCIADEVQAGVARTGSHFWGFEGHGVIPDIVTMAKGIGNGIPIGAVVTTPEIAQVLTRRSYFNTFGGNPVSTAGGHAVLKVLEKEKLQENAFVVGSYLKEQLNKLKEKHDIIGDVRGKGFLLGVELVTDREKKTPAKAEISHVMNHMKDMGVLVGKGGFYGNVFRITPPLCFTKEDSDFFIDVMDIALSKL

SEQ ID NO: 41256 - DNA, 681 bp, Panicum virgatum
  misc_feature: Ceres CLONE 2007146
  misc_feature: Encodes the peptide sequence at SEQ ID NO. 41257
aacaaacgctaaaaaagtaacagtttctgtactttattgggagaccaccactttctcaaccccaacaacactcaagccaaccatgtccaagggagcgtacgaaggcgcgatcggcatcgacctgggcacgacgtactcgtgcgtgggcgtgtggcagaacgagcgcgtggagatcatcgcgaacgaccagggcaaccgcacgacgccgtcgtacgttgccttcacggacacggagcgcctgatcggcgacgccgccaagaaccaggccgcgatgaaccccgcgcacacggtgttcgacgcgaagcgcctcatcggccgcaagttctcggactcggtcgtgcaggcggacgtgaagcactggccgttcaaggtcgtgacgcgcggtgacgacaagccgctcatcgaggtctccttcaagggcgagacgaagcagttcgcgccggaggaggtgtcgtcgatggtgcttgtgaagatgaaggagatcgcggagtcgtacctcggcaaggacgtgaagaaggcggtggtgacggtgccggcgtacttcaacgactcgcagcgcctggcgacgaaggacgcgggcacgatcgcgggcctggaggtgcagcgcatcatcaacgagccgacggcggctgccatcgcgtacggcctggaccgcatgggcgacgcgcaggagcgcaacgt

SEQ ID NO: 41257 - protein, 199 aa, Panicum virgatum
  misc_feature: Ceres CLONE 2007146
  misc_feature (9)..(199): Pfam Name: HSP70 Pfam Description: Hsp70 protein
  misc_feature: Useful for making plants with modulated heat sensitivity
MSKGAYEGAIGIDLGTTYSCVGVWQNERVEIIANDQGNRTTPSYVAFTDTERLIGDAAKNQAAMNPAHTVFDAKRLIGRKFSDSVVQADVKHWPFKVVTRGDDKPLIEVSFKGETKQFAPEEVSSMVLVKMKEIAESYLGKDVKKAVVTVPAYFNDSQRLATKDAGTIAGLEVQRIINEPTAAAIAYGLDRMGDAQERN

SEQ ID NO: 41258 - DNA, 1213 bp, Panicum virgatum
  misc_feature: Ceres CLONE 2007147
  misc_feature: Encodes the peptide sequence at SEQ ID NO. 41259
actaaattcaagaattcccggtttcagagacgcaccgagccaaaaagcaacagaaacccaaacttcccttctaaaggaggagtcaaggcgacgtctacctttgtgtttttttcccttctcacgtcggtcattttgtaaccatcgttcaccatgagcgaccctaacgccagcgaggcggagaagaacatcgagatctggaaggtgaagaaactcatcaagcagctcgaagctgcacgtggaaatggcaccagcatgatttccttgattattccgccaaaggaccaagtctctcgtgcggcaaagatgttggcagaagaatacggtaccgcatccaacatcaagtcgcgagttaaccgtcaatccgtcctttcagccattacctcgacccagcagcgccttaagctctacaacaaggttccccccaacggtcttgtcgtgtactgcggtgaaatcttgacctcggaaggcaaggagcgcaaggtcaatatcgatttcgagcccttcaagcccatcaacacatcgctctacctctgcgacaacaaattccacacggaggctctcgccgagctgctcgagtcggatcagaagttcggttttatcatcatggatggtaacggagcgttgttcggaacgctcagcggcaacactcgcgacatcgtccagaagttttcggtcgatcttcccaagaagcacggtcgtggtggccagtcggcgctgcgttttgcccgtctgagagaggaaaagcgccacaactatgttcgcaaggtcgctgagttggcggtgcagaacttcatcaccaacgacaaggtcaacgttggcggcattgtgctggccggttcggccgatttcaagaatgacctgaacgcttccgacctgttcgaccagcgtctgcaggtcaaggtcatcaaggtcgtcgatgtgtcgtacggtggcgagaacggtttcaaccaggccatcgagctgtcgtccgagacgttgggcaacgtcaaattcatccaggagaagaaactcatcggcaagtacttcgaggagatcagccaggacacgggccgtatttgctacggtattgaggacacgctcaaggcgctggagctgggtgctgttgagacccttattgtctttgagagtctcgagatcaaccgctggactctgaaggacagcaacaacaccgaatacgtgattcacaccaccaagcagcaagaagcgggcaacc

SEQ ID NO: 41259 - protein, 354 aa, Panicum virgatum
  misc_feature: Ceres CLONE 2007147
  misc_feature (8)..(142): Pfam Name: eRF1_1 Pfam Description: eRF1 domain 1
  misc_feature (146)..(278): Pfam Name: eRF1_2 Pfam Description: eRF1 domain 2
  misc_feature (281)..(353): Pfam Name: eRF1_3 Pfam Description: eRF1 domain 3
MSDPNASEAEKNIEIWKVKKLIKQLEAARGNGTSMISLIIPPKDQVSRAAKMLAEEYGTASNIKSRVNRQSVLSAITSTQQRLKLYNKVPPNGLVVYCGEILTSEGKERKVNIDFEPFKPINTSLYLCDNKFHTEALAELLESDQKFGFIIMDGNGALFGTLSGNTRDIVQKFSVDLPKKHGRGGQSALRFARLREEKRHNYVRKVAELAVQNFITNDKVNVGGIVLAGSADFKNDLNASDLFDQRLQVKVIKVVDVSYGGENGFNQAIELSSETLGNVKFIQEKKLIGKYFEEISQDTGRICYGIEDTLKALELGAVETLIVFESLEINRWTLKDSNNTEYVIHTTKQQEAGN

SEQ ID NO: 41260 - DNA, 663 bp, Panicum virgatum
  misc_feature: Ceres CLONE 2007157
  misc_feature: Encodes the peptide sequence at SEQ ID NO. 41261
ggacaaggacaagtgataaagggatgggacctgggaatcaagactatgaaaaagggtgagaacgcggtcttcactatcccaccagtgctcgcctatggtgagactggctcaccaccaacaatcccaccgaacgcgactcttcagttcgatgttgagctcctttcatggggcagcgtcaaggacatctgcaaggatggtggaatcttcaagaagatagttactgaaggggaaaaatgggagaaccccaaggaccttgatgaagttttcgttaagtacgaggggagacttgaggatggaactgtagtgtccaaatctgatggtgttgaatttgccgtcaaagatggttacttctgccctgcccttgccaaggctgtgaagaccatgaagaagggcgagaaggtcctcctcactgtcaaaccacaatatggctttggagaacaaggaagaccagcttctggagatgagggtgctgtgccccccaatgctaccctgcatatagatcttgagctagtatcatggaagactgtgacacttattggagatcgcaagaggatcttgaagaaggttctcaaggaaggtgaaggctatgagcgccctaatgatggagcagtagtgagagtgaggcttattggtaagttggaggatggcactatctttgtaaag

SEQ ID NO: 41261 - protein, 220 aa, Panicum virgatum
  misc_feature: Ceres CLONE 2007157
  misc_feature (76)..(171): Pfam Name: FKBP_C Pfam Description: FKBP-type peptidyl-prolyl cis-trans isomerase
  misc_feature (1)..(54): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
GQGQVIKGWDLGIKTMKKGENAVFTIPPVLAYGETGSPPTIPPNATLQFDVELLSWGSVKDICKDGGIFKKIVTEGEKWENPKDLDEVFVKYEGRLEDGTVVSKSDGVEFAVKDGYFCPALAKAVKTMKKGEKVLLTVKPQYGFGEQGRPASGDEGAVPPNATLHIDLELVSWKTVTLIGDRKRILKKVLKEGEGYERPNDGAVVRVRLIGKLEDGTIFV

SEQ ID NO: 41262 - DNA, 735 bp, Panicum virgatum
  misc_feature: Ceres CLONE 2007169
  misc_feature: Encodes the peptide sequence at SEQ ID NO. 41263
atgaagagaaccgaatcttctgctcctatcttcaacatggaagatatagaagagggctttgaaggttatgaggatgaaagatcactgcttatgtcccagaaaagcttggagaaacgatttggccagtctccaatttttattgcgtccacttttatgactcaaggtggcataccaccttcaacaaatccagcttccctgctaaaggaagctatccatgtcatcagttgtggatatgaggacaagacagaatggggaaaagagatcggatggatatatggctctgttactgaggatattttaactgggttcaagatgcatgcaagaggttggatatccatctactgcatgccacttcgaccttgcttcaagggttctgctccaattaacctttctgatcgtctcaatcaagttttacgttgggctcttggttcagttgaaattctgctcagcagacactgtcctatttggtacggttataatggaaggctaaagcttctggagagattggcgtacatcaacaccattgtttatccaattacatctatcccactaatagcctactgcgtccttcctgctatctgtctacttaccaacaaattcattattcctgaggtaagttcgccagaacccttggcctttatccaccgtattcgaatgccttgcacttatgttctcttgtgctcatgaagttaacaaacaagcacataataaattgatcttcttggttatgtttgc

SEQ ID NO: 41263 - protein, 216 aa, Panicum virgatum
  misc_feature: Ceres CLONE 2007169
  misc_feature: SWISSPROT Homolog: EC 2.4.1.12 Cellulose synthase (UDP-forming)
  misc_feature: Useful for making plants with altered cell wall content and/or composition
  misc_feature: Useful for making plants with modulated biomass
  misc_feature: The sequence is a functional homolog of SEQ ID NO 6 in US patent 7285702
  misc_feature: Useful for making plants with altered carbohydrate content
  misc_feature: The sequence is a functional homolog of SEQ ID NO 26 in US patent 7312377
  misc_feature: The sequence is a functional homolog of SEQ ID NO 2 in US patent 7049481
MEDIEEGFEGYEDERSLLMSQKSLEKRFGQSPIFIASTFMTQGGIPPSTNPASLLKEAIHVISCGYEDKTEWGKEIGWIYGSVTEDILTGFKMHARGWISIYCMPLRPCFKGSAPINLSDRLNQVLRWALGSVEILLSRHCPIWYGYNGRLKLLERLAYINTIVYPITSIPLIAYCVLPAICLLTNKFIIPEVSSPEPLAFIHRIRMPCTYVLLCS

SEQ ID NO: 41264 - DNA, 1586 bp, Panicum virgatum
  misc_feature: Ceres CLONE 2007177
  misc_feature: Encodes the peptide sequence at SEQ ID NO. 41265
aaaccatggcgaggtcagggcgggaaggggagggcgggggcggggaggagcggaggctggtgctgggcaagtacgagctgggccggatgctggggcagggcaccttcgccaaggtctactacgcgcgggacctcagcgccgcggcggcgggctccggctccggctccggcggcggcagcagcgtggcgatcaaggtgatcgacaaggcgcggctgcggcgcacggagggcatggtggagcagctgcgccgggagatctccatcatgcggatggtgcgccaccccagcgtggtgagcatccgggaggtgctcgcctcccgctcccgcgtcttcgtcgtcatggagtacgcccgcggcggggagctcttcgccaaggtggcccgcggccgcctcaccgaggaccacgcccgccgctacttccagcagctcgtcgccgccgtcggcttctgccaccgccgcggcgtcgcgcaccgggacctcaagcccgagaacctgctcctcgacgaggagggccgcctcaaggtcaccgacttcggcctcgccgcgctgcccgagcagctgcgccacgacggcctgctccacacgcagtgcggcaccccggcgtacgtcgcgcccgaggtgctccgcaagcgcggctacgacggcgcccgcgccgacctctggtcctgcggcgtcgtgctctacgtcctgctctgcggctccctccccttccagcacgacaactacgccaagatgtaccagaagatcttcaaggccgactaccaggtgccgccctgggtctccggcgaggcgcgccgcctcatcgctcgcctgctcgtcgtcgaccccgccaagcgcgcctccatcgccgagatcatgctcacgccctggttcaggaagggcttcgtcccgcccgtcctgtcgccccaggtctcgcccaagaaacggctggccgaccaaggcgatgccggcgccctcctcgagggcggcgacgacgacagcgacagcagctccgcctctgtctcgccgcggtcgtgcaacgcgttccagctcatctcctccatgtcctccgggttcgacctgtcggggctgttcgagagcgagcggaaggccgcgacggtgttcacgtcccgcgcgccggcggccgccgtggcggagaagctggagtccgtgggacgcaccctggggttcgaagtcaccaggggcaccaagggctggaatctgcggctggaggtcaaggtcgagggcaccaacgggcggctcgcggtcaccgccgaggtgctggaggtggccgcggacgtggccgtggtggagttcgcgcacgacgccggggacgcgctggacttcaacaagttctgcgcagaggacgtgcgcccggggctcgccgagatcgtctgggcgtggcagggcgacagcccgccggcgccggccgccgtcgccgggtgcgcgtgatgatgaacagagaaagcggccgttgcggcgtccaatctgcgatgtaaaacttctagcggcttggttaggatttgcagttattttttaggatgtaaaattcgtaccttcgttgtacagggagagaagagctgaaccaaagagaggagtttgtagacg

SEQ ID NO: 41265 - protein, 474 aa, Panicum virgatum
  misc_feature: Ceres CLONE 2007177
  misc_feature (23)..(289): Pfam Name: Pkinase Pfam Description: Protein kinase domain
  misc_feature (333)..(392): Pfam Name: NAF Pfam Description: NAF domain
  misc_feature: SWISSPROT Homolog: EC 2.7.11.1 Non-specific serine/threonine protein kinase
  misc_feature: Useful for making plants with modulated biomass
MARSGREGEGGGGEERRLVLGKYELGRMLGQGTFAKVYYARDLSAAAAGSGSGSGGGSSVAIKVIDKARLRRTEGMVEQLRREISIMRMVRHPSVVSIREVLASRSRVFVVMEYARGGELFAKVARGRLTEDHARRYFQQLVAAVGFCHRRGVAHRDLKPENLLLDEEGRLKVTDFGLAALPEQLRHDGLLHTQCGTPAYVAPEVLRKRGYDGARADLWSCGVVLYVLLCGSLPFQHDNYAKMYQKIFKADYQVPPWVSGEARRLIARLLVVDPAKRASIAEIMLTPWFRKGFVPPVLSPQVSPKKRLADQGDAGALLEGGDDDSDSSSASVSPRSCNAFQLISSMSSGFDLSGLFESERKAATVFTSRAPAAAVAEKLESVGRTLGFEVTRGTKGWNLRLEVKVEGTNGRLAVTAEVLEVAADVAVVEFAHDAGDALDFNKFCAEDVRPGLAEIVWAWQGDSPPAPAAVAGCA

SEQ ID NO: 41266 - DNA, 689 bp, Panicum virgatum
  misc_feature: Ceres CLONE 2007183
  misc_feature: Encodes the peptide sequence at SEQ ID NO. 41267
aggcgaccaatggccacgggccggcggctcggcggcgtcgacccgttccggcaaccgcgtcttcccctgccgctgccgccctcgccgcgcgcgcgtgcctcctccgcccccgcccccgccccagcaaagccaacctactcccggtgacccggtcgccgacgcgccggtctctccacccagactacaaatggagctccgcacaagcgcggcccgcggctttgcgtcccccgcttccggccgcggcacggtgccatccccacgcttcctctcccgtctcgtctggagccgatcgacacagtgtactgcctcctccctacaaggccctgttgctaggaggaggagccggttttctactctgatgacgactgcctacaacacagggaccccggatctagttgacttcaattgggatgcccttgggtttcaactggtccctacggacttcatgtatttaatgaggtgttcttcagatggggtgttcacaaagggtgaattggtgccatatggaccaattgagctgaacccagcagctgcagtgttgaattatggtcagggattgcttgaaggtctaagagcacatagaaaagaggatggatcaatccttctttttcgcccacatgaaaatgcattgcggatgagaactggtgcagatcggttatgcatgcctgcaccaagcgtagagcaattcc

SEQ ID NO: 41267 - protein, 167 aa, Panicum virgatum
  misc_feature: Ceres CLONE 2007183
  misc_feature: SWISSPROT Homolog: EC 2.6.1.42 Branched-chain-amino-acid transaminase
  misc_feature: Useful for making plants with modulated nitrogen use efficiency
MELRTSAARGFASPASGRGTVPSPRFLSRLVWSRSTQCTASSLQGPVARRRSRFSTLMTTAYNTGTPDLVDFNWDALGFQLVPTDFMYLMRCSSDGVFTKGELVPYGPIELNPAAAVLNYGQGLLEGLRAHRKEDGSILLFRPHENALRMRTGADRLCMPAPSVEQF

SEQ ID NO: 41268 - DNA, 1759 bp, Panicum virgatum
  misc_feature: Ceres CLONE 2007184
  misc_feature: Encodes the peptide sequence at SEQ ID NO. 41269
agagaggaggaagagctgttgcagcgccgtcggcgggggagcggagcgtgtgggagagcaagaagtcgccgaggtggggcttcagccggaggaacaaggtcggcgtggacgggtcggaggagaggaggttcaagaactcggcggcgagcccgaagggtgcccgcgccggggagccgagcgggccgagccccgcgcggacggtgagcgcgaaggggaggccctggtcgttgcggcggcgcgagaggcggagcgccgggcccgacgcgaaggcggtggtgaggtcgaagcggagctgccgcgggtcgccgcccgccacgaggctcgactggaacggcagcccgagcacgccgatgggcaccttgacccgcatccgcggccggtcgtcgtcgcggaacttgatcgacgccttcatgggcctcgcccactggcgtggcaggaggagatcgccgccgcctgggaccagagcagcgaggagaggggcgcgctccggtcggcttacgccgccgtcagggaaatgatacgcgagctcaaagacgatcctgctcttgcaagttcgatgccgtcatggacaggattgaaaagcttcatgagaaagtgcaaagaccactggagcagctcgtagatggtgaggctctgctggaacttgctaatgttctggtctcatcgaccaaggaggaaaacagaaatgggccgaccccatctgaatttgttacagtcctgctcaggaagtttggtgttacagccacaccgcttaatgattctaatgagtcaatcgactggtcgagtcttggtgctgcaacatcgacattgttcatgacagcaaccgggtgccaaacaatgcatggtccaatggatcttgcaatcaaggaacggaggtgtgtgtttagaagagaatctggccgcttagacagtagacctgcagagcctgatgctttggtgccagaccaggatgaaaggaatgacaccgataagaacatagctgtcatgttcagcctcctagtacatcacaaaagtataaagctggaacatctcattttgaaccggcagtcctttgcacaaaccgttgagaacttatttgcgctctcatttctggtgaaggatgggagagctgagataaacgtggttgatagtggggatcattttgtcgctccaaggaatgctcctgcagctggattgatagcctccaggaaagtgaccaacagccaatttgtgttccggtttgatactgaggactggcagataatgcaacgagtggtcaagccaggagaggaagtaatgcctcacagaagtagttaccatgggggtgaatacaggaacacacaatcatgtcctactcgtgattgcactaagctggtttcagattctgaacatctgaaagaagacaagtttgcaaaagaagacccaacagagttcacagatgacgaagcagtgaagaagttgaccaattggtgctctgaagatgacactccaaagaagaggagaagacagcatgtggctaggaggttgttttctgcagatgactaggaagaaagagcaactgagcaagacgaagcaggctctctgacatagcgagttaacaccattttgaagaaattaaatgcaaagcagttgtaagcatgattaggcagcttttctttccccttttgttcctgctcggaggaaatgatgcttcagagttcagattaactatgtaaattacttgctgtatattgtcctaatgtaagggcatgtgaacatctgccctaaatggctttagttc

SEQ ID NO: 41269 - protein, 319 aa, Panicum virgatum
  misc_feature: Ceres CLONE 2007184
  misc_feature (1)..(241): Pfam Name: Nse4 Pfam Description: Nse4
MDRIEKLHEKVQRPLEQLVDGEALLELANVLVSSTKEENRNGPTPSEFVTVLLRKFGVTATPLNDSNESIDWSSLGAATSTLFMTATGCQTMHGPMDLAIKERRCVFRRESGRLDSRPAEPDALVPDQDERNDTDKNIAVMFSLLVHHKSIKLEHLILNRQSFAQTVENLFALSFLVKDGRAEINVVDSGDHFVAPRNAPAAGLIASRKVTNSQFVFRFDTEDWQIMQRVVKPGEEVMPHRSSYHGGEYRNTQSCPTRDCTKLVSDSEHLKEDKFAKEDPTEFTDDEAVKKLTNWCSEDDTPKKRRRQHVARRLFSADD

SEQ ID NO: 41270 - DNA, 694 bp, Panicum virgatum
  misc_feature: Ceres CLONE 2007185
  misc_feature: Encodes the peptide sequence at SEQ ID NO. 41271
ctcatcacttgttcattattgtgtatctggcgctcattgttcatggccagtgcctgtacctcattcatgtctggtacagaaaaacgacatggatgtatctggcggtgcctgtttgcttgtatgtaggggagagggtgctgaggttcttcaggtctggcagttattctgtcaggttattgaaggtggccatatatcctggtaatgtcttgacactgcaaatgtccaagcctcctgctttccggtacaagagtgggcaatatatgtttgttcaatgtccagcagtgtcaccctttgaatggcatcctttctcaattacttcagcgcccggagatgattatctcagcattcacgttagacaacttggtgactggacacgagagctcaagagggtatttgcagcagcttgcgaacccccagtgggtggtaaaagcggccttcttagagcagatgagacaaccaagaaagccttaccaaagcttctgattgatggaccttatggctctcctgctcaggattacagcaagtatgatgttcttctacttgttggattaggaattggtgcaactccttttatcagcatattgaaagatctgcttaacaatatcatcaaaatggaggaagatgaggatgcttccactgatctttatccaccagttggtccaaataagccgcacattgatctgggcacacttat

SEQ ID NO: 41271 - protein, 230 aa, Panicum virgatum
  misc_feature: Ceres CLONE 2007185
  misc_feature (53)..(169): Pfam Name: FAD_binding_8 Pfam Description: FAD-binding domain
  misc_feature: SWISSPROT Homolog: EC 1.6.3.1 NAD(P)H oxidase
HHLFIIVYLALIVHGQCLYLIHVWYRKTTWMYLAVPVCLYVGERVLRFFRSGSYSVRLLKVAIYPGNVLTLQMSKPPAFRYKSGQYMFVQCPAVSPFEWHPFSITSAPGDDYLSIHVRQLGDWTRELKRVFAAACEPPVGGKSGLLRADETTKKALPKLLIDGPYGSPAQDYSKYDVLLLVGLGIGATPFISILKDLLNNIIKMEEDEDASTDLYPPVGPNKPHIDLGTL

SEQ ID NO: 41272 - DNA, 700 bp, Panicum virgatum
  misc_feature: Ceres CLONE 2007186
  misc_feature: Encodes the peptide sequence at SEQ ID NO. 41273
ccaccccaccccacaggcacagcagccgccggcgccgccgccgcagaccgacccgaggcgagcacggaagcggcgattcgccgacgctccttcagatcttcggcgagccgtgactgagacctctgctgccgtccgccgagcagtttaatcttcacctgcagccatgggtaaggagaagtcccacatcaacatcgtggtcattggccacgtcgactccggcaagtcgaccaccaccggccacctgatctacaagcttggaggcatcgacaagcgtgtgatcgagaggttcgagaaggaggctgcggagatgaacaagaggtccttcaagtacgcgtgggtgcttgacaagctcaaggcggagcgcgagagaggtatcaccattgatatcgccctgtggaagttcgagaccaccaagtactactgcacggtcattgatgcccctggacaccgtgacttcatcaagaacatgatcacgggtacctcccaggctgattgtgctgtccttatcattgactccaccactggtggttttgaggccggtatctccaaggatggccagacccgtgagcatgctctccttgctttcactcttggagtcaagcagatgatctgctgctgcaacaagatggatgccaccactcccaagtactccaagggccgttatgatgagattgttaaggaagtctcctcctacctgaag

SEQ ID NO: 41273 - protein, 178 aa, Panicum virgatum
  misc_feature: Ceres CLONE 2007186
  misc_feature (5)..(178): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKGRYDEIVKEVSSYL

SEQ ID NO: 41274 - DNA, 708 bp, Panicum virgatum
  misc_feature: Ceres CLONE 2007208
  misc_feature: Encodes the peptide sequence at SEQ ID NO. 41275
attcgtctccctcctccattctcccgtttgcttgattgattggcgagcaaccaccccacaaccgcggcagcaatcccctcgccatctccgcgtcgcggaatcccttcgccattgccgaggaggcggggtcgccgcggcgggaggtggtgttccggatctcggatggcgtcggcgaagtcgtcgcggtcgcggccggcgggccactcgggggtgttcccggtgggcagcgccgcggcggtggggagcagcgggggcgggggaggcggcggcggcggcggcgacggcggggtgcagctcgccgacaagctcaagatcttcaagaccgacaacttcgatcccgacgcctacgtgcagtccaagtgccagaccatgaacgagaaggaaatacgacatttgtgttcttatctgcaagacttaaagaaagcttcggctgaagagatgcgcaggagtgtttatgcaaattatgcttcgtttatcagaacatcaaaggagatttcggaccttgaaggggagctactgtcaattagaaatctgcttaatacacaggcagctttaattcatggtctgtctgaaggagttcagatagattcattgacatcaggccctgaaggttccgcagaagacgacatatccaatgttgaagatcaggagcctttccgaaattcagaaatggtctgcagattttcctgacatgcttgacgttttgct

SEQ ID NO: 41275 - protein, 175 aa, Panicum virgatum
  misc_feature: Ceres CLONE 2007208
  misc_feature (52)..(138): Pfam Name: Vps51 Pfam Description: Vps51/Vps67
MASAKSSRSRPAGHSGVFPVGSAAAVGSSGGGGGGGGGGDGGVQLADKLKIFKTDNFDPDAYVQSKCQTMNEKEIRHLCSYLQDLKKASAEEMRRSVYANYASFIRTSKEISDLEGELLSIRNLLNTQAALIHGLSEGVQIDSLTSGPEGSAEDDISNVEDQEPFRNSEMVCRFS

SEQ ID NO: 41276 - DNA, 1946 bp, Panicum virgatum
  misc_feature: Ceres CLONE 2007210
  misc_feature: Encodes the peptide sequence at SEQ ID NO. 41277
acactgctcccacgccgaagcaccaccaccaaggcccaagcagctgctcattagtgagctagaagtagctagctagaaagaacaatggctgccggcggcggcggcatggccgacgagaaggcgcccgaggcgttcgggctgagccggcacgtggcggaggcggagatggaggaggagcacggcggtgctggtggcggcgagtcgtccagcgtcaagtcgaagctgtccgggctgctgtggcacggcgggtcggcgtacgacgcctggttcagctgcgcctccaaccaggtcgctcaggtcctcctgacccttccctactcgttcgcccagctgggcatgctgagcggcatcctgttccagctcttctacggcctgatgggcagctggacggcgtacctgatcagcatcctgtacctggagtaccgcacccggaaggagcgcgacaaggtggactaccggaaccacgtgatccagtggttcgaggtcctggacgggctgctgggccgccactggcgcaacgccggcctcgccttcaactgcaccttcctcctcttcggctccgtcatccagctcatcggctgcgccagcaacatctactacgtcaacgaccgcctcgacaagcggacgtggacctacatcttcggcgcctgctgcgccaccaccgtcttcatcccctccttccacaactaccgggtctggtccttcctcggcctcgtcatgaccacctacaccgcctggtacatcgccgtcgcctcgctcctccacggccaggtcgagggggtcgcgcactcggggcccaccaggatcgtcctctacttcaccggcgccaccaacatcctctacacattcggcggccacgcagtcacagtggagatcatgcacgcgatgtggcgtccccagaagttcaagtccatctacctgctggccacggtgtacgtgctgacgctgaccctgccgtccgccgccgccgcgtactgggcgttcggcgacgcgctgctgacccactcgaacgcgctggcgctgctgccgcgcacgcccttccgcgacgccgccgtggtgctcatgctcatccaccagttcatcaccttcgggttcgcgtgcaccccgctctacttcgtctgggagaagctcatcggcctccacgactgccgcagcctctgcaagcgcgccgccgccaggctccccgtcgtcgtgcccatctggttcctcgccatcatcttccccttcttcgggcccatcaactccgccgtcggctcgctcctcgtcagcttcaccgtctacatcatcccggcgatggcgcatatggtcaccttcaggtcgccgcagtccagggagaacgcggtggagcggccgccgaggttcgccggagggtggacgggcgcgtacgtgatcaactccttcgtggtggcgtgggtgctggtggtcggcttcggcttcggcggctgggccagcattaccaacttcgtgcagcaggtcaacaccttcggcctcttcgccaagtgctaccagtgcccgccgcacctcgctgccccgccgccgcccatggccccggcccccgccatgccaccggcgacggccttcaacgccaccgggttcttccctccggtcccagccccagctccggcgccgtcgcccatgatgaacttcttcctccgccaccaccaccacaggcaccacggccgccatggcctgtgatcgacatggccgcctcaagttaatctggcagattagtatatgttctccgttcgagtttgctgtagttgtagtgctactgcctacttgttgatgggcagcagcgaggttgttcaaggtagccctagtaaaaattcctttgttctactactctatgccaccatctcttcatgttgagagataaaagagagtctggggcggctaggtacctcgagctttgtaccggtagcatgcatttcaagcagagatgtgat

SEQ ID NO: 41277 - protein, 536 aa, Panicum virgatum
  misc_feature: Ceres CLONE 2007210
  misc_feature (53)..(447): Pfam Name: Aa_trans Pfam Description: Transmembrane amino acid transporter protein
MAAGGGGMADEKAPEAFGLSRHVAEAEMEEEHGGAGGGESSSVKSKLSGLLWHGGSAYDAWFSCASNQVAQVLLTLPYSFAQLGMLSGILFQLFYGLMGSWTAYLISILYLEYRTRKERDKVDYRNHVIQWFEVLDGLLGRHWRNAGLAFNCTFLLFGSVIQLIGCASNIYYVNDRLDKRTWTYIFGACCATTVFIPSFHNYRVWSFLGLVMTTYTAWYIAVASLLHGQVEGVAHSGPTRIVLYFTGATNILYTFGGHAVTVEIMHAMWRPQKFKSIYLLATVYVLTLTLPSAAAAYWAFGDALLTHSNALALLPRTPFRDAAVVLMLIHQFITFGFACTPLYFVWEKLIGLHDCRSLCKRAAARLPVVVPIWFLAIIFPFFGPINSAVGSLLVSFTVYIIPAMAHMVTFRSPQSRENAVERPPRFAGGWTGAYVINSFVVAWVLVVGFGFGGWASITNFVQQVNTFGLFAKCYQCPPHLAAPPPPMAPAPAMPPATAFNATGFFPPVPAPAPAPSPMMNFFLRHHHHRHHGRHGL

SEQ ID NO: 41278 - DNA, 1689 bp, Panicum virgatum
  misc_feature: Ceres CLONE 2007222
  misc_feature: Encodes the peptide sequence at SEQ ID NO. 41279
atcgaacaaagacctgccctacaaccgagagcacggtcatcgccgttcaatctgcagattttatcgactttgggttccgctctgcaggaaatcgctagttgactttcactgctcaatcattgacgatcgccgaatcgaaaccagcctcgactccagccatcaccatgtcggacgccaactcaccagccgcctcgcgggctgggtcggccgaaccaacccgccaggatgagcatcaagatagccctgcggatgtgcaggatgccgccgacgccggcaatgaatccgacaaggactccgacctcctctccgaaatcgatgaagatcagttcgaggactacgatcccactctggaagagagacccgtcgagatcgacgagaatgtcgccaagactctgaaagccgcaaagcgcaagcggacagatgccgagacagtcaagaagccaaaagagggccgccgacccaagaagcgggcgcgagcggctgaggatgatggtggcgatgtcgaggacggcgagcgcaggcccagaaaggcgcgcgctgcgggcggcgagcggcgagctgcgcggaaggaggccacaccggaggagcaagtaaatgaagaggaccttacccccgaggagcggcggcgccgggcaattcagcgggctatggataacgcgctgaagaaccccacgaagcggaggcgcaagaaggacgatatcgacctcgaagaggagattgacgaccagctcgccaacctcaaggtcgccatggagaaggcctgcctggcggacaacgaagcccgcgagaaaggcatggccgccacccagaagctccagctactccctcaagtcaccgcgcttctcaaccgaacctcgatccaagattccgtcctcgaccccgagaccaacttcctccagtcggtcaaatacttcctcgagccgctgaacgacggcagcctgcctgcctacaacatccagcgcgacatcttcaatgctctcgccaagctacccatcaacaaggaagtccttctgagcagcggcatcggcaaggtcgtctacttttacaccaggagcaagcgccccgagcccagcatcaagcgcatcgccgagcgactcgtcggcgagtggagccgtccgatcctgaagcgaacagacgactacaagaagcgccacatcgagacgcgcgactttgattttgccgccgcgaaactagcccaacgccaagaagccgccgtgtccggctcacaaatgacactcgcccagcggcccgcgggcggcaagacgcgcttcgagctggagcgcgagcgcgcccttgcccccgagatcaagcgcgccaaccgtgcccaacccgcaggcctgccggccagttacaccatcgccccgcgcagcacgttcgacccgtcgcgcagcgcggcagagttccgccccgctggggctgcgggcatggacgcgttcaggaagatgacgcagaaggggaagggcggcgggcgtcgttagttgtgggagggccgtcggtgatactgggttggggagttggcttgccgtttctcttttggcttttggtgagagaggtgggtgggatggtgataaagggtgcttttgccctgactgggattggactttgggggtatggacgttgggtcttgactggcagacatattcataaccctggaatcagagggatgcaggaggcgtttctccttggcag

SEQ ID NO: 41279 - protein, 437 aa, Panicum virgatum
  misc_feature: Ceres CLONE 2007222
  misc_feature (187)..(436): Pfam Name: IWS1_C Pfam Description: IWS1 C-terminus
MSDANSPAASRAGSAEPTRQDEHQDSPADVQDAADAGNESDKDSDLLSEIDEDQFEDYDPTLEERPVEIDENVAKTLKAAKRKRTDAETVKKPKEGRRPKKRARAAEDDGGDVEDGERRPRKARAAGGERRAARKEATPEEQVNEEDLTPEERRRRAIQRAMDNALKNPTKRRRKKDDIDLEEEIDDQLANLKVAMEKACLADNEAREKGMAATQKLQLLPQVTALLNRTSIQDSVLDPETNFLQSVKYFLEPLNDGSLPAYNIQRDIFNALAKLPINKEVLLSSGIGKVVYFYTRSKRPEPSIKRIAERLVGEWSRPILKRTDDYKKRHIETRDFDFAAAKLAQRQEAAVSGSQMTLAQRPAGGKTRFELERERALAPEIKRANRAQPAGLPASYTIAPRSTFDPSRSAAEFRPAGAAGMDAFRKMTQKGKGGGRR

SEQ ID NO: 41280 - DNA, 419 bp, Panicum virgatum
  misc_feature: Ceres CLONE 2007225
  misc_feature: Encodes the peptide sequence at SEQ ID NO. 41281
ttgtggcaatgtccatagtatttactggaaatccgaagatgacgtaagcgttgctggtctgggaggtgaatcagaggtccatccttacgtctcctttaccataaactttgtctgaacccagtatgtggcctattgtctgccaatattttgaagcagctattaccttgagtaatcgaaacaaacgaatggttcatgtatattacttgtgatacgccaattctttcttgatttgtcgctcttctctggtcctgtaatttatgttggagagatctgccgatcaataatgtagcttttgaggaaactgaaatatgttgtggctgaagaagagatccatcaccttgtaaagcttctgtggatatttttgtaacattgggctactggatttatactgtaataaagccgtgtcaaataaatcctgg

SEQ ID NO: 41281 - protein, 37 aa, Panicum virgatum
  misc_feature: Ceres CLONE 2007225
  misc_feature: SWISSPROT Homolog: EC 3.6.3.14 H(+)-transporting two-sector ATPase
CGNVHSIYWKSEDDVSVAGLGGESEVHPYVSFTINFV

SEQ ID NO: 41282 - DNA, 682 bp, Panicum virgatum
  misc_feature: Ceres CLONE 2007226
  misc_feature: Encodes the peptide sequence at SEQ ID NO. 41283
acttcccaacaacatcgccgttgcacttcaggattccaagctatcacccacagacagccacattactatagccatggcggcgagctcggaccaaacaagcatcaacgtcctcctcgtcccgttcccggtccagggccacatcaacccgctgctccagttcggcaagcggctcgccagccacggaggcgtccggtgcaccctcgcggcgacccgcttcgtcgccaactccaccaggccgaccccgagctcggtgcacgtcgccgtcttctccgacggctgcgacggcggcgggcccgacgaggtcggggggatgggcgccccctactacgagcgcctcgagtcggccgggtccgcgacgctggacgcgctcctcgcttcggagtcggagcggggccggccggtgcacgtggtggtgtacgacgcgttcctgccgtgggcgcggcgtgtggggaggcggtacggtgcggcgtgcgcggcgttcctcacgcagacgtgcgccgtggacatcctgtacgcgcacgcctgggccggccgcgtgccgccgccgccgctgctgcgggcggaggacgtgcggggcctgggcgggctgtcgtgccggctcgaggtgggcgacctgccgacgttcctgaccgacgctagctaccccccgtcgttcagggagctgctggtgaaccagttcctg

SEQ ID NO: 41283 - protein, 202 aa, Panicum virgatum
  misc_feature: Ceres CLONE 2007226
  misc_feature: SWISSPROT Homolog: EC 2.4.1.121 Indole-3-acetate beta-glucosyltransferase
MAASSDQTSINVLLVPFPVQGHINPLLQFGKRLASHGGVRCTLAATRFVANSTRPTPSSVHVAVFSDGCDGGGPDEVGGMGAPYYERLESAGSATLDALLASESERGRPVHVVVYDAFLPWARRVGRRYGAACAAFLTQTCAVDILYAHAWAGRVPPPPLLRAEDVRGLGGLSCRLEVGDLPTFLTDASYPPSFRELLVNQF

SEQ ID NO: 41284 - DNA, 1621 bp, Panicum virgatum
  misc_feature: Ceres CLONE 2007231
  misc_feature: Encodes the peptide sequence at SEQ ID NO. 41285
cgtgctgcgacctgcgacccgcgagccggcaaaacaaaggctacgacgaccaaacggcgtggccgccgcgtgcgcgggtacggtgagcctgcacctgcccgcggcctgccggatgccgccgagagaccgagaggagaatcgaagagaatacccatcactagctagatgccacgaggcccagaggagaaggggtggcgaggatggccggggctgacggcggcgaacgcccgcggcttggcctatatatgagaggccgtggatcgtatccgagcagccgcaggccattccattccagggccaggccagcagcttccgttagccgcccgcccggcctttcccaccaccggagcgcgagatgggtgctcgcggcctccctcgggctctgccttccgcgccggcggcggcgctcctcctcctcctctgcctggtggtcgcgccggcggcggcgcgcgggcacagcagggaagacgacgctcccaccggcaccggcggcggctgcaacagcggcggcggcggcacggccccgccgcggctgtgggtgttcggggactcgtacgcggacacggggaacctgggcgacctcgggcgggagctgacgcacgcgtggtacgacccctacggcgacaccttccccggccgccccaccggccgcttctccgacggccgcgtcctcaccgacttcgtagcttcggccatggggatgccgacgccggtggcgtacaagctgcgcaggggcgccgcccaggggctcctcgcgcgcggcatgaacttcgccgtcggcggcgccggcgtgctcgacaccggcaacttccagcgcaacatcagtgcccagatcgacctgttccaggcccaggcgcagcgcggcgctccctccagcaaccgcggctgcgccggcgccggcgtcgcgctcgtcgtcgtctctggcaacgactactcctacgccgccgacaaggacaacggcacgagcgcggcgatcgcgtacatcccgacggtggtgcggcagctccgggagcagctccggcggctgcgcgacgaggccgggatgcgccgggtggtggtcaccggcctgcacccgctcgggtgcacgccgctcttcacccgcccgctcaactacagcggctgcgacccgctcgccaacgccggcgccgcccagcacaacgccgcgctccggtccgtgctcgccgcgctcgacccggccaaccgcaccttcctcctcctcgacctcaacgcgcccttcgccgccctcgtcgacgctccgccgggggggaggttcgccgagcagaggcggccgtgctgcgaggccctcgccgccgacggctactgcggccagcaggacgacgacggcaagaggatgtacacgctgtgcgacgaccccgcagagcacttctactgggacgacgtgcacccgacgcaggcggcatgggccgccgtcgccgaggctttcaggcccaagatccgcgagtttctcctctccacctgaccagaccttggattccgactattttttgttctgccggggataaaaaaaatgcgcaaaagaaacgcccaaagctaacaaaatgttcttggtctgtctaccagaatcatcatattagtgaaattctactgttactgttcctct

SEQ ID NO: 41285 - protein, 374 aa, Panicum virgatum
  misc_feature: Ceres CLONE 2007231
  misc_feature (60)..(363): Pfam Name: Lipase_GDSL Pfam Description: GDSL-like Lipase/Acylhydrolase
  misc_feature: SWISSPROT Homolog: EC 3.2.1.51 Alpha-L-fucosidase
MGARGLPRALPSAPAAALLLLLCLVVAPAAARGHSREDDAPTGTGGGCNSGGGGTAPPRLWVFGDSYADTGNLGDLGRELTHAWYDPYGDTFPGRPTGRFSDGRVLTDFVASAMGMPTPVAYKLRRGAAQGLLARGMNFAVGGAGVLDTGNFQRNISAQIDLFQAQAQRGAPSSNRGCAGAGVALVVVSGNDYSYAADKDNGTSAAIAYIPTVVRQLREQLRRLRDEAGMRRVVVTGLHPLGCTPLFTRPLNYSGCDPLANAGAAQHNAALRSVLAALDPANRTFLLLDLNAPFAALVDAPPGGRFAEQRRPCCEALAADGYCGQQDDDGKRMYTLCDDPAEHFYWDDVHPTQAAWAAVAEAFRPKIREFLLST

SEQ ID NO: 41286 - DNA, 1939 bp, Panicum virgatum
  misc_feature: Ceres CLONE 2007244
  misc_feature: Encodes the peptide sequence at SEQ ID NO. 41287
gacgcacacgatgaccgcaacaaacgaagctggaggagacatgtcggagttgaaagactccgaagccaatgaaagtgtcgcccacggacatcatcatgcacattttccgtcaatgccggccgttacgatggcaacagaagccaccgctgagtcccctgacccgtcgccgcttccggacctcacgactcagttccagaatcctctcgggtatgcaacgttcgcagatggatacgaactgattgcagagatcggaaagagtgacttcgatgtcgtttaccgcgcccgatgcctcgccaactcgagtctgaaggacgctgctgtcaaagtaattgatcttgacagactgcgggcaacagcgactcaactctccgaagaactcaagctgatgagcggacttcaacaccccagtctcgcttctgttcatacgtgctttatcgatggggtggacctctgggttgtgatgcctttgtttgaaggaggatcttgcgctcgaattctgcaaaccatagctcccgatggtattcgtgacgaatgcgtaattgcaactgtgctgcgagaagctgtgcttgggctccagttcatgcactctcacggcctctgtcaccgaggagtcaaggctggcaacatcctgctgaccgcccaaggcaatgttcgattgagtgacccttgcttgtccccatgccgcatcgcatcggatggcggggacgagcagccgtctcatgagtacctgtgttggatggcacccgagtgtgtgcaagcttccgaaccctctgctcctcaacccagtgctgatatttgggcagttggtatcacagctttggagctcgcctttggctctgcaccttattcttcgcaaccaccgatgaaagtgatgctgcgcctccttggagaggacccgccaagcgcagaatcctacgcccgtccggatcgtgagctcagcaaggagctcacgtcattcatccgtcgctgtctcaaaaagtctccagagaagcgaccgtcggcggcagatttgttggctggcccgttcctttcaacgtttgctcgggacagccagtatctggtggaccatgtgatcctgcggctgccgcacaactacatgagcagtcagcccgacgcgcctcccgtgcactcaaagcgccgctccagaccgcacagggaacgcgcctcctccttcgctggccggcccggcgtgcctattgcgctcaccccgacccgcgccgagcacatggggtcagtcgcacccttcaacgcgggcaaatggctaaccgcagcctcagggcacgcaggcgactccctgtccccgcactccgccagcctccaagtgcgcagctcgagcgtcggggaaaccaaggaggctggcgtgcgctcaccgcctcagcagttccggaagccggcttcctcgaccgacctcggcgccgactccgaacccgaggcgatgacccctcgggacgacactgtgcaccagccggccgtcccgcccatcctcgagctgcccgagtcgcacgcggtctactcgcacgaacactcggagcactccgcgcgcgagcccggcacgccgcgtgactcactgatccagtccgcatctactgactcgcatccgctctcagtcgcgctcttctccccgggcgaaaccgtcgacggcctctactcgccctcgacagtggccggcatcgtatcgcctgcggtgcggcacgccacagccccaacgctgcccccgcccatccccttacagagcctcgacggctccttgcgccctccgcccgcctcgctattgggccagttcgctgccgagtcgtcagatctcaccgagccctcgcccccgccacagtccggccagtcgagccccccgccaccggacctggattctgcccgcgcaagtccggactcttccaaccttccatcctcataactcattgcgaatacactcgacattttgatc

SEQ ID NO: 41287 - protein, 593 aa, Panicum virgatum
  misc_feature: Ceres CLONE 2007244
  misc_feature (35)..(301): Pfam Name: Pkinase Pfam Description: Protein kinase domain
  misc_feature: SWISSPROT Homolog: EC 2.7.11.1 Non-specific serine/threonine protein kinase
MATEATAESPDPSPLPDLTTQFQNPLGYATFADGYELIAEIGKSDFDVVYRARCLANSSLKDAAVKVIDLDRLRATATQLSEELKLMSGLQHPSLASVHTCFIDGVDLWVVMPLFEGGSCARILQTIAPDGIRDECVIATVLREAVLGLQFMHSHGLCHRGVKAGNILLTAQGNVRLSDPCLSPCRIASDGGDEQPSHEYLCWMAPECVQASEPSAPQPSADIWAVGITALELAFGSAPYSSQPPMKVMLRLLGEDPPSAESYARPDRELSKELTSFIRRCLKKSPEKRPSAADLLAGPFLSTFARDSQYLVDHVILRLPHNYMSSQPDAPPVHSKRRSRPHRERASSFAGRPGVPIALTPTRAEHMGSVAPFNAGKWLTAASGHAGDSLSPHSASLQVRSSSVGETKEAGVRSPPQQFRKPASSTDLGADSEPEAMTPRDDTVHQPAVPPILELPESHAVYSHEHSEHSAREPGTPRDSLIQSASTDSHPLSVALFSPGETVDGLYSPSTVAGIVSPAVRHATAPTLPPPIPLQSLDGSLRPPPASLLGQFAAESSDLTEPSPPPQSGQSSPPPPDLDSARASPDSSNLPSS

SEQ ID NO: 41288 - DNA, 1208 bp, Panicum virgatum
  misc_feature: Ceres CLONE 2007251
  misc_feature: Encodes the peptide sequence at SEQ ID NO. 41289
gttccacttcggatcttgaaggtgtcaatggctctctacaacttcaaaaagattcaagttgtcccaaatggcaaagagttcatggacattgttttgacacgaacccaaaggaaaacccccacagtcgtccaccctggttatgcgatcagccgaatccgtaagttttacatgagaaaggtcaagtatacccaatcgaccttgcatgacaaactgtcacaaattttgactgactttcctgtccttgatcaaattcaccccttttatggcgatttgatgaacgtcctttatgacaaagatcactacaaacttgctcttggccaattaagcacagcacgacatcttattgacaccattgcaaaggattacctccgtttgttgaaatttggtgattctttgtaccgttgtaaacaattgaaacgtgctgctcttggaagaatgatgaaagtactcgtcaaaaatggtacttccctctcttatcttgaagaagtccgtcaacatcttgctcgtcttccatccattgacccgaataccagaactctcctcgtttgtggatatccgaatgtaggaaaaagttctttcatcaacaaaatcaccagagccaaagttgatgttcaaccttatgcattcaccacaaaatcattatttgttggacacatggattaccgattttctagatggcaagtcattgataccccgggaattcttgaccatcctctagaagaacgaaatacaattgaaatgcagtctgttaccgcccttgctcacctcagagcctcagttttgttctttattgatatttctgaaagttgcggatacaacattgaacaacaatgcaatttatttcacagcttacgccctcttttcaataacaaaccattgcttcttattatgacaaaaactgatttaatagatccaaattctttatccccacataacagaaaattaatcgaagaagcatcgaaagacgaaaatgttcatttactcccgatgagtactctctcagaagacggagttagtgatgtcaaaaaaactgcttgcgagttattacttgcacagagagttcaaattagattaaaaggaagtaaaatgggagatattggcaatagaatgcacttggctgagcctgtcgcaagagataaaaattgaaaagacctccctcaaattccagattcagttatggctggacaaaaaaaaagttgctgaaaaaa

SEQ ID NO: 41289 - protein, 372 aa, Panicum virgatum
  misc_feature: Ceres CLONE 2007251
  misc_feature (235)..(292): Pfam Name: NOG1 Pfam Description: Nucleolar GTP-binding protein 1 (NOG1)
  misc_feature (169)..(292): Pfam Name: MMR_HSR1 Pfam Description: GTPase of unknown function
MALYNFKKIQVVPNGKEFMDIVLTRTQRKTPTVVHPGYAISRIRKFYMRKVKYTQSTLHDKLSQILTDFPVLDQIHPFYGDLMNVLYDKDHYKLALGQLSTARHLIDTIAKDYLRLLKFGDSLYRCKQLKRAALGRMMKVLVKNGTSLSYLEEVRQHLARLPSIDPNTRTLLVCGYPNVGKSSFINKITRAKVDVQPYAFTTKSLFVGHMDYRFSRWQVIDTPGILDHPLEERNTIEMQSVTALAHLRASVLFFIDISESCGYNIEQQCNLFHSLRPLFNNKPLLLIMTKTDLIDPNSLSPHNRKLIEEASKDENVHLLPMSTLSEDGVSDVKKTACELLLAQRVQIRLKGSKMGDIGNRMHLAEPVARDKN

SEQ ID NO: 41290 - DNA, 710 bp, Panicum virgatum
  misc_feature: Ceres CLONE 2007268
  misc_feature: Encodes the peptide sequence at SEQ ID NO. 41291
cttccattttcgtcgaatcccaggtcttaccaatttaattctttaaggttcttgctccccacttccgcaattggagccacctgcttccgattcctctttctgcagtcgtggagttgtcaaagattcagatttcttgctcctccgcagcaacttgacagggtccgagtgccggagggcggcagctggtagtttccatggttcttggtttgctgctgctggggtggagataacacgggggaggagattgggggcaggcggcgggcgcgcgggatgatggagccccaggcggtggacctcgaggatgacagcatcaacttctgggcttccctcggcgtcaacccccatgtcgaccagatgccgctgcacaacgtccacatcgtcgaccaccaggctcagccaccgccggccgcggcagcggcacagccacagtccgtctgcagggacctcttcccagttgaggccgacgcttgcctggaacctcggttggggatggagtttgagtctggcgaggctgccaaaaccttctacattgcttacgccggccgtgttgggttctccatccgcattgcccggtcgcgcaagtccaagtgcagtgagtccattatcatgctacgattcgtgtgctcgagggaagggttcagcaaggagaaacgctccgtcgcagctgggacgaagacgaggaagcggcccgcctccattagggagggctg

SEQ ID NO: 41291 - protein, 146 aa, Panicum virgatum
  misc_feature: Ceres CLONE 2007268
  misc_feature (84)..(146): Pfam Name: FAR1 Pfam Description: FAR1 family
MMEPQAVDLEDDSINFWASLGVNPHVDQMPLHNVHIVDHQAQPPPAAAAAQPQSVCRDLFPVEADACLEPRLGMEFESGEAAKTFYIAYAGRVGFSIRIARSRKSKCSESIIMLRFVCSREGFSKEKRSVAAGTKTRKRPASIREG

SEQ ID NO: 41292 - DNA, 713 bp, Panicum virgatum
  misc_feature: Ceres CLONE 2007278
  misc_feature: Encodes the peptide sequence at SEQ ID NO. 41293
aatccagtcacatggatactatgcactaaggcggctctctcagcgagcctgtcgaggccaaatggctgcgagagccgccgccgccgccatgctgccatgcctcctcctgctcccgtttctccttctagctgctgcttccggcgccgccaacgatgcagccggcagcacgccgccgatcagccggaaaagcttccctgagggcttcgtcttcgggacggcctcgtcggcctatcagtatgaaggtggtgctaaggaagggggcagaagaccaagtatctgggacactttcacccaccagcatccagaaaaaatcgctgacggaagcaacggggatgtagcagtggactcctaccatctttacaaggaagatgtgcgcctcatgaaggacctggggatggatgcgtacaggttctccatttcatggagcagaatccttccaaatggcagtctgagcggtggaattaatagggaaggtgtcaattactacaataatctcattaatgagctcctgtccaaaggaatgcaaccctatgtgaccctttttcactgggacacacctcaggcattagaagataaatatgagggatttcttagccccaatattgtaaatgacttcaaggactatgctgacgtctgcttcaaggagttcggtgatcgagtgaagcactggatcaccttcaacgagccctggacgttctgcgtaatgggctact

SEQ ID NO: 41293 - protein, 217 aa, Panicum virgatum
  misc_feature: Ceres CLONE 2007278
  misc_feature (40)..(217): Pfam Name: Glyco_hydro_1 Pfam Description: Glycosyl hydrolase family 1
  misc_feature: SWISSPROT Homolog: EC 3.2.1.21 Beta-glucosidase
  misc_feature: Useful for making plants with altered cell wall content and/or composition
  misc_feature: Useful for making plants with altered carbohydrate content
  misc_feature: Useful for making plants with modulated biomass
  misc_feature: Useful for making plants with modulated flowering time
MAARAAAAAMLPCLLLLPFLLLAAASGAANDAAGSTPPISRKSFPEGFVFGTASSAYQYEGGAKEGGRRPSIWDTFTHQHPEKIADGSNGDVAVDSYHLYKEDVRLMKDLGMDAYRFSISWSRILPNGSLSGGINREGVNYYNNLINELLSKGMQPYVTLFHWDTPQALEDKYEGFLSPNIVNDFKDYADVCFKEFGDRVKHWITFNEPWTFCVMGY

SEQ ID NO: 41294 - DNA, 724 bp, Panicum virgatum
  misc_feature: Ceres CLONE 2007296-R
  misc_feature: Encodes the peptide sequence at SEQ ID NO. 41295
gcagagcccaaaaaaataggaataccacatttaagaaacgtattaatagcatactcaagacgagcaactcatatcggttactgtcaagcaatgaacatagtgacggctactttgtgcttttatatgcaggaagaagaggctttctggactctttctgctatttgtgaggatattgtaaaagattattatcttgaaggactccaattaattggatcaattgttgatttgaatacattcgtctctctggttgcccactacttcccagaactaaacaaacatttcattcaccttgaatgtccgattgagaccttaaccctcccttggttcatgtgcttctttttgggctacattcctcaagcggcttcactgacggttctcgatttggtatttgctttcggtaagaatgttttgtttcaagttggtttggccgtatttgctctctgtcgtgatcggttactggcagcaaatgacccagaagacatagcacagataatcaaaaaaggagtaacagacaacctcaagctaatggacatcgctttagaccgttttggaaacctccatgaagagggccttgctgaactctcaaagtccaataaatattcatttatggattcaatgcaaaaacaaattgataaaaagagaattggattattatcaaaacaatatccatcggttgctttacaaattgaaggactattgggtggattcaataaagttgcaatgg

SEQ ID NO: 41295 - protein, 241 aa, Panicum virgatum
  misc_feature: Ceres CLONE 2007296-R
  misc_feature (1)..(155): Pfam Name: TBC Pfam Description: TBC domain
AEPKKIGIPHLRNVLIAYSRRATHIGYCQAMNIVTATLCFYMQEEEAFWTLSAICEDIVKDYYLEGLQLIGSIVDLNTFVSLVAHYFPELNKHFIHLECPIETLTLPWFMCFFLGYIPQAASLTVLDLVFAFGKNVLFQVGLAVFALCRDRLLAANDPEDIAQIIKKGVTDNLKLMDIALDRFGNLHEEGLAELSKSNKYSFMDSMQKQIDKKRIGLLSKQYPSVALQIEGLLGGFNKVAM

SEQ ID NO: 41296 - DNA, 1393 bp, Panicum virgatum
  misc_feature: Ceres CLONE 2007296
gttcagagaaaccacagttttgaggatgtgggtccttcctcgccctgtgtctgcaacagaaagcatcctatttaaagaacttttaactggacaaactgaactcttcaaaatgctccattatgaaacgagcttattcaatggcctagttagtacagtctcctctcaaattcttttttacaggatcgtaatggtgcaaccgaatggaggacagactcttttggcggtttctgattcctatgaaaccctcttcaacaagcaatggacctttttactgaaattggagccgttaatcttaaatattgaaaagatcgaagatcggaggaaatttattcttgataaagtctcagggcttgcccaactcgaagaaggagaagaaggaactgatcagttccaaaaagaatttagattcaaattccctgaaatgaaagaacaaaaattcataacagcctattctggattattatggataccagggaagatgactcctattaatggtgtcatgtatctcacaccagatttcattacttttgaatctggaggacaaaaatttagtttttcttttaaaaacgtcacttctctggtcaaagactcactaacagctgtgaaatggacttatcgggatactgataaatctgaaaaaacctattggatgactgtattagaatcggatggattatttgttgtccttgattcgttatggcaagaccatcttgagcaatggaagagaaaactcgatcctcaagggttggggaaaaaatcaacaaattcgatttctcaaaatatggctcaaatgaaacgagcgacaaaagaaaatgacttctcagccgagttcaacgttcctgataaatttaatgaatttcacgcattccattgccttttctggttcaatggtcgttacaggatgggaaagatttatattactgaaaattttttatgttttcatacaaaagaggattatcttagtgtacatggttatagggttgttatcgcttggaataatgttagattgattgctcccaaggagagcatgttaggaatggtctcaaacgcgattgaaattacttcaatatcaggaaacaaattcttattctgtacagccactcctaatcaatcccgtgatgaaatcatgaacataatgatccctaattggaatgaatgtattaattttagagctcggaagctgaaggagttatcctttttaacgcctccggatccaaatgttacagaaggatgggccatgactctaaacaaagatccctcttaccttcaaggagaaaaggaaaaaaagaaaatgtgggatgactactttgaaacttatggtcctccgatgaatatgatattttctggagattaaacgaattcgtcacaggtcttgggtgtccagatgtttatc

SEQ ID NO: 41297 - DNA, 654 bp, Panicum virgatum
  misc_feature: Ceres CLONE 2007301
  misc_feature: Encodes the peptide sequence at SEQ ID NO. 41298
agaggaaccccggggtcccggaccgactccatttccggccaagaggccaagatccatttcgttccgccattctttttttttccttcttggtgatctgatctagtcgcccccgttcgcgtccattaatcctagcagcggcggacctcagcgagcgagcctgttgtcatctcctcgtactaccgccagccgttacagcgtgcaatggcgctcaacctcgcgcaccagaccggcgcggcggcggccgtgacggcggcgccgcgctcggcggttgtcgcggcggcctccaccgtggcgccgtccgcgacggcgccctcgtcggcgcccgcgctccaggcgcagacggtgacggtggacccggcgccggcgcaggcggcggcggactcggtgaagccggacctcgccatggtgtgccaggcgcttgtggacggcggcaagccggaggcggagcacgcggacgtggccgccgaggtgaagagcaaggagggcgtgccggtgttcgtgatgatgccgctcgacacggtgcgcaaggacggcaacagcctgaaccggcggagggcggtggaggccagcctggcggcgctcaagagcgccggcgtcgagggcatcatggtggacgtgtggtggggaatcgccgaggccgagggccccggccag

SEQ ID NO: 41298 - protein, 150 aa, Panicum virgatum
  misc_feature: Ceres CLONE 2007301
  misc_feature: SWISSPROT Homolog: EC 3.2.1.2 Beta-amylase
MALNLAHQTGAAAAVTAAPRSAVVAAASTVAPSATAPSSAPALQAQTVTVDPAPAQAAADSVKPDLAMVCQALVDGGKPEAEHADVAAEVKSKEGVPVFVMMPLDTVRKDGNSLNRRRAVEASLAALKSAGVEGIMVDVWWGIAEAEGPG

SEQ ID NO: 41299 - DNA, 722 bp, Panicum virgatum
  misc_feature: Ceres CLONE 2007304
  misc_feature: Encodes the peptide sequence at SEQ ID NO. 41300
ccgcgacgagcttgtcgtcaaggccttcttcgaggccgagagggcgcaccgtggtcagaagcgggctagtggtgatccatacttgcagcattgtgtggaaactgcagtgcatctggccaaaatcggcgcaaacgcgaccgtcgtgtctgctggccttctccatgacacaattgatgactcgttcatggactatgatgatatcttccggatgtttggcgctggtgtagccgatcttgttgaaggggtatgaactttttgtttagtttatcattattttagatgagaggataacttcccctgtattagtgtattttactgaaggttttgactagatctgcttctagttattcaagttatctagattagcctgtttatctttagacgttaattgagtcatggactccttttgcttaacatatgggtagctttgctactaaataaacaaagtcctcaaatgatgccaagtctaatttcttgaccttggaagcttctatcctgactgagctacttgtttataagctataggccatagcaatcaacttgtgatgaaatttcttagtaaaatagtcccaactattccattcttaaacctctgtctgttttgttaatattacaaattagacatactttctcaattccctaccaagaatagatgcaagaaactggcctgtgtcatgtattcaatgttttcggtggcatggtcccccaagtccgtcagcatc

SEQ ID NO: 41300 - protein, 82 aa, Panicum virgatum
  misc_feature: Ceres CLONE 2007304
  misc_feature: SWISSPROT Homolog: EC 2.7.6.5 GTP diphosphokinase
RDELVVKAFFEAERAHRGQKRASGDPYLQHCVETAVHLAKIGANATVVSAGLLHDTIDDSFMDYDDIFRMFGAGVADLVEGV

SEQ ID NO: 41301 - DNA, 1935 bp, Panicum virgatum
  misc_feature: Ceres CLONE 2007305
  misc_feature: Encodes the peptide sequence at SEQ ID NO. 41302
gcaactcctcctctccccttcctccgcgctgccagccagccagcccacagcccggcgccatcagtgggtggggtgggtggttgcctgcctccgcctgctccactccaccgcgcccgcgcgcccgcgctgctgaccgccgccccgctcgacttacccgccgccgcccgcgccgcggttggctggctggttggtgctaggtaggtgggcggctgcttgcggcacgcgagcgggcgatccggggcggggatctcggcggcgcggatctcatggaggaggacggctcctctgccgccgccgcggtggagaatggcgcggcggtggaggcggagggatgcgtcgccgtgaaggtgggcgcggagggggagcccgtcggcgatcggggggatctcgcggccgtggaagaggcggcgccgccggcagagggcggatctgaggccgccagcccggccgtagcggcggccgaggaggaggcggcggcggcaacggcaaaggcgccgggcaagaaggctggatccggggacgccgccggggcgcggaaggggaagctgcccaacggcagggcgcccgccgccgtcgcggccaaggggaagcggcccggcgtcctctcgcagagcgcctctttcccagcgcgggggccggccggcggcgccaagaaggctgctgccgtggcggctccggctgccgcgcccaagcaggctgcggcggcggcggccaacggatcaggatcagcggcggcgtcaggacgggcggcggtggcagtggacaagaagccgaaggcgaatccggctgttgctcgccggtcgatgcctgccaagtctggatcagtggatgccgcgccaagtgatgcaactcctgcagtccaagagtcacatgagaatgccgccaaaccattgaagcaagcgcagccagggaaaacagatgatgatgttctctccaccacatcaagtacgaatactccccgtgcagcagcccgcaagagtgctgctgctggcttcagtttcagattggagcagcgtgctgagaagcgaaaggagttcttccaaaagcttgaagagaaaatccatgcaaaggagcttgaacaaacaaatttgcaggaaaaatccaaggagagccaagaggctgagatcaaacttctgaggaagagcctgacatttaaagcgacaccaatgccaagcttttacaaggagcagccacctaaagtcgagttgaaaaagattcccccaacacgtgctagatcaccaaagcttgggcggcacaagccaactacttctgctactgctgcttctgcagatggttctgtatgtgagagcccgcggagcacagcgaattctggcaaggtaaatgaagttgtggaaaacaacaaacctcgggctcctgcaaggaaacctgtccagagatcagtcacaaaacctacgtcccaagtgtctggaactgctaaggctgacccaaggcctgtggttacaaaaccgaaaaccttaaactcgaaacctaaggtttcaagggcaaaggctgcgcaagtacaagacaacccagttgaagttcccccttcagaaccttctgctccacaagagctcacagtcgaacatggtgttggagaagcaacaggacctgatctggctgccccatttgtcacttcgaatgaagtcccagtccatggttgatctgcgtcattttgcctattcatttccttcttgcagttctgtgaatagtgagggtgtgtgcttcattgaaagttgaatctctcaaaattgtcgggtcatggggttatcgtttcctgagtagacattcatttttttcagcttgtcattgagcatgccatgtatattgctttgatattttgtccatgtttacatttcccaatcttgtgtatattggatttctatgtcgttggacatcctaggattattgcaatacattaatgcaactttgtggatc

SEQ ID NO: 41302 - protein, 464 aa, Panicum virgatum
  misc_feature: Ceres CLONE 2007305
  misc_feature (245)..(301): Pfam Name: TPX2 Pfam Description: Targeting protein for Xklp2 (TPX2)
MEEDGSSAAAAVENGAAVEAEGCVAVKVGAEGEPVGDRGDLAAVEEAAPPAEGGSEAASPAVAAAEEEAAAATAKAPGKKAGSGDAAGARKGKLPNGRAPAAVAAKGKRPGVLSQSASFPARGPAGGAKKAAAVAAPAAAPKQAAAAAANGSGSAAASGRAAVAVDKKPKANPAVARRSMPAKSGSVDAAPSDATPAVQESHENAAKPLKQAQPGKTDDDVLSTTSSTNTPRAAARKSAAAGFSFRLEQRAEKRKEFFQKLEEKIHAKELEQTNLQEKSKESQEAEIKLLRKSLTFKATPMPSFYKEQPPKVELKKIPPTRARSPKLGRHKPTTSATAASADGSVCESPRSTANSGKVNEVVENNKPRAPARKPVQRSVTKPTSQVSGTAKADPRPVVTKPKTLNSKPKVSRAKAAQVQDNPVEVPPSEPSAPQELTVEHGVGEATGPDLAAPFVTSNEVPVHG

SEQ ID NO: 41303 - DNA, 607 bp, Panicum virgatum
  misc_feature: Ceres CLONE 2007332
  misc_feature: Encodes the peptide sequence at SEQ ID NO. 41304
ctggagttctaaaaaaaaaaactccgccttctgccgccgcgactccgacgccgccagcctctgcagcagccaccgcgcttcctccgtcggcgccgcccccaacttctccgaccgcgccacgcaggccgccgcgctccgcgtcgtcaacgccttcctcgcccccgccgtcacgctccgcgggccgctcccctccgcgcgcgacatccaggccgcgctccgcatcctcctcgaccgcatcgacgcccccccccccccaaaacttcgccggggagagcagcgccgccgccgcggccgctgacgaggaggagccggagaacgggttcgccggcggcgatcaggccattgacttccctggagggaaggtttcatttgtagctgaaatgaacttccttccggaggcacatggggaaaggatcagctgttatcgtgttcttgacgatgatggcagaacaatatctggaagtagattccgagaggtcaatacggaggtggctctgaaaatgtacagggagatggtcaccctccatatcatggataacatcttctatgaagcgcagaggcagggaagaatctcattttatctcacttccactggcgaggaagcgat

SEQ ID NO: 41304 - protein, 201 aa, Panicum virgatum
  misc_feature: Ceres CLONE 2007332
  misc_feature: SWISSPROT Homolog: EC 1.2.4.4 3-methyl-2-oxobutanoate dehydrogenase (2-methylpropanoyl-transferring)
GVLKKKTPPSAAATPTPPASAAATALPPSAPPPTSPTAPRRPPRSASSTPSSPPPSRSAGRSPPRATSRPRSASSSTASTPPPPQNFAGESSAAAAAADEEEPENGFAGGDQAIDFPGGKVSFVAEMNFLPEAHGERISCYRVLDDDGRTISGSRFREVNTEVALKMYREMVTLHIMDNIFYEAQRQGRISFYLTSTGEEA

SEQ ID NO: 41305 - DNA, 1337 bp, Panicum virgatum
  misc_feature: Ceres CLONE 2007334
  misc_feature: Encodes the peptide sequence at SEQ ID NO. 41306
gtgttcctgtcacggacgcctcgtgcacatggcgcggccccgatctgcgcttgctctccttcctcgaccggccggcttctccagatccgaacggtccgctgtaccacaagggctggtaccacctcttctaccaatggaacccggactccgcggtgtggggcaacatcacctggggccacgccgtgtcgcgcgacctcgtccactggctgcacctgccgctcgccatggtgccagaccactggtacgacgccaacggcgtctggtccgggtcggcgaccaggctcccggacggccggatcgtcatgctctacacgggctccacgacggagtcggtgcaggtgcagaacctcgcggagccggccgacccgtcggacccgctgctccggcggtgggtcaagtcggccgccaaccccatcctggtgccgccgccgggcatcgggctcaaggacttccgcgacccgacgacggcgtggcgggtccccaacgacacggcgtggcgcgtcgccatcgggtccaaggaccggagccacgccgggctggcgctggtgtaccggacggcggacttcgtgcggtacgacccggcgccggcgctgatgcrcgtcgtgccgggcaccggcatgtgggagtgcgtggacttctacccggtggccgccgtcgccggcggcgtggagaacgggctggagacctccgtgccgccggggcccggggtgaagcacgtggtgaaggccagcctcgacgacgacaagcgcgactactacgccatcggcacctacgacgccggggccgacgcctggacccccgaagacgcggcgaacgacgtcgggatcgggctcctctacgactacggcaagttctacgcgtccaagaccttctacgaccccgtgctccggcggcgggtgctgtgggggtgggtcggcgagaccgacagcgagcgcgcagccatcctcaagggatgggcgtccgtgcagtcaatcccgaggacggtcctcctggacacgaagaccggcagcaacctgctccagtggcccgtggtggaggtggagaacctccggatgagcggcaagagcttcgacggcgtggcgctggaccgcggctccatcgtgcccctcgacgtcggcaaggcgacacagctggacatcgaggccgtgttcgaggtggacgcggcggccgtggagggcgtgacggaggccgacgtggggttcaactgcagcaccagcgccggcgcggcggggcggggcctgctcggcccgttcggtctgctcgtgctcgccgacgacgacctctcggagcagaccgccgcctacttctacctggccaagggcaccgacggcagcctc

SEQ ID NO: 41306 - protein, 444 aa, Panicum virgatum
  misc_feature: Ceres CLONE 2007334
  misc_feature (28)..(342): Pfam Name: Glyco_hydro_32N Pfam Description: Glycosyl hydrolases family 32 N terminal
  misc_feature (383)..(443): Pfam Name: Glyco_hydro_32C Pfam Description: Glycosyl hydrolases family 32 C terminal
  misc_feature: SWISSPROT Homolog: EC 3.2.1.26 Beta-fructofuranosidase
  misc_feature: Useful for making plants with altered carbohydrate content
  misc_feature: The sequence is a functional homolog of SEQ ID NO 4 in US patent 7253335
  misc_feature (199)..(199): Xaa is any aa, unknown, or other
VPVTDASCTWRGPDLRLLSFLDRPASPDPNGPLYHKGWYHLFYQWNPDSAVWGNITWGHAVSRDLVHWLHLPLAMVPDHWYDANGVWSGSATRLPDGRIVMLYTGSTTESVQVQNLAEPADPSDPLLRRWVKSAANPILVPPPGIGLKDFRDPTTAWRVPNDTAWRVAIGSKDRSHAGLALVYRTADFVRYDPAPALMXVVPGTGMWECVDFYPVAAVAGGVENGLETSVPPGPGVKHVVKASLDDDKRDYYAIGTYDAGADAWTPEDAANDVGIGLLYDYGKFYASKTFYDPVLRRRVLWGWVGETDSERAAILKGWASVQSIPRTVLLDTKTGSNLLQWPVVEVENLRMSGKSFDGVALDRGSIVPLDVGKATQLDIEAVFEVDAAAVEGVTEADVGFNCSTSAGAAGRGLLGPFGLLVLADDDLSEQTAAYFYLAKGTDGS

SEQ ID NO: 41307 - DNA, 804 bp, Panicum virgatum
  misc_feature: Ceres CLONE 2007334-R
gtgcagcattcatcatatggaatgtatcaatacttcatcaaggttgttcccactgtctacactgacataaatgatcacatcatcctctcaaatcagttctctgtgacggaacattttagaagtagtgaaagtggtcgcatacaagctcttcctggcgtgtttttcttttatgacctttccccaatcaaggtcacattcacagagcaacatgtgtcattcttgcacttcttaaccaatgtttgcgcaattgttggtggtgtgttcacagtttctggaatcatagattcatttgtataccatggccagagagcaatcaagaagaagatggagattggtaaattcaactgagtgttgccttcctattgctgccacttattccatcttcagggcttcctttggaagaactctagccgtggtaaagcaagactgcaagcttttggtgcacttgcatagtctggaaacacctgctcattgaatatcgcatggtgtgcttgcttgcttcctgcagaagatgccaggaagcaaaatgatcagcttgtacacttattccgctgtcaaatggaacatttcagaggcgctccatttttgtacgctctagtctaacaggaaaacatttttcttctgtgagatggtgtttgtatcattgtaaatctgtggaagggggcacaagcctctttgtaggattttttttggggttgcaattctgttatctgtgacagattctttttctcggatgtttgtagacttcacagataaagagtaaaaaaaatgtaaagaccatttcaaggaaagacaatttttctt

SEQ ID NO: 41308 - DNA, 1802 bp, Panicum virgatum
  misc_feature: Ceres CLONE 2007336
  misc_feature: Encodes the peptide sequence at SEQ ID NO. 41309
atcccttgctctctgtccgttcctcgcctctagcaggggagcaatggtcctatctcgcctcttcgtggtcgtcctcagcgccgccatggctgctgtactcttcttctctcctgccgatgccggcgtagtgggggtgaactacggcacgctggcgaacaacctgccggacgtggcgtcggtggtaaggctgttgcagaggaacggcatcaaatcggtgaggctgtacgacgccaacgcaatggtgctcaatgccctggccaacaccgggatcacggtgatagtgatgttgcctaacgacaacctcgccgccgcggccctggacccatcgaacgcgcgccggtgggtgcagaggaacgtggcggcgcactaccctgccacgcggatcatcgccgtggacgtgggcaacgaggtgttcctgaaggcgaagaacctgacccggctgctcgtcccggccatgaacaacgtctacgccgcgctggtgaggctgcgcctgcagaaggtggtgaaggtgaccacgcccatcgcgttcaccgcgctgaaggtgtcctggccgccgtccgccggcaggttccaggacgacatcgcgcggtcggtgatgcggcccttgatcgacttcctggaccgcaccggatcgtacctcggcgtcaacgcctaccccttcttcgcgtacatcgcacagcctgacaagatacccctcgactacgctttgggaaactacacacccggcgtgcgcgatcccggcaccgggctcgtgtaccacagcctcctcgacgcccagatcgacgccgcccactttgcgatccagaggctggggtcatcgaccagcgtgcgcggccaaggaaattctttggcgcagtatggcccaacgcaggtgaatgttcctgagaacgggcatcctaacggcggcgggctaaaccaaaaaaaaaaaaagagtcctggcaggaggcgtttgatggctgcgggcgatgaagcagccgcggcagcatcggcagcttcggtggccaacgccaaagcctacaacaactacgtcatcaaccgcatcctgtccggcaacacgggcacgccgtaccggcccaacgccgacctgaacatccacatcttctctctgttcaatgagaacttgaaggggttcggaccaggcgacatcgagcaacacttcggcctattctacccgaaccagaccaaggtgtacgacttcgacttccgcggcacccacttaccgccgccgccgccgccgccgccaccgatgccgagctggtgcgtggcgaacgccgccgtcggggacgcgcggctgcaggcggccatggactacgcgtgcggccacggcgcggactgcagcgacatccagcccggcgccgcgtgcttcgagcccaacaccaaggccgcgcacgcctcccacgccttcaacagctactaccagcgcaatggccggaccggcgggacgtgcgacttcgccggcgcggcttccgtcgtctacaaggcgccaaagattggaaaatgcgtgcttccgtccaaggcgtgaattaagttacaacgacagtgaagtctgaaggatacgctgcaatataatctgatgctccacttgttttcaagaaataaatgaccagttttacccttgttaattgtaatatttcccttatcagtgttaccccaacatagcccaccacgtcctcccgaagctccaagcaagaggttattgtgttattagggcataaacattgcgtgtaaaattaagtgttgatatttgttgattgcataattatacggaaagcttgattgcaaatatataagtgttcttccag

SEQ ID NO: 41309 - protein, 492 aa, Panicum virgatum
  misc_feature: Ceres CLONE 2007336
  misc_feature (29)..(387): Pfam Name: Glyco_hydro_17 Pfam Description: Glycosyl hydrolases family 17
  misc_feature (404)..(488): Pfam Name: X8 Pfam Description: X8 domain
  misc_feature (325)..(486): SWISSPROT Homolog: EC 3.2.1.39 Glucan endo-1,3-beta-D-glucosidase
  misc_feature (29)..(260): SWISSPROT Homolog: EC 3.2.1.73 Licheninase
  misc_feature: Useful for making plants with altered carbohydrate content
  misc_feature: Useful for making plants with altered cell wall content and/or composition
  misc_feature: Useful for making plants with modulated drought sensitivity
  misc_feature: Useful for making plants with modulated water use efficiency
MVLSRLFVVVLSAAMAAVLFFSPADAGVVGVNYGTLANNLPDVASVVRLLQRNGIKSVRLYDANAMVLNALANTGITVIVMLPNDNLAAAALDPSNARRWVQRNVAAHYPATRIIAVDVGNEVFLKAKNLTRLLVPAMNNVYAALVRLRLQKVVKVTTPIAFTALKVSWPPSAGRFQDDIARSVMRPLIDFLDRTGSYLGVNAYPFFAYIAQPDKIPLDYALGNYTPGVRDPGTGLVYHSLLDAQIDAAHFAIQRLGSSTSVRGQGNSLAQYGPTQVNVPENGHPNGGGLNQKKKKSPGRRRLMAAGDEAAAAASAASVANAKAYNNYVINRILSGNTGTPYRPNADLNIHIFSLFNENLKGFGPGDIEQHFGLFYPNQTKVYDFDFRGTHLPPPPPPPPPMPSWCVANAAVGDARLQAAMDYACGHGADCSDIQPGAACFEPNTKAAHASHAFNSYYQRNGRTGGTCDFAGAASVVYKAPKIGKCVLPSKA

SEQ ID NO: 41310 - DNA, 746 bp, Panicum virgatum
  misc_feature: Ceres CLONE 2007339
  misc_feature: Encodes the peptide sequence at SEQ ID NO. 41311
atagatccagatgtcgaatcacgaaggaaatctattatcggagaactccaaagggaagagctacgatttgtccagaccttggaaagaggtgaaaagttattaggtgaccttctagatgaggccttattaagtgatggtaataatggaaataatccttccctatctggaaaggatgttttccttttgtacgatacatatggttttccagtagagattacagctgaaatagctggtgaacgaggtgtcactgttgatatgaagggatttgaaattgaaatggaaaaccaaaggaaacaatctcaggctgctcataatgtagtcaaactttctgtaggaaatgagacagagatagtcaagagcatccctgatactgaatttcttggatatgactcgctctttgccactgctgttgtcaaaggtctcctagttaatggaaacccagttaatgaagtttctgaaggttctgaagtagaaatattattagatcggacaccattctatgcggaatcaggtggccaagttggagataagggtttcttatatttgaatggaggggaggatagaaaacaaacagcagtcatagaaatcactgatgtccaaaagtctctgggaaatatatttgtgcgcaaaggcacgattaagcaggggtctgtagaggttggcagggaaattgatgcctctgttgatgcaaagttgaggcagggtgctaaggcacatcatactgcaacacatttactacaatccgc

SEQ ID NO: 41311 - protein, 248 aa, Panicum virgatum
  misc_feature: Ceres CLONE 2007339
  misc_feature (1)..(232): Pfam Name: tRNA-synt_2c Pfam Description: tRNA synthetases class II (A)
  misc_feature: SWISSPROT Homolog: EC 6.1.1.7 Alanine--tRNA ligase
IDPDVESRRKSIIGELQREELRFVQTLERGEKLLGDLLDEALLSDGNNGNNPSLSGKDVFLLYDTYGFPVEITAEIAGERGVTVDMKGFEIEMENQRKQSQAAHNVVKLSVGNETEIVKSIPDTEFLGYDSLFATAVVKGLLVNGNPVNEVSEGSEVEILLDRTPFYAESGGQVGDKGFLYLNGGEDRKQTAVIEITDVQKSLGNIFVRKGTIKQGSVEVGREIDASVDAKLRQGAKAHHTATHLLQS

SEQ ID NO: 41312 - DNA, 769 bp, Panicum virgatum
  misc_feature: Ceres CLONE 2007350
  misc_feature: Encodes the peptide sequence at SEQ ID NO. 41313
cagaccagtcgcaatcccatcaaccaaagccagaaagcctctcccctctctcaacagcggcgcgcggttcctccccctctcgactcgactcggctccaccccgcccccgcggcgcggcgcgacaagaaaacccaccaaaccctaaccctagctgcggcgccaccgcccgccggagggtcccgagccagcgcgcgaggatgccgtcggggtcggcgacgcagttccgctacacgcagacgccgtccaaggtgctgcacctgcggaacatgccgtgggagtgcaccgaggaggagctcgtcgagctctgcaagcccttcggcagggtcgtcaacaccatgtgcaacgtcggcgccaaccgcaaccaggccttcgtcgagtttgcggatcaaaaccaggcaatttcaatggtttcctattatgcttcatcttcagagcctgctcaagttcgtggtaaaactgtatatatccaatattcaaaccggcaagaaattaccaacaataaaggcactggtgattctactggcaatgtcctgcttgtcacttttgaaggtgttcagcctaatgatgttaccatcgaagtcattcatttggtattttcagcatttggatttgttcacaagatagctacttttgagaaagcagctggtttccaggcacttatccagtatactgatgccccaactgctcttgaagctaaaaactcattggatggaagaagcataccaaaatatttacttccagaacatatcagtgcctggcacatgcgcat

SEQ ID NO: 41313 - protein, 190 aa, Panicum virgatum
  misc_feature: Ceres CLONE 2007350
  misc_feature (19)..(90): Pfam Name: RRM_1 Pfam Description: RNA recognition motif. (a.k.a. RRM, RBD, or RNP domain)
MPSGSATQFRYTQTPSKVLHLRNMPWECTEEELVELCKPFGRVVNTMCNVGANRNQAFVEFADQNQAISMVSYYASSSEPAQVRGKTVYIQYSNRQEITNNKGTGDSTGNVLLVTFEGVQPNDVTIEVIHLVFSAFGFVHKIATFEKAAGFQALIQYTDAPTALEAKNSLDGRSIPKYLLPEHISAWHMR

SEQ ID NO: 41314 - DNA, 1285 bp, Panicum virgatum
  misc_feature: Ceres CLONE 2007352
  misc_feature: Encodes the peptide sequence at SEQ ID NO. 41315
actcctcgcggtcacttcaccagccaaccacgagccggtggagtggcaggcaggcaggcaggctagctcagtagtgagtgcccgagtcgtagccgcctttgaattccacgcggaggggaggcgtcctcgcgctccccggctagacggctagtcccgtcgtttgtcgctcaccacctgatcgagtagcagcagcttcgtcttgtcgaccgccggcggctatataaactgccgcgcaagtcaccgtgctgagcactccagctagagcacgaaccattgtctgactgtcttctgcagttctatgttaccgagctctgctgtgctgtactaaagctagctgcgagtctcactgttggtggtgttgtgcaactggtctgcagagatgggggagaacggtaagcactgctacccggcggcggccatggaggtgacctccgcggagctcggccacacggcggcctccaagtgctacgacgacgacggccgcctcaagcgcaccgggacgatgtggacggcgagcgcgcacatcatcacggcggtcatcgggtccggcgtgctgtcgctggcgtgggccatcgcgcagctcggctgggtggccggccccgccgtcatgctgctcttctccttcgtcacctactacacctccgggctgctcgccgactgctaccgctccggcgacgcgtgcaccggcaagcgcaactacacctacatggacgccgtcaacgccaacctcagtggcgtcaaggtccagatctgcggcttcctgcagtacgccaacatcgtcggcgtcgccatcggctacaccatcgccgcctccattagcatgctggcgatcaagaaggccaactgcttccacgtggaggggcacggcgacccgtgcagcatctccagcacgccctacatgatcatcttcggcgtggcggagatcttcttctcgcagatcccggacttcgatcagatatcgtggctctccatcctggccgccgtcatgtccttcacctactccgccatcggcctgggcctcggcatcgtccaggtggtcgccaacaagggcgtccagggcagcctcaccggcatcagcgtcggcgccgtcacccccgtcgacaaggtgtggcgcagcctgcaggcgttcggcgacatcgccttcgcctactcctactccctcatcctcatcgagatccaggacacgatccgcgcgccgccaccgtccgagtccaaggtcatgcgccgcgccaccatcgtcagcgtcgccgtcaccacgctcttctacatgctctgcggctgcacg

SEQ ID NO: 41315 - protein, 301 aa, Panicum virgatum
  misc_feature: Ceres CLONE 2007352
  misc_feature (38)..(301): Pfam Name: Aa_trans Pfam Description: Transmembrane amino acid transporter protein
MGENGKHCYPAAAMEVTSAELGHTAASKCYDDDGRLKRTGTMWTASAHIITAVIGSGVLSLAWAIAQLGWVAGPAVMLLFSFVTYYTSGLLADCYRSGDACTGKRNYTYMDAVNANLSGVKVQICGFLQYANIVGVAIGYTIAASISMLAIKKANCFHVEGHGDPCSISSTPYMIIFGVAEIFFSQIPDFDQISWLSILAAVMSFTYSAIGLGLGIVQVVANKGVQGSLTGISVGAVTPVDKVWRSLQAFGDIAFAYSYSLILIEIQDTIRAPPPSESKVMRRATIVSVAVTTLFYMLCGC

SEQ ID NO: 41316 - DNA, 626 bp, Panicum virgatum
  misc_feature: Ceres CLONE 2007352-R
ttttacgagcccttctggctccttgacgtcgccaacgccgccatcgtcgtgcacctcgtcggcgcctaccaggtctactgccagccgctcttcgccttcgtcgagaagtgggcgcagcagaggtggcccgagtccaggtacatcaccggcgaggtcggcgtcccgctctccctctccggctccgccggccgctgctacaagatgaacctgttccgcctgacgtggcggacggcgttcgtggtggcgaccacggtggtctccatgctcctgcccttcttcaacgacgtggtcgggctgctcggcgcgctggggttctggccgctcaccgtctacttccccgtggagatgtacatcgtgcagaagaaggtgcccaggtggagcacgcggtgggtgtgcctgcagctgctcagcctcggctgcctcatcatcaccgtggcctccgccgctggctccgtcgccgggatcatctccgacctcaaggtgtacaagccgttcgtcaccacctactgatggatcgatcgttcgtcgcactgaacatatgcacagattgatggacagacagatgatttggcgcctagtatgtgcagtctttaattaaattagtcattaattaattaccacacggt

SEQ ID NO: 41317 - DNA, 673 bp, Panicum virgatum
  misc_feature: Ceres CLONE 2007360
  misc_feature: Encodes the peptide sequence at SEQ ID NO. 41318
aagatccaagaagatcgaagggccgggctgctcgagcgctagctaactactcgccatggccagcaacggcacggacgccgccgccgaggtgccgcagccgccgccgtcgcaggggcggctcatcaccgtgctcagcatcgacggcgggggcatccgcgggctcatcccggccaccatcatcgcctgcctcgaggccaagctccaggagctggacggcccggacgctcggatcgcggactacttcgacgtgatcgccgggacgagcaccggcgccctgctcacgtcgatgctggcggcgccagacgagaacaagcgccccatcttcgccgccaaggacctcaccaccttctacctcgagaacggccccaagatcttcccccagagaaagatggggttcctgaagccggtggcgaacctggtgagcctgatgaggggccccaagtacgacggcgccttcctgcacgacaagatcaagagcctgacgcgcgacatgcgggtcgcggacacgatcaccaacatcgtcgtgccggccttcgacgtcaagtacctgcagccggtcatcttcaccacctacgaggccaaggccgacccgctcaagaacgcgcacctctccgacatctgcatcagcacgtcggcggcgccgacctacttcccggcccacttcttcaccacc

SEQ ID NO: 41318 - protein, 205 aa, Panicum virgatum
  misc_feature: Ceres CLONE 2007360
  misc_feature (26)..(205): Pfam Name: Patatin Pfam Description: Patatin-like phospholipase
  misc_feature: Useful for making plants with modulated heat sensitivity
MASNGTDAAAEVPQPPPSQGRLITVLSIDGGGIRGLIPATIIACLEAKLQELDGPDARIADYFDVIAGTSTGALLTSMLAAPDENKRPIFAAKDLTTFYLENGPKIFPQRKMGFLKPVANLVSLMRGPKYDGAFLHDKIKSLTRDMRVADTITNIVVPAFDVKYLQPVIFTTYEAKADPLKNAHLSDICISTSAAPTYFPAHFFT

SEQ ID NO: 41319 - DNA, 1800 bp, Panicum virgatum
  misc_feature: Ceres CLONE 2007363
  misc_feature: Encodes the peptide sequence at SEQ ID NO. 41320
cttccagcttcatccacattccactgacaagaagtcacaaaaccctagttggctcgttccccgctctcgtctcgcctaaacctcgcctccgccccccctcaaccccggccggccgaaagacgaaccaccgaaccggcggcggcggcgggtggtagccatggcagagctgaagcggctgtcggagagccgcgacctgacgcggatcgagcgcatcggcgcgcactcccacatccgggggctagggttggactcctccatggaggcgcgcgacgcctccgagggcatggtcgggcagctcccggcccgccgcgccgcgggcctcatcctccagctaatccgccaggggaagatcgccggccgcgccgtgctcatcgcgggccagcccggcaccggcaagaccgcgctcgccatgggtatcgccaagtcgctcggcgcggagacgcccttcgcctccgtcgccgcctcggagctcttctccctcgacctatccaagacggaggcgctcacgcaggccttccgccgcgccatcggcgtccgcatcaaggaggaggcggaaattatcgagggcgaggtcgtcgagatctccattgaccgccccttagcatcctctggcgctggcagcagctccgccgcgccttcgggcgctactgcggccggaaaatccggccggctcacgctgaagaccacggacatggagacggtgtacgagctcggagggaagatgattgaggctcttggaaaggagaaggtgcagagtggggatgtgattgcccttgacaaggcctcggggaaggtcaccaagcttggccgctccattgggaggtcgcgggattatgatgctgttggcccccacaccaagtttgtcaagtgtcctgatggtgagctccagaagcgcaaggaggtcgtgcactgtgtcaccttacatgagattgatgtgatcaatagcaggacacagggttttcttgcactgttcactggggacactggtgaaattcgtgcggaggttcgggagcagattgacacaaaagttgcagagtggagagaagaaggaaaggctgagattgtgcctggggttctgtttatcgatgaagtccacatgctagatattgagtgcttctccttcctcaaccgagcattggaaaatgatatggctccaatcctagtcatcgcaacgaaccgagggatcacatccatccgcgggacaaactaccggtcgccgcatgggatcccgccggacttcctcgaccggctcctgatcatcacgacgcagccctacaaggaggatgagatccggaagatccttgacatccggtgcgacgaggaggacgtggagatgtccgcggacgccaaggtcctgctcaccaagattggcatcgagacctccctgaggtatgccatccacctgatcaatgccgccgcgctggcctgccagaagcgcaaggggaaggtggtggagatggaggacatcagccgggtgtaccagctgttcctggatgtgaagcgatcgacgcagtacctgatggagtaccagagccagtacatgttcagtgaagtgtcgggggaagcagatggagatgatgccatgcattcctagacgacctttgtgttacaaggtggctgggttattgtgcccggcgtcgtgtatttcggatgcttgttgctcgtttaggttgctggtattaccctgacaaggcgtggtgtgtgcgatggactctgttagctgctgtaggtgaaggtgactatgcaattcaatgtatctgatcaaattcatcccagctaagtgccgtgattttttttttt

SEQ ID NO: 41320 - protein, 478 aa, Panicum virgatum
  misc_feature: Ceres CLONE 2007363
  misc_feature (121)..(447): Pfam Name: TIP49 Pfam Description: TIP49 C-terminus
MAELKRLSESRDLTRIERIGAHSHIRGLGLDSSMEARDASEGMVGQLPARRAAGLILQLIRQGKIAGRAVLIAGQPGTGKTALAMGIAKSLGAETPFASVAASELFSLDLSKTEALTQAFRRAIGVRIKEEAEIIEGEVVEISIDRPLASSGAGSSSAAPSGATAAGKSGRLTLKTTDMETVYELGGKMIEALGKEKVQSGDVIALDKASGKVTKLGRSIGRSRDYDAVGPHTKFVKCPDGELQKRKEVVHCVTLHEIDVINSRTQGFLALFTGDTGEIRAEVREQIDTKVAEWREEGKAEIVPGVLFIDEVHMLDIECFSFLNRALENDMAPILVIATNRGITSIRGTNYRSPHGIPPDFLDRLLIITTQPYKEDEIRKILDIRCDEEDVEMSADAKVLLTKIGIETSLRYAIHLINAAALACQKRKGKVVEMEDISRVYQLFLDVKRSTQYLMEYQSQYMFSEVSGEADGDDAMHS

SEQ ID NO: 41321 - DNA, 748 bp, Panicum virgatum
  misc_feature: Ceres CLONE 2007364
  misc_feature: Encodes the peptide sequence at SEQ ID NO. 41322
ggtggcgtgcctctcacacttgaaccgtctctagcaccaagtactctatccttctcccctagcttcctgctttctctctctgatcgatccctccctcatacgcaaaaacagaaacacagagaacagcctgaaaaagagggttgctggaacaatggaggaagcaaggatcccggggtacttcaagaacaagggcatcctcatcactggctcaacgggcttccttggaaagatacttgtggagaagatactgagggtccagccggacgtcaagaggatctacctcccggtgagagcgccggacgcggaatcggccaagaaacgggtggagactgaggtgatcggtaaggagctgtttgggctcctgcgggagacgcacggcaaggggttccagtccttcgtcgacgacaaggtcgtcccgctggccggcgacatcatccacgagaacttcggcgtggagggagcccagctggcgcagatgacccaagagatgaacgtcatcgtcaacggagccgccaccaccaacttctacgagaggtacgacgtggccctggacgtgaacgtgatgggagtgaagcacatgtgccggctggccaggcagtgccccaacctcgaggtcatcctccatgtctccaccgcttatgtggttggggagaggcagggggtgatccaggagcggccgttcaagcacggcgagacactgcgcggggacgacgcgcggctgcggctggagctggacgtcgacgccgag

SEQ ID NO: 41322 - protein, 198 aa, Panicum virgatum
  misc_feature: Ceres CLONE 2007364
  misc_feature (17)..(197): Pfam Name: NAD_binding_4 Pfam Description: Male sterility protein
  misc_feature: SWISSPROT Homolog: EC 1.2.1.31 L-aminoadipate-semialdehyde dehydrogenase
MEEARIPGYFKNKGILITGSTGFLGKILVEKILRVQPDVKRIYLPVRAPDAESAKKRVETEVIGKELFGLLRETHGKGFQSFVDDKVVPLAGDIIHENFGVEGAQLAQMTQEMNVIVNGAATTNFYERYDVALDVNVMGVKHMCRLARQCPNLEVILHVSTAYVVGERQGVIQERPFKHGETLRGDDARLRLELDVDA

SEQ ID NO: 41323 - DNA, 721 bp, Panicum virgatum
  misc_feature: Ceres CLONE 2007365
  misc_feature: Encodes the peptide sequence at SEQ ID NO. 41324
gaaaggaaagaagctgttgattctttccgtctggatccggaggtgaaggttgtaataattggaattactgctggcggtgttggcttagacttctcatctgctcagaatgttgttttcgtggagctcccgaaatcagcttcggaattgcttcaggccgaggatagagctcatagacgtggccaaactaatgcagtcaacatatatatattctgtgcaaagaacacatcggatgaatcacactggctccaattaaatcagagtctgttccgtgtctcatctttgatgaatggaaaaaaggatgctataagagagatcgaggttgatcaggtgtgccatcttgaggaaatcaggaacactgagaaaatagaatgcaaacttcatcctttggagaatcataatacagaaagtgatgatatttctattgaatgttttcctggcattgaagatttggaacttgactcagatttcactattaggacaattcctcttgaatttgaggatgaaagccttgggacatccttgaaaaataatccaactccaacagtacttgaagatagatcttgcattgatgtttctctttcgccagctgcagccttttgcactgcaatatcaagttgtaaatcaattaaggctcgtaggaggctttctggaaattcagggaccttaagtcagactgcacctatttcagattttcccattcaagtggagtctctgcgttttg

SEQ ID NO: 41324 - protein, 240 aa, Panicum virgatum
  misc_feature: Ceres CLONE 2007365
  misc_feature (1)..(60): Pfam Name: Helicase_C Pfam Description: Helicase conserved C-terminal domain
ERKEAVDSFRLDPEVKVVIIGITAGGVGLDFSSAQNVVFVELPKSASELLQAEDRAHRRGQTNAVNIYIFCAKNTSDESHWLQLNQSLFRVSSLMNGKKDAIREIEVDQVCHLEEIRNTEKIECKLHPLENHNTESDDISIECFPGIEDLELDSDFTIRTIPLEFEDESLGTSLKNNPTPTVLEDRSCIDVSLSPAAAFCTAISSCKSIKARRRLSGNSGTLSQTAPISDFPIQVESLRF

SEQ ID NO: 41325 - DNA, 1807 bp, Panicum virgatum
  misc_feature: Ceres CLONE 2007367
  misc_feature: Encodes the peptide sequence at SEQ ID NO. 41326
aaacacgcttcgcccttctttttcctttgcccaactcgtctcgtcttcgttcccctttcctcctccgcatcccggcttctcctcaccgcgtcaaacccagcaccaagcaaccgcccccgccaatctgccgccgcggtgcctaatccggccgatcccccctccgatccgcgggtgcccgccgcaaaggcggcgcctttgggcctcccccgatgtatagcaacttcaaggagcaggcaatcgagtacgtcaagcaggcggtccaggaggacaatgccggcaactatgtcaaggcgttcccgctctacatgaacgcgctcgagtacttcaagacccacctcaagtacgagaagaaccccaagatcaaggaggcaatcaccgccaagttcaccgagtacctccgccgcgccgaggagatccgggccgtcctcgatgagggcggcgcggggcccggggccaacggcggcgacgcggccgtcgccacgcgccccaagaccaagggcaaggacggggacggcggcaacggcggggacgactccgagcagtccaagctgagggcggggctcaattccgccatcatcaccgagaagccgaacgtcaagtggaacgacgtcgccggcctcgagagcgccaagcaggcgctgcaggaggccgtcatattgcccgtcaagttcccgcagttcttcacgggcaagcggaggccttggagggcttttcttttgtatggcccccctggaacgggaaagtcttatttggcaaaagctgttgcaaccgaggctgattcaacatttttcagtatatcttcatcagatctggtttcaaagtggatgggtgaaagtgagaaattagttgcgaaccttttcgaaatggctcgtgaaaatgccccttcaattatctttatcgatgaaattgattctttatgcggtcaacgtggagaaggcaatgaaagcgaagcttcaaggagaatcaagactgaactacttgtgcaaatgcagggtgttggccataatgatgataaagttcttgttcttgctgctacaaatacaccatatgctctggaccaggctgtgcggcgaagatttgacaagcgtatctacattccgctacctgacatgaaagcaaggcagcatatgtttaaggtccatctcggggatacaccccacagcttaacagaaagtgattttgagagcttggcccgtcgaacagatgggttttctggttcagatattgctgtttgtgtgaaggatgtgttatttgaacctgtccgcaaaacacaggatgccatgttcttctttaaggcagatggtgacatgtggatgccctgtggaccaaagcagccgggtgccatccagaccaccatgcaggagctagcatccaagggccttgctgcgaagattcttccaccacccatctccaggacagattttgaaaaggtcctgtcgaggcagaggccgacagttagcaagaaggacctggaggtgcacgagaggttcaccaaggagtttggcgaggagggctgatacaccgctcgcggacactcacccatgcacagctgcaccacagaaatgtatattgtttatgactttgattgttctgcatgcaagttggattcacaggattgtacattcggtagcccaactaaggttgatcatggctgcggctttatcatgtgttgggctatcgatgtgcgtctgttgtcatcttatttcgattttacacatacatggaatttttccacaggtgtataaaggaataataattcttaacgtggagtccttgtggtgcagtctgtatgtacagctgttttctc

SEQ ID NO: 41326 - protein, 435 aa, Panicum virgatum; identical to SEQ ID NO: 15243
  misc_feature: Ceres CLONE 2007367
  misc_feature (167)..(352): Pfam Name: AAA Pfam Description: ATPase family associated with various cellular activities (AAA)
  misc_feature (367)..(432): Pfam Name: Vps4_C Pfam Description: Vps4 C terminal oligomerisation domain
  misc_feature (5)..(73): Pfam Name: MIT Pfam Description: MIT (microtubule interacting and transport) domain
  misc_feature (118)..(353): SWISSPROT Homolog: EC 3.6.4.3 Microtubule-severing ATPase
  misc_feature (7)..(73): SWISSPROT Homolog: EC 2.7.11.1 Non-specific serine/threonine protein kinase

SEQ ID NO: 41327 - DNA, 726 bp, Panicum virgatum
  misc_feature: Ceres CLONE 2007373
  misc_feature: Encodes the peptide sequence at SEQ ID NO. 41328
gttgaatcttgagaattgagagagacaaatatccgtcgaggaggcgagagctcgaaggggaagcgagacgaccgccatggcaggcgccaccaacggcggcggcaaggtgatcagcctgccgctgcagtacttctgcgtgctggcggtggttgtggtggccgtgatggtgctgtcgctggccttcatgtcgccggcggccatggtagccgtccgccagaacctcggctccgtggccgccgcctccgccgggagcagcagcaacagcagcggcgccggagcgggaggcgcgggcctggccgccccagcaccgccggtggcccggagggagaaggagcaggcgcagcggccgccggtggtgctgttcaacttcggcgactcgaactcggacaccggcggcgtggcggcggccggaggcatccggatcatgccgccggagggccgcacctacttccgccgccccaccgggcggctctccgacggccgcgtgatcatcgacttcttctgtgagagcctgggaacccatgagctgaatccatacctcaagggaattggttcagactacagcaacggcgtcaacttcgccatggctggctcgacagcgagtcacggtgtctctacctactccttgaacgtccagatcgaccagttcgtctacttcaggcacagatccctcgagatgttcgaacgaggactgaaaggcccggtgagcaaaggagggtttgagaa

SEQ ID NO: 41328 - protein, 216 aa, Panicum virgatum
  misc_feature: Ceres CLONE 2007373
  misc_feature: SWISSPROT Homolog: EC 3.2.1.51 Alpha-L-fucosidase
MAGATNGGGKVISLPLQYFCVLAVVVVAVMVLSLAFMSPAAMVAVRQNLGSVAAASAGSSSNSSGAGAGGAGLAAPAPPVARREKEQAQRPPVVLFNFGDSNSDTGGVAAAGGIRIMPPEGRTYFRRPTGRLSDGRVIIDFFCESLGTHELNPYLKGIGSDYSNGVNFAMAGSTASHGVSTYSLNVQIDQFVYFRHRSLEMFERGLKGPVSKGGFE

SEQ ID NO: 41329 - DNA, 1341 bp, Panicum virgatum
  misc_feature: Ceres CLONE 2007375
  misc_feature: Encodes the peptide sequence at SEQ ID NO. 41330
gttttgtttgggctttagcgctcgctcgcttccctctctcttcgcgtgcggcggaaccgcggaacggctgcgctccgcctccatccctgcgctcgggaggcttcgatctgcggccgcgcttcggtgacatcttaaagaagattttcatatattttgttgaagatgaagagaacgcgaaaggcacagtcaggaaaatcccactcatggtggtgggatagccatatcagtcctcaaaactctaagtggctctccgagaatgtagaagaaatggagaagcaagtgaaagagatgctggagcttattggaggagaattctctgcagaaaaggctgaggtgtttaaccagcaacgacctttgcttgtcactcatgtggagaacttccatcacatgtatcgtgctctttctgcgcgatatgacaatgtgattggagaattgcgcaaatatatcccatcatctctgcaatcacatggctcttttggtgtctctgaatcagattctgagacactgtcttcctcatctcccgaatctgacatgcaagaaaatatgccacagcagaaacaaaaacctggaccagattaccttgatgtttctgttggctttggtgttagctctgatgtattgaagaaggggagtgaaggttcttcttcatcttcagattctgattcagagcttgatgaggcgaaagaggaaaatggaagtattgtgtatgccctgagccaaaaaatcattgagctagaagatgagcttcacgaagcaaggggaaagctcgttgctctggaggaaaagcatgcacattgccaggattattatggtaccaactcaaaagttgctgaacatgacgaaaaactggagacttcggatatggaatccaacaacattcagaaagaccttgaagaaagagaatctgctttaaagatccccacagaagtcaacagtggaaaggaagcatttgaaactgtgctgttggagcacaaacatgagatcgaagtgctgaagggagcaatggcctcagctgctaagcagtttgaggttgaattggcacatcgtgatcttgaaattgataagtgcaagcatgagcttgaagtagtctcagagaagtatttgcatgatatgtctactcttgaggatgagcacagaaggctccagggagttatcaagaatatggaaggtgacctagcaaaaatgtcagaggagaaattgctgctcgagtctcggattgaagaacttgagcaggcagctcacagcttagaacattcagcttctgagatagtgaagctgcaagaagtaacaaggaatacacaagcagaattagaaaaggttacagaggagaaagaagtcctc

SEQ ID NO: 41330 - protein, 392 aa, Panicum virgatum
  misc_feature: Ceres CLONE 2007375
  misc_feature (14)..(85): Pfam Name: KIP1 Pfam Description: KIP1-like protein
  misc_feature: SWISSPROT Homolog: EC 2.7.11.1 Non-specific serine/threonine protein kinase
MKRTRKAQSGKSHSWWWDSHISPQNSKWLSENVEEMEKQVKEMLELIGGEFSAEKAEVFNQQRPLLVTHVENFHHMYRALSARYDNVIGELRKYIPSSLQSHGSFGVSESDSETLSSSSPESDMQENMPQQKQKPGPDYLDVSVGFGVSSDVLKKGSEGSSSSSDSDSELDEAKEENGSIVYALSQKIIELEDELHEARGKLVALEEKHAHCQDYYGTNSKVAEHDEKLETSDMESNNIQKDLEERESALKIPTEVNSGKEAFETVLLEHKHEIEVLKGAMASAAKQFEVELAHRDLEIDKCKHELEVVSEKYLHDMSTLEDEHRRLQGVIKNMEGDLAKMSEEKLLLESRIEELEQAAHSLEHSASEIVKLQEVTRNTQAELEKVTEEKEV

SEQ ID NO: 41331 - DNA, 623 bp, Panicum virgatum
  misc_feature: Ceres CLONE 2007375-R
gcaagtttatgctgacaaggaagaagaatctctcaataatgagaagcaaatttctgtgctcaatcatgatatcgctgatctcaggagcaagcttgaattattatcatctgagaaagccacagttgatgataggttggccaatctgctagctgatattatggctcgcgatgaaaagatgaagcaggtggacgatcacctgaatcagcttcagtttgagcatgccaagctgatggcagagtctgactctgccagcaagtccttatcagaggtgcgtgcgcgagtttctgagctggaggaagaggtcgaaaaacagaagcttgtgatatccgagagcgcagagggaaagcgagaggccatcaggcagctgtgcttctccattgaacactaccgcagcgggtatgagcagctccggcagctgctgcaaggccacaggaggctattggtgatggcaacctgataaatgaacaatatcagtttgccaatgaaatgcacactcgcatgtcttttgtcctgttctatatgtggtatgtgcgtgaaatgtaatggggtgggataatcgtattgctcctttgtactctttggagttttgttcttgtcagctattgaatattatgaacattgct

SEQ ID NO: 41332 - DNA, 314 bp, Panicum virgatum
  misc_feature: Ceres CLONE 2007377
  misc_feature: Encodes the peptide sequence at SEQ ID NO. 41333
aagccgagcaacgcaaataaaggcatcctcgtactcgcctatcaccgcaagtctaagctttcacccctacccccaacccaccgccgccgcccaggcctgccgacgacaccaggacggacgtgcatctcgatcaacatcgctcacggcgggatccagttcggaaacgcatgctgggagctctactgcctctagcatgggattcagggtgatgggcagatggcagccgacaagaccagtggaggaggtgatgatggtttcaacaccttcttcaccgagactggcgctgggaaggccgtcccccgcgctgtatttgc

SEQ ID NO: 41333 - protein, 32 aa, Panicum virgatum
  misc_feature: Ceres CLONE 2007377
  misc_feature: Useful for making plants with altered cell wall content and/or composition
MAADKTSGGGDDGFNTFFTETGAGKAVPRAVF

SEQ ID NO: 41334 - DNA, 1338 bp, Panicum virgatum
  misc_feature: Ceres CLONE 2007379
  misc_feature: Encodes the peptide sequence at SEQ ID NO. 41335
aattaaggcaaccacccaacccaaatcatgacgccccaaagcaattttaagcaaagcaaagcaattaagcaaaggcaaagccttcctccgctcagctgtcagctccgaggaccctcgcctggagcgccatgagaggagatcccaagccgccgccgaggaaaagcccagcagctcccaccctcgccggcaggctgcggaagcactccacgtcccttctcctcctcctcctctggttcgccctctccctctacctcttcatctcccccacgccgcccgccgccgcgccgctccggcgctccgccttcctccgctccaaggcccgcgccctctcagccaccaccgcaggcgcaccccccgttcggatctacgtctacgacctccccgcccgcttcaaccgcgactgggtggccgccgacgcgcgctgcgcccgccacctcttcgcggccgaggtggccgtgcacgaggcgctgctggcctacgccggccgcgccgcgcgccccgacgatgccgacctcttcttcgtccccgtctacgtctcctgcaacttctccacgcccaacggcttcccctcgctctcgcacgcgcggggcctgctcgccgacgccgtccacctcctccggacccagatgccctactggaatcgctccgccggggccgaccacgtcttcgtcgcctcgcacgacttcggcgcctgcttccatcccatggaggatgtggccatcgccgacggcataccagagttcctgaagagatccatcctgctgcagacatttggtgtgcagggccatcacgtatgtcaggaggtggagcatgtggtgatcccacctcatgtgccaccagaggtgtctcatgagctaccggagccagaaaaggtgcggagggacatttttgccttcttccggggcaaaatggaggtgcaccccaagaacattagtggccgcttctacagcaagaaggtgaggactgagctactacagcattatggtcgcaatcgcaagttttatcttaagagaaagcgattcgacaactaccaatcagaaatggctcgttctctgttctgtctctgtccgctgggatgggctccatggagtcctcggcttgtggaatcagtcctcctcggctgcattcccgtcataattgctgataacatacgtctgccgttcccttctgtccttcggtggccagaaatctcattgcaggtagctgagaaggacatagccagtcttgagacggtgctcgatcatgttgtggcgaccaatttgaccagaatacagaggaacttgtgggatccaatgaagcggaaggcactggttttcaaccgcccaatggaagtgggag

SEQ ID NO: 41335 - protein, 403 aa, Panicum virgatum
  misc_feature: Ceres CLONE 2007379
  misc_feature (79)..(385): Pfam Name: Exostosin Pfam Description: Exostosin family
  misc_feature: Useful for making plants with altered cell wall content and/or composition
  misc_feature: Useful for making plants with altered carbohydrate content
MRGDPKPPPRKSPAAPTLAGRLRKHSTSLLLLLLWFALSLYLFISPTPPAAAPLRRSAFLRSKARALSATTAGAPPVRIYVYDLPARFNRDWVAADARCARHLFAAEVAVHEALLAYAGRAARPDDADLFFVPVYVSCNFSTPNGFPSLSHARGLLADAVHLLRTQMPYWNRSAGADHVFVASHDFGACFHPMEDVAIADGIPEFLKRSILLQTFGVQGHHVCQEVEHVVIPPHVPPEVSHELPEPEKVRRDIFAFFRGKMEVHPKNISGRFYSKKVRTELLQHYGRNRKFYLKRKRFDNYQSEMARSLFCLCPLGWAPWSPRLVESVLLGCIPVIIADNIRLPFPSVLRWPEISLQVAEKDIASLETVLDHVVATNLTRIQRNLWDPMKRKALVFNRPMEVG

SEQ ID NO: 41336 - DNA, 683 bp, Panicum virgatum
  misc_feature: Ceres CLONE 2007379-R
aagtgggagatgctacatgcaaagtgttgagggaacttgagattttgctagaccagtctcagagaaggtatgttggctcctggaggtgaagaccatagaggattcgttcatccaatctgctgcagctgtgcaactattgcctgctgcacatgcctaactcacagcatcgacggtcagtccacgctgagcctgagatctacttctgacatggatttttttttctggccagaaattcagaatatgaatctcaaaccagagaatctcaaaccagagctctatttgtgatatatttttcttgccagaatcttagaatataaacctcataccagagatcccaaccttcatcagtcaatgggatgctagctcaaccagggttggtgcctaactggagctctcaattccagcgtggcaagttgaccccgactccgtgtgtatagggaattttttactcatttatttattctttggagaagtgggaagagcctgctttttcttgccataggaagaacattagatcttattgtattacatgatgtgcatatctatgtatgtattttctggttgtacctgtacacttgtagagttggtaggcttttccaattagtatccagtagatcgaagggtgccaaaaaaatgtattggtgattggatgataaccagtagcactctactattgaaagcac

SEQ ID NO: 41337 - DNA, 1285 bp, Panicum virgatum
  misc_feature: Ceres CLONE 2007388
  misc_feature: Encodes the peptide sequence at SEQ ID NO. 41338
aagcagcttcccgggtatgaaatcggtgaaaaagaggatctaaaagggccgtgactcacctggttgggccaaagcaaccactgtaacaaagtttcatgaagccttttctgcaaccccctctcttttcaccactcgttggtattgcgctcaactttcacacagtcacggccccaagggtctttcggtttccggttcgtggcctcacagctctcgctccttctaccccgcgatcgtacgctttcaaaaagtatacgcccaccaaaaaaaaagaaaacgcccagtatgaccacgacagccaccaccctcaagggccagcccctcgacaaggcggccctcgaatccctcctgcgccgtcgcttgttctacactccctcgttcgagatttacggtggtgtctcgggtctttacgactacgggccacctggctgcgccctgcaggcaaacatcatcgacctatggcgcaaacacttcatcctcgaggaggacatgctcgaggtcgattgtaccgtcctcacgccccatgaggttctcaagaccagcggccacgttgagaagtttgcggactggatgtgcaaggaccctaagaacggcgagattctccgtgccgaccattttgtggaggatgtcctcgagtcgcggctaaagggagataaggaggcccgcggccaaaaggtggaagagaaggcggatgttggcgatggccagaagacagaggagaaggcagaggactctaagcggaagaagaagaaggcaaagggccaggaggccatcaagctggatgacgctgtggttcaggagtacgaggaggtgctagcaaagattgacaactacaatggcgatcagctgggtgagctcatcaagaagtacgacctcaggaaccccgcgaccggcgaacagcccagccctccggtggcgttcaacctcatgttccagacggccattggccccagcagcaacacacctggctacctccggccggaaaccgcccagggccagttcttgaacttcgccaagctccttgagttcaatactggtcagatgccctttgcctctgcttccattggaaagtcgtaccgcaacgagatttccccaagggctggtcttctacgtgttcgggagtttcttatggcggagatcgaacactttgtcgaccccgaaggccacaagaagcaccaccggttccatgaagtcgaggacatcgagcttgagttcctggaccgccacgtccagctgtctggcaagactactacgacgaagctgaccgttgggaaagccgtcaaggacg

SEQ ID NO: 41338 - protein, 334 aa, Panicum virgatum
  misc_feature: Ceres CLONE 2007388
  misc_feature (51)..(334): Pfam Name: tRNA-synt_2b Pfam Description: tRNA synthetase class II core domain (G, H, P, S and T)
  misc_feature: SWISSPROT Homolog: EC 6.1.1.14 Glycine--tRNA ligase
MTTTATTLKGQPLDKAALESLLRRRLFYTPSFEIYGGVSGLYDYGPPGCALQANIIDLWRKHFILEEDMLEVDCTVLTPHEVLKTSGHVEKFADWMCKDPKNGEILRADHFVEDVLESRLKGDKEARGQKVEEKADVGDGQKTEEKAEDSKRKKKKAKGQEAIKLDDAVVQEYEEVLAKIDNYNGDQLGELIKKYDLRNPATGEQPSPPVAFNLMFQTAIGPSSNTPGYLRPETAQGQFLNFAKLLEFNTGQMPFASASIGKSYRNEISPRAGLLRVREFLMAEIEHFVDPEGHKKHHRFHEVEDIELEFLDRHVQLSGKTTTTKLTVGKAVKD

SEQ ID NO: 41339 - DNA, 604 bp, Panicum virgatum
  misc_feature: Ceres CLONE 2007388-R
  misc_feature: Encodes the peptide sequence at SEQ ID NO. 41340
agccgtcgttcggtattggccggatcctgtactcgctgatggagcacaactactggacccgagccagcgagggtggcgatgaggcccgtggtgtcctgtccttccctcccgcggtcgcgccgacgaaggtccttatcgttcctctgtcatcccacaaggactttgcgcccgccgtccgcaagctgtcgcagaagctcaggtccgccggcatctctagccgtgtggatgactcgtccgctagcattggcaagcggtacagcagaaacgacgagctgggcacgccattcggtattaccgtcgactttcagacggtcaaagacgacaccatcactctcagagagcgtgatagcacgcgacaggtgcgcgctgaggaggacaagatcatcgaggccatccgggcgttggtcgagggcaccaagacatggcaggacatcgagtctgaactgcctctctttgagggccagcaggaggtggaggttactgtccgttaagaacagcagcgtcgagttaaaagatggttcggttttatttggtcgggttgagcgcgccttgccaactacatacaccctttggcatacgccacaatagagctctctctagacgg

SEQ ID NO: 41340 - protein, 162 aa, Panicum virgatum
  misc_feature: Ceres CLONE 2007388-R
  misc_feature (42)..(134): Pfam Name: HGTP_anticodon Pfam Description: Anticodon binding domain
  misc_feature: SWISSPROT Homolog: EC 6.1.1.14 Glycine--tRNA ligase
PSFGIGRILYSLMEHNYWTRASEGGDEARGVLSFPPAVAPTKVLIVPLSSHKDFAPAVRKLSQKLRSAGISSRVDDSSASIGKRYSRNDELGTPFGITVDFQTVKDDTITLRERDSTRQVRAEEDKIIEAIRALVEGTKTWQDIESELPLFEGQQEVEVTVR

SEQ ID NO: 41341 - DNA, 652 bp, Panicum virgatum
  misc_feature: Ceres CLONE 2007395
  misc_feature: Encodes the peptide sequence at SEQ ID NO. 41342
tgttggtgatcgtttgtatgatgaagagctgtatgaagctgcaaagatcatctatgctttcatctcaaactgggctaagctggctgttaccctggttaagctgaagcagttccaaggtgctgtggatgctgctcgtaaggctaacagcgcgaaaacatggaaggaggtctgctttgcttgtgttgacgcagaggagttccgtcttgcacagatatgtggtctaaatattattgtccaggttgatgacttggaagaagtgagtgaatactaccagaatagaggatgcttcaatgaacttattgctctcatggagagtgggcttggacttgaacgtgcacacatgggcatcttcacagaactgggagttctgtatgctagataccgatctgagaagcttatggagcacatcaaacttttctccacccgtctcaacattcctaagctaatccgggcttgcgatgaacagcaacactggaaagaacttacctacctgtacatacagtacgatgaatttgacaatgctgccaccactatcatgaaccactctccagatgcatgggatcatatgcagttcaaggatgtttgtgttaaagttgcaaatgttgaactatattacaaggcagttcacttctatttgcaagagcaccctgat

SEQ ID NO: 41342 - protein, 216 aa, Panicum virgatum
  misc_feature: Ceres CLONE 2007395
  misc_feature (74)..(216): Pfam Name: Clathrin Pfam Description: Region in Clathrin and VPS
VGDRLYDEELYEAAKIIYAFISNWAKLAVTLVKLKQFQGAVDAARKANSAKTWKEVCFACVDAEEFRLAQICGLNIIVQVDDLEEVSEYYQNRGCFNELIALMESGLGLERAHMGIFTELGVLYARYRSEKLMEHIKLFSTRLNIPKLIRACDEQQHWKELTYLYIQYDEFDNAATTIMNHSPDAWDHMQFKDVCVKVANVELYYKAVHFYLQEHP

SEQ ID NO: 41343 - DNA, 741 bp, Panicum virgatum
  misc_feature: Ceres CLONE 2007396
  misc_feature: Encodes the peptide sequence at SEQ ID NO. 41344
agaactatttctccctcccgccctccgccgacgccgccgctctctctccctccctgctccttcactcttccatctcatcaccaacccccagccgagctcgcaaatgctctctgccaccatcgccgcgcaccccgccgccgccataaccctgcggcaacggcactcgctccgccctctccagcgactccgtgttcccatcggcgcggcgccgccgaggcggcggatggcaacggcgaggcccttagtggtcaaggccctagctagccagggcgtccccgcggtgccccccaagctctcctttccgatactggtgaatagttgtactggaaaaatggggaaggctgtggcagaagcagctgtatcagccggtcttcagttagttccggtatcattcagtgccatggaagtccctgatggaagacttgaaatctgcgacagagaaattcaaattcatgacccttctgaaagtgaaaaaattctcccttccattattgaagagtacccagatctcatagtcgtcgattacactgttcctgatgctgtcaatgccaatgctgaactctattgcaaattgcgcttgccatttgtaatgggcacgacaggtggaaataggcaactgctgcacaaaaccgtgcaggatgcaaatatttatgctgtgatatccccacagatgggaaagcaggtcgttgcttttcttgctgccatggaaatcatggcagagcaattccctggtgcattttc

SEQ ID NO: 41344 - protein, 212 aa, Panicum virgatum
  misc_feature: Ceres CLONE 2007396
  misc_feature (66)..(190): Pfam Name: DapB_N Pfam Description: Dihydrodipicolinate reductase, N-terminus
  misc_feature: SWISSPROT Homolog: EC 1.3.1.26 Dihydrodipicolinate reductase
MLSATIAAHPAAAITLRQRHSLRPLQRLRVPIGAAPPRRRMATARPLVVKALASQGVPAVPPKLSFPILVNSCTGKMGKAVAEAAVSAGLQLVPVSFSAMEVPDGRLEICDREIQIHDPSESEKILPSIIEEYPDLIVVDYTVPDAVNANAELYCKLRLPFVMGTTGGNRQLLHKTVQDANIYAVISPQMGKQVVAFLAAMEIMAEQFPGAF

SEQ ID NO: 41345 - DNA, 1453 bp, Panicum virgatum
  misc_feature: Ceres CLONE 2007407
  misc_feature: Encodes the peptide sequence at SEQ ID NO. 41346
aatatcataaattattctcacctctccaaatgccaaaggaaaagattcacgttaacttggtcgtcatcggtcacgtcgatgctggtaaatccacctccactggtcacttgatctacaagtgcggtggtatcgacaagagaaccatcgaaaagttcgagaaggaagccaacgaactcggtaagggttctttcaagtacgcttgggtcctcgataagctcaaggctgaaagagaaagaggtatcaccatcgatatctccctctggaaattcgaaactggtaagtatcacttcaccattatcgatgcccccggccatagagatttcatcaagaacatgattaccggtacttcccaagccgatgttgctctcctcatgattgcctctccccccggtgaattcgaagctggtatctccaaggaaggacaaaccagagaacacgctctcttggccttcactttgggtgtcaagcaaatgatcgtctgtgttaacaagatggacgaaaagaccgtctcctggtctcaatccagattcgacgaaatccaaaaggaagtcgccgaatacttgaagaaggtcggttacaaccccgctaaggttcccttcgtccccatttccggatggcacggtgacaacatgctcgaaaagtcccccaaccttacctggttcaagggccccactctcctcgaagccctcgatgctatcatcccccccaagagacccctcgacaagcccctcagacttccccttcaagacgtctacaagatcggtggtatcggaacagtccccgtcggtagagtcgaaaccggtatgttgaagcccggcatgaccgtctacttcgctccctccaacgtctccactgaagtcaagtccgtcgaaatgcatcacgaatccgtccaagaagccatccccggtgacaacgtcggtttcaacatcaagaacgtcgctgttaaggacatcagaagaggtaacgtttgcggtgatgccaagaacgatccccccaaggaagctgcttctttctatgctcaagttatcgtcctcaaccatcccggtcaaatcggtaacggctactgccccgtcctcgattgccacactgcccatattgcctgcaagttcgctgaaatcaaggaaaagatcgacagaagaactggtaccgtcctcgaagaagaacccaagtccgtcaagtctggtgattgcgctatggttaccctcatccccaacaagcccatgtgcgttgaagccttctctgactatccccctcttggtagattcgccgttagagacatgaagcaaactgtcgctgtcggtgtcatcaagtccgtcgaaaagaagacccccgctgccaagaaataaacttgattgttttatttcatattatttgatataagtatattcataaatatgctttcatataatttgcccaataagagttattataattgacccttaaaaaaaacatc

SEQ ID NO: 41346 - protein, 438 aa, Panicum virgatum
  misc_feature: Ceres CLONE 2007407
  misc_feature (5)..(226): Pfam Name: GTP_EFTU Pfam Description: Elongation factor Tu GTP binding domain
  misc_feature (322)..(430): Pfam Name: GTP_EFTU_D3 Pfam Description: Elongation factor Tu C-terminal domain
  misc_feature (248)..(315): Pfam Name: GTP_EFTU_D2 Pfam Description: Elongation factor Tu domain 2
  misc_feature: SWISSPROT Homolog: EC 2.7.7.4 Sulfate adenylyltransferase
MPKEKIHVNLVVIGHVDAGKSTSTGHLIYKCGGIDKRTIEKFEKEANELGKGSFKYAWVLDKLKAERERGITIDISLWKFETGKYHFTIIDAPGHRDFIKNMITGTSQADVALLMIASPPGEFEAGISKEGQTREHALLAFTLGVKQMIVCVNKMDEKTVSWSQSRFDEIQKEVAEYLKKVGYNPAKVPFVPISGWHGDNMLEKSPNLTWFKGPTLLEALDAIIPPKRPLDKPLRLPLQDVYKIGGIGTVPVGRVETGMLKPGMTVYFAPSNVSTEVKSVEMHHESVQEAIPGDNVGFNIKNVAVKDIRRGNVCGDAKNDPPKEAASFYAQVIVLNHPGQIGNGYCPVLDCHTAHIACKFAEIKEKIDRRTGTVLEEEPKSVKSGDCAMVTLIPNKPMCVEAFSDYPPLGRFAVRDMKQTVAVGVIKSVEKKTPAAKK

SEQ ID NO: 41347 - DNA, 688 bp, Panicum virgatum
  misc_feature: Ceres CLONE 2007415
  misc_feature: Encodes the peptide sequence at SEQ ID NO. 41348
gctcctgaaggccctcaaggctgctggtgccgagagcgtccagatcgacgagcccgtcctcgtcttcgatctccgccccgagatcaaggccgccttcaagcccgcatatgaggctattgccgctcagggcagcgccgttccctctgtcgtcgtcgccacctacttcggtgacatcgtccacaactttgacgtcctccctgcctttgccaaaacccagggtctccacgtcgaccttgtccgcaaccccgagcagctcgagcctgtcctcaagcagctcggcgccaaccagatcctctctgccggtgtcgttgatggcaggaacatctggaagaacgacttcaagaagtcgcttgaccttctccagaccgccatcaaggccctcggccctgagcgtgtccttgttgccacttccagctctctcctccacaccccgcacaccctcgccagcgagaagaagcttcccgctgacgtctacgagtggttctcatttgccagcgagaaggtcaaggaggttgctatccttgccaaggctgtgtccgatgccggcgctgtcagcgctgagctcgaggccaacgctgccgccatgaaggcacgcgccgagtcgacccgcaccaacgaccccaaggtcaaggagcgtcagtctcaggttaccgaggctcagcacaaccgcaagactgagttcgaccac

SEQ ID NO: 41348 - protein, 228 aa, Panicum virgatum
  misc_feature: Ceres CLONE 2007415
  misc_feature (1)..(128): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
LLKALKAAGAESVQIDEPVLVFDLRPEIKAAFKPAYEAIAAQGSAVPSVVVATYFGDIVHNFDVLPAFAKTQGLHVDLVRNPEQLEPVLKQLGANQILSAGVVDGRNIWKNDFKKSLDLLQTAIKALGPERVLVATSSSLLHTPHTLASEKKLPADVYEWFSFASEKVKEVAILAKAVSDAGAVSAELEANAAAMKARAESTRTNDPKVKERQSQVTEAQHNRKTEFD

SEQ ID NO: 41349 - DNA, 704 bp, Panicum virgatum
  misc_feature: Ceres CLONE 2007439
  misc_feature: Encodes the peptide sequence at SEQ ID NO. 41350
ccacccaaaacccacgcaggaggagccagcgcagccggagcagcaaaccgcccgccccctcctccccccgcccgccgcttcgcccccatggagccggtgccgccggcgacggccgccggcatggggggccccgggcccgggcccgggtaccccgagtccacggagtcctccccccgcagccgcggcggggactcgtgggacgagcccttcccgtcctccgcggcggccgcggccgccgcggccggcggcgggggccggctccgcctgatgtgcagcttcgggggccggatcgtcccgcgcccgacggacaagtccctctgctacctgggcggggagacccggatcgtggccgtcgaccgccacgcctcgctcgccgacgtccacgcgcgcctctcgcggtcgctgctcgggggccagcccttcacgctcaagtaccagctccccaacgaggacctcgactcgctcatctccgtctccaccgacgaggacctcgacaacctcgtcgacgagtacgaccgcatcgccgccgcctcctccggcggcggatcctcgcgcacctcgcggatccggctattcctcttccccgccaagcccgagtcctcctcctccctcggctccctcctcgacgactcctccaagtccgagaactggttcgtcgacgccctcaacagcgccatctccggctccctcgacggcatccccag

SEQ ID NO: 41350 - protein, 205 aa, Panicum virgatum
  misc_feature: Ceres CLONE 2007439
  misc_feature (72)..(167): Pfam Name: PB1 Pfam Description: PB1 domain
MEPVPPATAAGMGGPGPGPGYPESTESSPRSRGGDSWDEPFPSSAAAAAAAAGGGGRLRLMCSFGGRIVPRPTDKSLCYLGGETRIVAVDRHASLADVHARLSRSLLGGQPFTLKYQLPNEDLDSLISVSTDEDLDNLVDEYDRIAAASSGGGSSRTSRIRLFLFPAKPESSSSLGSLLDDSSKSENWFVDALNSAISGSLDGIP

SEQ ID NO: 41351 - DNA, 717 bp, Panicum virgatum
  misc_feature: Ceres CLONE 2007441
  misc_feature: Encodes the peptide sequence at SEQ ID NO. 41352
gcacgcctttcacacttgatgggttgccgccaccgacgacgaaccgcccggcggcagggatgtcccggcgttcgcggagttctccctggcggacctccgcgcggccacgggcgggttcgcggccgagaacatcgtctccgagagcggcgagaaggcgcccaacctcgtctacaggggccagctcgagggcagcggcggcgcgccgccgcgcgcgattgccgtgaagaagttcgccaagctcgcgtggcccgaccccaagcagttcgcggaggaggccaagggggtggggggcctgcgccaccggaggatggcgaacctgatcggctactgctgcgacggcgacgagcgcctgctcgtcgccgagttcatgcccaacgacaccctcgccaagcacctgtttcactgggaaaaccagactatagaatgggctatgcgtctgagagttgcatactacatctcccaagcattggaatattgtagtatcaagggaaggcctttatatcatgacttaaatgcatacagggtcctctttgatgagaatggtgaccctcgtctgtcatgctttggtctgatgaaaaacagcagggatggcaaaagctatagcacgaacctagcatatacacctccagaatatctcagaaatggaagggttactccagaaagtgtcatattcagttttggcactgtacttctcgaccttctcagtggaaaacgtat

SEQ ID NO: 41352 - protein, 136 aa, Panicum virgatum
  misc_feature: Ceres CLONE 2007441
  misc_feature: SWISSPROT Homolog: EC 2.7.11.1 Non-specific serine/threonine protein kinase
MANLIGYCCDGDERLLVAEFMPNDTLAKHLFHWENQTIEWAMRLRVAYYISQALEYCSIKGRPLYHDLNAYRVLFDENGDPRLSCFGLMKNSRDGKSYSTNLAYTPPEYLRNGRVTPESVIFSFGTVLLDLLSGKR

SEQ ID NO: 41353 - DNA, 658 bp, Panicum virgatum
  misc_feature: Ceres CLONE 2007445
  misc_feature: Encodes the peptide sequence at SEQ ID NO. 41354
cagtcaagtccaactcgagatctgtcacaagcattaccgatgtcaacttctcatccgactgaggcctcagacaccaatacaagcagcaatgatgaccattcatcaggaacaccaaataggaggtctaaagtttgggaacactttgagacagagttggtcgaggtggatggtgctctgaaggttgtttgcagatactgcagcatgaagatggctagcggaaaatcaggtacaaatagtttgagaaatcacataaaagattcttgttgaaaaattagtgcagatgatagatagatgtttattgccacaattcagaaacaaccagcgggtccatttaccttcaatcctcaaataagtcgtgagttaatgataacttggtgcattcgggcagaggttgcatttaataaatttgaggacccaagtttttcaccatggatggcatccttgcagcccacatttgattgcattgggcgccaaacaatccgcaatgattgtgtttgtatgtatgggagagtgaagcaaacattagcaagtgaactgcaaggtcttgattctcacatatgctttacttctgatctgtggacatctaaccaaaagctgggatatatatgtctaacaacccattatgtggatgctaactttgccttgcataagaaaatat

SEQ ID NO: 41354 - protein, 75 aa, Panicum virgatum
  misc_feature: Ceres CLONE 2007445
  misc_feature (29)..(72): Pfam Name: zf-BED Pfam Description: BED zinc finger
MSTSHPTEASDTNTSSNDDHSSGTPNRRSKVWEHFETELVEVDGALKVVCRYCSMKMASGKSGTNSLRNHIKDSC
